United States Patent 11,098,302 (IDENTIFICATION OF POLYNUCLEOTIDES ASSOCIATED WITH A SAMPLE) - sequence listing, part 74

SEQ ID NO: 254136 - DNA, 866 bp, Homo sapiens
  misc_feature: GYAE6OF02JJ166.13.25.C03.1.454.CMB.1.raw
  modified_base (208)..(208): a, c, t, g, unknown or other
  misc_feature (208)..(208): n is a, c, g, or t
  modified_base (295)..(295): a, c, t, g, unknown or other
  misc_feature (295)..(295): n is a, c, g, or t
tcagtcacgtactacacgaccggtgctcgatttagtagtgtagatttgggtttgggggtaggcgatcacccagcaaccacatctgtcctctagagaatcccctgagagctccgttcctcaccatggactggacctggaggatcctcttcttggtggcagcagccacagcagcccactcccaagtgctcctgaaacagtccggggctgnggtgaagacgccgtggggcctcaggtgaaggttcctccgtggccaagggtccttccggattaccgacccctacgaatcggaaacttntacgtcccaatacgtgtgtcgacgtacggccccgaggacgaaagggcttccgtggtacggtaggtcgggggttaggactaccgaaaccccttaagttacggtgggtaggtaaccaacgtaaaaccgttatacggaaggaaaaggtaaaacgttttcgggaacggggtacccggggttacaaacccgagttacggaaccccgtaaggggggaaccctaaccgggttacccaaagttacccgaaaacgttaaccggaaccgttcccgtttaccgaaacggtttagggaaacccgtttaccggaaacccgtaacggtaaccgttacggtaaccccgttcgttacgggaaaccgacccggtaaccgggtcccgttaacggttaacgttttaacccgtgggttacccggaccgggttaacccggtaaaaccgttccggtaaccgggtaacccctttaaacggttttaccggtttaacgggtttaaaccgggtttttcggggggtaacccgaacgggggtttacccctcccggtttaaggggttacccccttaacccgggtttcccgttaacccccg

SEQ ID NO: 254137 - DNA, 251 bp, Homo sapiens
  misc_feature: GYAE6OF02IWPX3.13.25.C03.1.454.CMB.1.raw
  modified_base (239)..(239): a, c, t, g, unknown or other
  misc_feature (239)..(239): n is a, c, g, or t
  modified_base (245)..(251): a, c, t, g, unknown or other
  misc_feature (245)..(251): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcgggagggtccaaagtgaccgtcctaggtcagcccaaggctgccccctggtcactctgttccccacctcctctagtacgtgactgagcgggctggcaagggcncatagnnnnnnn

SEQ ID NO: 254138 - DNA, 566 bp, Homo sapiens
  misc_feature: GYAE6OF02HLE3D.13.25.C03.1.454.CMB.1.raw
  modified_base (447)..(447): a, c, t, g, unknown or other
  misc_feature (447)..(447): n is a, c, g, or t
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccgggctgaggtgaagaagcctgggcctcagtgaaggtctcctgcaaggcttccggataccaccctcaatggaaactatgtccactatgtgcgacaggccccaggaccaagggcttcgtgtggagtggggtgatcaaccctaataggtggtgacacaaactatagagaagaaatttggagggtccggtacaccatcgaccgagggacacgtcatacaatacagccttcatgaactgaccagactcgacctcngaccgacacggccgtgtacttacgtgtgcggtacaactcagtacctaacttacgtttagtaacgttttcggggacctacgggaccgtcccgttagggtaccctacccggttcttccccg

SEQ ID NO: 254139 - DNA, 265 bp, Homo sapiens
  misc_feature: GYAE6OF02HA26X.13.25.C03.1.454.CMB.1.raw
  modified_base (245)..(265): a, c, t, g, unknown or other
  misc_feature (245)..(265): n is a, c, g, or t
tcagtcacgtactacacgaccggtgctcgatttagtagtgtagatttgggtttggggggtgtggtggtctccactcccgccttgacgaggctgcctattactgctgctcatatgcaggtttcttctgtggtcttcggcggagggtccaaagtgaccgtcctaggtcagcccaaggctgccccctggtcactctgttccccaccctcctctagtacgtgactgagcgggctggcaaggcgcatagnnnnnnnnnnnnnnnnnnnnn

SEQ ID NO: 254140 - DNA, 252 bp, Homo sapiens
  misc_feature: GYAE6OF02H0X3U.13.25.C03.1.454.CMB.1.raw
  modified_base (247)..(252): a, c, t, g, unknown or other
  misc_feature (247)..(252): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctcgccccctcggtcactctcgttccccaccctcctctagtacgtgactgagcgggctggcaaggcgcatagnnnnnn

SEQ ID NO: 254141 - DNA, 258 bp, Homo sapiens
  misc_feature: GYAE6OF02JJM6R.13.25.C03.1.454.CMB.1.raw
  modified_base (193)..(193): a, c, t, g, unknown or other
  misc_feature (193)..(193): n is a, c, g, or t
  modified_base (224)..(224): a, c, t, g, unknown or other
  misc_feature (224)..(224): n is a, c, g, or t
  modified_base (250)..(258): a, c, t, g, unknown or other
  misc_feature (250)..(258): n is a, c, g, or t
tcagtcacgtactacacgaccggtgctcgatttagtagtgtagatttgggtttggggggtgtggtggtctccactcccgccttgacgaggctgcctattactgctgctcatatgcagttcttctgtgtcgttcggcgggaggtaccaaagtgaccgtcctaggtcacgcccaaggctcgcccccgtcggtacncctctcgttccccaccctcctctagtacgtnacgtgaggcggctggcaggcgcatgnnnnnnnnn

SEQ ID NO: 254142 - DNA, 263 bp, Homo sapiens
  misc_feature: GYAE6OF02I8WGN.13.25.C03.1.454.CMB.1.raw
  modified_base (243)..(263): a, c, t, g, unknown or other
  misc_feature (243)..(263): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggaggtccaaagtgaccgtcctaggtcagcccaaggctgccccctcggtcactctgttcccaccctcctctagtacgtgactgagcgggctggcaaggcgcatagnnnnnnnnnnnnnnnnnnnnn

SEQ ID NO: 254143 - DNA, 247 bp, Homo sapiens
  misc_feature: GYAE6OF02FLFI7.13.25.C03.1.454.CMB.1.raw
  modified_base (244)..(247): a, c, t, g, unknown or other
  misc_feature (244)..(247): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgccctcctctagtacgtgactgagcgggctggcaaggcgcatagnnnn

SEQ ID NO: 254144 - DNA, 722 bp, Homo sapiens
  misc_feature: GYAE6OF02JRZ3Q.13.25.C03.1.454.CMB.1.raw
  modified_base (229)..(229): a, c, t, g, unknown or other
  misc_feature (229)..(229): n is a, c, g, or t
tcagtcacgtactacacgaccggtgctcgatttagtagtgtagatttgggtttgggggggtcgacgaagaggcagcgctctcggacgtctccaccatggcctggctctgctgctcctcactctcctcactcaggacacaggtcctgggcccagtctcgccctgactcagcctgcctccgtgtctgggtctcctggacagtcgatcaccatctcctgcactacggaaacngcagtgaactcgttagggactttatagactttgtccttccgtacgtaccaacgacccaccgagaccgaaccgcccccaaggacgtacgactactaagtttacgtcggggactaaacgtacgggaccgtccggtacgaacgggtactttacccgacgttccggtcttcgtccgtcggtcctaccgtaacgtcgtcgacctaaaccgccggtaccctacccttagaacctaactccgtacttcggtacctccgtaggccgtaggtaacggaccgtaagggtcctcggtacccttagtttactcggttacgtctccttacgtagttacgtcggtaccggttacgtttaccgtttcgttcggttacggtttccgtacggggtccggtaacgggtacttaacgggtcccgttaaccgggtccgttaacggtcccgtaacggtacccgtaacgggtcccctaaccggtccccccgtttacggtccctaacgtttccccg

SEQ ID NO: 254145 - DNA, 246 bp, Homo sapiens; identical to SEQ ID NO: 253801
  misc_feature: GYAE6OF02GENON.13.25.C03.1.454.CMB.1.raw
  modified_base (243)..(246): a, c, t, g, unknown or other
  misc_feature (243)..(246): n is a, c, g, or t

SEQ ID NO: 254146 - DNA, 257 bp, Homo sapiens
  misc_feature: GYAE6OF02HKQ2D.13.25.C03.1.454.CMB.1.raw
  modified_base (243)..(257): a, c, t, g, unknown or other
  misc_feature (243)..(257): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgccctcctctagtacgtgactgagcgggctggcaaggcgcatagnnnnnnnnnnnnnnn

SEQ ID NO: 254147 - DNA, 569 bp, Homo sapiens
  misc_feature: GYAE6OF02GMG2X.13.25.C03.1.454.CMB.1.raw
  modified_base (228)..(228): a, c, t, g, unknown or other
  misc_feature (228)..(228): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcttgggacttatagacttgtctcctggtaccaacaccaccgagacaacggcccccagacgtacatctatttagtcggggacaagtaggcggccgtacgagggtactttccgactcgccttctcgtggtctccaagtctcggacaacgaccgccctccagacatctctcgtctccgaggtctgacggtacggaggtcgtcgaccttattctgtctcgctacattctgtcgtacgtttcttcgttgttcggttcgtacggtcggtacggtactagtcgtaccgtcgtacggtcgacgtcccgaaggtccgtccgtcccgtcggtccacgttcccg

SEQ ID NO: 254148 - DNA, 822 bp, Homo sapiens
  misc_feature: GYAE6OF02FH6EP.13.25.C03.1.454.CMB.1.raw
  modified_base (229)..(229): a, c, t, g, unknown or other
  misc_feature (229)..(229): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactaggaaacngcagtgatcgttgggacttatagtacttgtcctctcggtaccaacaccaccgaggccaacggcccccagacgtcactctactttagtggggactaagtacgggcggccgtgacgggtactttccgactcgtccttctcgtcggtcctaccgtaacgtctacgggacctaaccggtaccggtccccttacccgtacggtaaccttaacgttccgttaccgtttcgggttaccctttaccgaacgggtccgttacgggtaaacggggaaccggtacgggtccgttaccggttacccgtttaacgttaaccggttcgttaccgttacggttaccttacgtaacgtttaacgtccggttaccgtttaacggggtttttccttttaccggtttcgggtttacgggtttccggtttaccggggtaccggggttaacccggggttacccggttaaacggttcccgggtttaacccccggttacccgggtttaaaccgggttacccgaaccccgggttaaccccggtaacccggggttcccggttacccccgggtaccccccggttcccgggttacccgttaccccggttttacccccggg

SEQ ID NO: 254149 - DNA, 307 bp, Homo sapiens
  misc_feature: GYAE6OF02JDS4N.13.25.C03.1.454.CMB.1.raw
  modified_base (138)..(138): a, c, t, g, unknown or other
  misc_feature (138)..(138): n is a, c, g, or t
  modified_base (203)..(203): a, c, t, g, unknown or other
  misc_feature (203)..(203): n is a, c, g, or t
  modified_base (242)..(307): a, c, t, g, unknown or other
  misc_feature (242)..(307): n is a, c, g, or t
tcagtcacgtactacacgaccggtgctcgatttagtagtgtagatttgggtttggggggtgtggtggtctccactcccgccttgacgaggctgcctattactgctgctcatatgcaggtttcttctgtggtcttcggnggaggtcaaagtgaccgtctaggtcagcccaaggctgccccctggtcactctgtcccaccctctntagtacgtgactgacgcgggctgggcaagggctcatagnnnnnnnnnnnnnnnnnnnnnnnnnnnnnnnnnnnnnnnnnnnnnnnnnnnnnnnnnnnnnnnnnn

SEQ ID NO: 254150 - DNA, 244 bp, Homo sapiens; identical to SEQ ID NO: 254104
  misc_feature: GYAE6OF02GQNGP.13.25.C03.1.454.CMB.1.raw
  modified_base (243)..(244): a, c, t, g, unknown or other
  misc_feature (243)..(244): n is a, c, g, or t

SEQ ID NO: 254151 - DNA, 247 bp, Homo sapiens; identical to SEQ ID NO: 254050
  misc_feature: GYAE6OF02FKUI2.13.25.C03.1.454.CMB.1.raw
  modified_base (244)..(247): a, c, t, g, unknown or other
  misc_feature (244)..(247): n is a, c, g, or t

SEQ ID NO: 254152 - DNA, 247 bp, Homo sapiens
  misc_feature: GYAE6OF02GY1HM.13.25.C03.1.454.CMB.1.raw
  modified_base (243)..(247): a, c, t, g, unknown or other
  misc_feature (243)..(247): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttccccacctcctctagtacgtgactgagcgggctggcaaggcgcatagnnnnn

SEQ ID NO: 254153 - DNA, 292 bp, Homo sapiens
  misc_feature: GYAE6OF02JFONF.13.25.C03.1.454.CMB.1.raw
  modified_base (250)..(251): a, c, t, g, unknown or other
  misc_feature (250)..(251): n is a, c, g, or t
  modified_base (254)..(292): a, c, t, g, unknown or other
  misc_feature (254)..(292): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcgggagggtccaaaggtgaccgtcctaggtctagcccaaggctgccccctggtcacctctgttcccaccctcctctagtcgtgactgagcggggctgggcaaggcgtcagtagnncannnnnnnnnnnnnnnnnnnnnnnnnnnnnnnnnnnnnnn

SEQ ID NO: 254154 - DNA, 683 bp, Homo sapiens
  misc_feature: GYAE6OF02IKOLP.13.25.C03.1.454.CMB.1.raw
  modified_base (227)..(227): a, c, t, g, unknown or other
  misc_feature (227)..(227): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccaggtctgccctgactcagcctgcctcgtgtctggtctcctggacagtcgatcaccatctcctgcactggaaacngcagtgacttcgttgggaacttagtagacttgtctcctgtaaccaacaccaccgaggtcaacggcccccagacgtacatctagtttacgtgggggcaagtacggcggccgtacgagggtatttccgaccttcgtaccttctcgtcggtcctccgaaacgtcgttacggacctaacgaccgggtccctacccgtacgaacctaactccttcgttacggttccctacgtaacgtcgtaggacggtaccgaggtacctcgtacctttactaacgttcggactcgtcgtacagttactcggtactacgggttttactttccgttcgggttcggttcgttccgggtaacgggtcgggtaacccgtaagttcccggtaaccggtttcgtaaccgggtaccgaacggtacccgtaaggcccgttaccggccccccgttacgggttaccctccgtttaccccgg

SEQ ID NO: 254155 - DNA, 246 bp, Homo sapiens; identical to SEQ ID NO: 253801
  misc_feature: GYAE6OF02HSF2V.13.25.C03.1.454.CMB.1.raw
  modified_base (243)..(246): a, c, t, g, unknown or other
  misc_feature (243)..(246): n is a, c, g, or t

SEQ ID NO: 254156 - DNA, 259 bp, Homo sapiens
  misc_feature: GYAE6OF02FLEFS.13.25.C03.1.454.CMB.1.raw
  modified_base (245)..(259): a, c, t, g, unknown or other
  misc_feature (245)..(259): n is a, c, g, or t
tcagtcacgtactacacgaccggtgctcgattagtagtgtagatttgggtttgggggttgtggtggtctccactcccgccttgacgaggctgcctattactgctgctcatatgcaggttcttctgtggtcttcggcgagggtccaaagtgaccgtcctaggtcagccccaaggctgcccccctggtcactctgttccccaccctcctctagtaccgtgactgagcgggctggcaaggcgcatagnnnnnnnnnnnnnnn

SEQ ID NO: 254157 - DNA, 253 bp, Homo sapiens
  misc_feature: GYAE6OF02GS9F1.13.25.C03.1.454.CMB.1.raw
  modified_base (244)..(253): a, c, t, g, unknown or other
  misc_feature (244)..(253): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgcccccctcggtcactctgtcccaccctcctctagtacgtgactgagcgggctggcaaggcgcatagnnnnnnnnnn

SEQ ID NO: 254158 - DNA, 696 bp, Homo sapiens
  misc_feature: GYAE6OF02HLMQE.13.25.C03.1.454.CMB.1.raw
  modified_base (228)..(228): a, c, t, g, unknown or other
  misc_feature (228)..(228): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatccaccatctcctgcactgaaacngcagtgatcgtggacttatagacttgtcctctcggtaccaacaccaccaggccaacggccccagagtcatactattagtggggacaagtggcggaccgtgagggtactttccacgtcgcttcgtcgtcggtacctacctaagtcctggaccaaaccgtaccggtacccttcccgtagtaactaacgttcctacccgttaggttccctacccggacggtacctacgggtaacgggacgtacgggtacctcggtaccctttaacgttaccttcggtactcggtccttacgtaacttacgttcgacgtttacggtttccttttacggtcggttttacggttccggtttaccggggacgggtttacgggtaacctaacgggttccggtacccggtttacgttaacggtcccgtaaccgggacccgttaacggtccggttacccccgtcccccggttcggtaccttaccccgg

SEQ ID NO: 254159 - DNA, 533 bp, Homo sapiens
  misc_feature: GYAE6OF02F29JX.13.25.C03.1.454.CMB.1.raw
  modified_base (247)..(247): a, c, t, g, unknown or other
  misc_feature (247)..(247): n is a, c, g, or t
  modified_base (301)..(301): a, c, t, g, unknown or other
  misc_feature (301)..(301): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacgcagtgatcttgggacttanagacttgtctctgtaccaacaccaccaggcaacggccccagatcatcatttagnggggcaagtaggcgccgtcgagggtacttccactcgcttctctggctaccaagtctaggacaacgcgcctcctagacaatctacgtcggtcctcgagctaggaggacgaggctgaccttatactgactgctnactntgctaggttcttcgtgttcggtcgttcgggacggtagtacctaaggtcgtaccgtcgtagtcacgtaccgagctaccgccctacggtcacttcccg

SEQ ID NO: 254160 - DNA, 251 bp, Homo sapiens
  misc_feature: GYAE6OF02FF5H8.13.25.C03.1.454.CMB.1.raw
  modified_base (245)..(251): a, c, t, g, unknown or other
  misc_feature (245)..(251): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgcccccctggtcactctcgttcccaccctcctctagtacgtgactgagcgggctggcaaggcgcatagnnnnnnn

SEQ ID NO: 254161 - DNA, 676 bp, Homo sapiens
  misc_feature: GYAE6OF02JOQ70.13.25.C03.1.454.CMB.1.raw
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcacgcccactcccaagtcgctcctgaaacacggtccgggctggaggtgaagaacgccgtgggcctcagtgaagagtctcctggacaaggtcttcgtacggttaacctacctttagccaggtcctattcttatacagtcgtgggtacgcggaaccgacggtccccgtagggaccgacgggtcgtacggacgggttagggacgtaggggagttagggaacttcgaaccgttcccgtaaacgaaaccggtaacacgacgtactagtacggaacaacgtacctacggacggacgtagtacttaccaacgagtacgaaccgaacgacgaactacaacgtacgaaccgacaaacgacgtacctacgacgtacgggtacggcgggtaagacggtacaggtaataggtactaaggaccgaacgtaccgggtcgttacgtatttcgtagtcgggacgtaacgggtggtaacggtaggtaccgggtagtacggtaagggtaactacggtaactaaaaccgg

SEQ ID NO: 254162 - DNA, 695 bp, Homo sapiens
  misc_feature: GYAE6OF02J2AVI.13.25.C03.1.454.CMB.1.raw
  modified_base (141)..(141): a, c, t, g, unknown or other
  misc_feature (141)..(141): n is a, c, g, or t
  modified_base (236)..(236): a, c, t, g, unknown or other
  misc_feature (236)..(236): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacgngggtcctgggcccagtctgccctgactcagcctgcctccgtgtctgggtctccgtggacagtcgactccaccatcctcctgacactacggaaacngcagtgattccgttagggtacttatagcttcgtcctcgtcgtaccaacaccaccacggccaacggccccacgagtcatactatttagtcggggactaacgtcgggccggacgtcgtaggtcctttccactcgtctttcgcgtcgtctacctaagtcgtacgaccaactcccgggtaccctaccagtactaacgttcgtccgttggtccttacgaccggtacggtcggacggtacgacgggtccgtcggtaaccttaacgttccggtaccgtccgttaacctccgtacgttaacgtaacgtgttacccggttagtttcctacggtttcggtcggtttaccggtacggacggggttaccggtaccggtaaggtttaccgtacccggttacgttaccggacggtcccggaaccggttacggtccgtccccggttaccccgtccggttaccttaccgttcccg

SEQ ID NO: 254163 - DNA, 306 bp, Homo sapiens
  misc_feature: GYAE6OF02GX3NS.13.25.C03.1.454.CMB.1.raw
  modified_base (251)..(306): a, c, t, g, unknown or other
  misc_feature (251)..(306): n is a, c, g, or t
tcagtcacgtactacacgaccggtgctcgatttagtagtgtagatttgggtttggggggtggtggtggtctccactcccgccttgacgaggctgcctattactgctgctcatatgcaggttcttctgtggtcttcggcggagggtccaaagtgaccgtcctaggtcagcccaaaggctgcccccctcggtcactctcgttccccgccctcctctagtacgtgacgtgagccgggctggcaaggcgcatagnnnnnnnnnnnnnnnnnnnnnnnnnnnnnnnnnnnnnnnnnnnnnnnnnnnnnnnn

SEQ ID NO: 254164 - DNA, 781 bp, Homo sapiens
  misc_feature: GYAE6OF02HE4H4.13.25.C03.1.454.CMB.1.raw
  modified_base (243)..(243): a, c, t, g, unknown or other
  misc_feature (243)..(243): n is a, c, g, or t
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaggtgcaactggtgcaatcgtgggtctgagttgaagaaaccgtggggcctgagtgtaaggtttccngacgaagggcgtcgtaggtataccgtacgttcacttacttagtgtctagtagtaagttggggtgcgacgacgggcctccggtaggaaccgaaggggtcttagggtaggtacgggtagtacggggagtcgggaacgttcgaacgtataccgaaaccgtaaccggtaaccgggaaaccctaacggtacgtaccggacccgtacggtccttacgaacggtacgggttacgggttttcgttccgtttccgtccggttacgggaccttacccttcggtgaccgtacggtaccgacgggtcgttaatacggttacgaagttacgtccgaacggtcctaaacggaccggttaaacggtcggtaaacggaccggaaaccctacgggtttccctaaaccgtttaaacgtttttacgtacggttcggttaaggtacgggttaagttaacccgttttacttttccccgttttaaccggtaggttttaaacccggttccggtttaacgttttaccccgttccggtttacccggtttattaaccccggggg

SEQ ID NO: 254165 - DNA, 773 bp, Homo sapiens
  misc_feature: GYAE6OF02FLPQK.13.25.C03.1.454.CMB.1.raw
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcgttgggacttatagacttgtctctggtaccacaccaccagcaacggccccagacgtcatcatttagtggggacaagtaggcggcgtacgagggtactttcccactcgactttccgtcgttcgggcctaccgaaggttcgtcgggtaccaaaccgtccgggtacccttcccgttaggaacctaaacggttcccttacggttacgggtacccttacccgggtaagggtccgttacggaacgggtaaccgggtacgggtaccgttccggacccgtttaagtttaacccgttcggtacccgttaacgtcccttaaccgtaacgttaacggtaccggttacgtttaaccgggttttaccgtttccggttacggtttccggggttaccggtttcccgggggtaacggggttaccggggttaccgaaacggtttccggtaaacccgggttaccgttaacgggtacccgtaaccggtaccccggtaacggttcccggttacccgggtaccccccgtttaggtaccccgtaccggtttaccccgg

SEQ ID NO: 254166 - DNA, 257 bp, Homo sapiens
  misc_feature: GYAE6OF02I276U.13.25.C03.1.454.CMB.1.raw
  modified_base (247)..(257): a, c, t, g, unknown or other
  misc_feature (247)..(257): n is a, c, g, or t
tcagtcacgtactacacgaccggtgctcgatttagtagtgtagattggtttgggggtggtggtggtctcgactcctccttgacgaggctgcctattactgctgctcatatgcaggttcttctgtggtcttcggcggagggtccaaagtgaccgtcctaggtcagcccaaggctcgcccctcggtcactctgtcccgccctcctctacgtacgtgactgacgtcgggctggcaagggccgcgaatagnnnnnnnnnnn

SEQ ID NO: 254167 - DNA, 247 bp, Homo sapiens
  misc_feature: GYAE6OF02GMVWK.13.25.C03.1.454.CMB.1.raw
  modified_base (244)..(247): a, c, t, g, unknown or other
  misc_feature (244)..(247): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctcgttcccaccctcctctagtacgtgactgagcgggctggcaaggcgcatagnnnn

SEQ ID NO: 254168 - DNA, 729 bp, Homo sapiens
  misc_feature: GYAE6OF02HDCOE.13.25.C03.1.454.CMB.1.raw
tcagtcacgtactacacgaccggtgctcgatttagtagtgtagatttgggtttgggggggggtcacaagaggcagcgctctcgggacgtctccaccatggcctgggctctgctgctcctcactctcctcactcaggacacagggtcctgggcccagtctgccctgactcagcctgcctccgtgtcgtggtctcctggacagtcgatcaccatcctcctgcactggaaacagcagtgattacgttagggacttatagtacttgtctccgtagtaccaacaccaccaggaccaaccggcccccagtagtacactacgtaagtttacggtcggggactaagtacgggccggaccgtacgagggtactttccgacgttcgtccgttctacgtcggtccttaccgtaaggtcgttcggaacctaaaccgaccggtacccttaccccgtaagtaacctaaacgttccgtacgttacgggtaccctaccgaacgggtcgtacgggaaacgggacggtaggcccttacggtacctttaacgtacctcgtacctcgtactacgaattacgtcgttacgttacggtttcctttcgtggtttccgggttcgtttcggggtacgggtaccggtacgtaaacggtcggtaacccggttcggttaacgggtaccgaaccgtacccggaacggttcccgttacccggtacccccggtttacggtacccttacccgtttacccgg

SEQ ID NO: 254169 - DNA, 657 bp, Homo sapiens
  misc_feature: GYAE6OF02GF42X.13.25.C03.1.454.CMB.1.raw
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactaggaaatagcagtgatcgttgggacttatagacttgtctctgtaccaacaccaccaggacaacggccccagacgtcatctagtttagtgggggactaacgtaggcggtccgtacgagggtacttccacgtcgtcttacgtctggcctacctaagtctgggaccaacgaccggtccctcctacgactaatccgtacgtggtactccgagtcgtaggacgggtacgacggtcgtcgtacttacgttactcgtctcgtccttactataacgtcgtaccgttacgtttaccgtttgttcggttacgggttcgtttaccggggaccgggttaaccggggttaccgttaaacgggttacccggtaaccccggttcgtaacgggttccgaccgtaccccggaaggttcccgtacccgtcccccggttcggtacccgttacccg

SEQ ID NO: 254170 - DNA, 282 bp, Homo sapiens
  misc_feature: GYAE6OF02JHJX5.13.25.C03.1.454.CMB.1.raw
  modified_base (210)..(210): a, c, t, g, unknown or other
  misc_feature (210)..(210): n is a, c, g, or t
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
  modified_base (243)..(244): a, c, t, g, unknown or other
  misc_feature (243)..(244): n is a, c, g, or t
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (251)..(251): a, c, t, g, unknown or other
  misc_feature (251)..(251): n is a, c, g, or t
  modified_base (253)..(282): a, c, t, g, unknown or other
  misc_feature (253)..(282): n is a, c, g, or t
tcagtcacgtactacacgaccggtgctcgatttagtagtgtagatttgggtttggggggtggtggtggtctccactcccgccttgacgaggctcgcctattactgctgctcatatgcaggtttcttctgtggtcttcggcggagggtccaaagtgaccgtcctaggtcagcccaaggctgcccccctggtcactctgttcccaccctctntagtcgtnactgagcgggctggcaggcncatgnnctnantnannnnnnnnnnnnnnnnnnnnnnnnnnnnnn

SEQ ID NO: 254171 - DNA, 796 bp, Homo sapiens
  misc_feature: GYAE6OF02HH4ZW.13.25.C03.1.454.CMB.1.raw
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccatgtcgtgggtctcctggacagtcgatccactactctcctgcacgtaggaaatagctaggtgtattcgttgggaactttagtagtacttgtcttcctacggtaccaaccacccacccgaggacaaccggccccagacgtacactacttagttacggtgggggactaaggtcgggccgggtacggtacggtaacgggtactttcccgacttccgtacttcctcgtgtcctccgagttcgacggtaccaaccgaccgtccttacccgtcgtaactaacttcccgttgtacgttccgtaccgtagggcgttacggacgggtaacggcggtaccgttacgtaacctttacggttaccgtggtcgttaccggtaccttacggtaacctttagtcccggttaagtttacggttttccgttttccggttccggggtttacgttcccgggtttaacccgggggtacgggttaaccggggttaacccgttaaaccgggggtttccgggtaaccccggtttaccccgttaaaggggttacccccgtaaccggttacccccgggtaacggggtttcccctaccccccggggtttacccccccggttacggtttacccccggtaacccg

SEQ ID NO: 254172 - DNA, 254 bp, Homo sapiens
  misc_feature: GYAE6OF02H4E4K.13.25.C03.1.454.CMB.1.raw
  modified_base (247)..(254): a, c, t, g, unknown or other
  misc_feature (247)..(254): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgcccccctcggtcactctgttccccgccctcctctagtacgtgactgacgcgggctggcaaggcgcatagnnnnnnnn

SEQ ID NO: 254173 - DNA, 631 bp, Homo sapiens
  misc_feature: GYAE6OF02H5DOO.13.25.C03.1.454.CMB.1.raw
  modified_base (229)..(229): a, c, t, g, unknown or other
  misc_feature (229)..(229): n is a, c, g, or t
  modified_base (250)..(250): a, c, t, g, unknown or other
  misc_feature (250)..(250): n is a, c, g, or t
tcagtcacgtactacacgaccggtgctcgatttagtagtgtagatttgggtttggggggggtcacgaagaggcagcgctctcgggacgtctccaccatggcctgggctctgctgctcctcactctcctcactcaggacacagggtcctggcccagtctgccctgactcagcctgcctccgtgtcgtgggtctcctggacagtcgatcaccatctcctgcactggaaacngcagtgatcgttggactttanagacttgtctccgtagtaccaacaccacccagcaacgccccaagacgtcatctatttagtcgggggacaagtacgggcggccgtcgagggtattcccacgtcgccttcgtcgtcggcttaccgaagttcgtcggacaaccgacggccctccgtagacattcctcgtcggtcctccgaggctaggagaccgtaggctagtcctaatttcacgtcgtacgtccgtactagttaacgtcgaccgttaggtttctttacgtgttacgggttccttcgggacggttacggtaccgtaaggttccggaccgttaccgtacggtccggtaacgacccggtaacggtccccgttccgtacccccggttcgtacccgtacccgtttcccg

SEQ ID NO: 254174 - DNA, 875 bp, Homo sapiens
  misc_feature: GYAE6OF02H3690.13.25.C03.1.454.CMB.1.raw
  modified_base (418)..(418): a, c, t, g, unknown or other
  misc_feature (418)..(418): n is a, c, g, or t
tcagtcacgtactacacgaccggtgctcgatttagtagtgtagatttgggtttgggggagcatcacccagcaaccacatctgtcctctagagaactcccctgagagctccgttcctcaccatggactggacctggaggacttcctcttcgttgggtggcagcacgccacagcacgtcccacctccaagtcgcctacctagaaacgtcggtccgggctggtaggtagaaggaacgtccggtgggtcctcgtagtaggaacgttccgtacgcgacgacggtctaccggactaccgacctacgaagtacgaaactctcgtacctatagtgtacgacggtacgacccggaccgacggacgtaacggtcgtagtggtaggtggtacgggtgtaacgtaccgtaaccgttaggtaggtcgtaanaaccgtaaataagtaacgaagtaaacggtaacggtttaaaggtccggggtacgggtaaccgtaacccgtacggtaacgaaccgggtaccgtaaacgggtaacctacgaaccgttaacgtaaacgacccgttaagtccgtaaccgttaacggaacggttaaccggaacctaccggttaagtaacccgtacgtttaccggtaaccgtacggttaaacccgaacccggggtaacccgtaccgggttttacctttacgggttaacgttaaccggggtcggttaacccgggtaaacgttaaaccgttaacccggtacccgtttaaccgtttaaccggtttaaacgtttaccggggttttaacgggttaaaccgggttttccccggggaaaacggttcccgggttaaaccccggttcggttaacccccgtttacccgggttaccccgtactttaccccccggg

SEQ ID NO: 254175 - DNA, 280 bp, Homo sapiens
  misc_feature: GYAE6OF02HNLOF.13.25.C03.1.454.CMB.1.raw
  modified_base (260)..(280): a, c, t, g, unknown or other
  misc_feature (260)..(280): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccatcctaggtcagcccaaggcctcgcccccctggtcactctcgttcccacccctcctactagtacgtgactggacggcgggctaggacaagggccgctaatacggnnnnnnnnnnnnnnnnnnnnn

SEQ ID NO: 254176 - DNA, 785 bp, Homo sapiens
  misc_feature: GYAE6OF02HQMQQ.13.25.C03.1.454.CMB.1.raw
  modified_base (230)..(230): a, c, t, g, unknown or other
  misc_feature (230)..(230): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcacatctctgcacgtacggaaacngcagtgattcgttagggactttaagtacgtcttagtcctccgtacggtaaccaaaccgacccaacccgaaggacctaacggacccccaagacgtacagtacctaagtttacggacggggacaagtacgggcggtaccgtacgtagggtacttttaccacgttccgtactttcctcgtggtacccttaccgtaaacggttccgttacggaccaaacgtacccgggtcccttaccctagtaacctaacttaccgtcgttacgggttaccctaccggaacgggtccttacgggaaaggtaccggtacgtccgtacgtacccgtttaatttaccgcgttacgcgtactaccgttaagtactacggtacgtaccgtttcgttccgttacgggttaccggtcgttaccgggtaagggttaccgggttaacgttaaacggttacccgggttaacccgttacccggtttaacgggtcccgtaaaccgggtccccggttaaggaccccgggtttaccccgtccccccggtttacggttaccccgttaacccgtttacccccggg

SEQ ID NO: 254177 - DNA, 257 bp, Homo sapiens; identical to SEQ ID NO: 253727
  misc_feature: GYAE6OF02FPS14.13.25.C03.1.454.CMB.1.raw
  modified_base (243)..(257): a, c, t, g, unknown or other
  misc_feature (243)..(257): n is a, c, g, or t

SEQ ID NO: 254178 - DNA, 768 bp, Homo sapiens
  misc_feature: GYAE6OF02F4T06.13.25.C03.1.454.CMB.1.raw
  modified_base (228)..(228): a, c, t, g, unknown or other
  misc_feature (228)..(228): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcgttagggacttatagtacttgtctccgtggtaaccaaccaccacccgaggaccaacggcccccagacgtcactctagtttagtcgggggacaagtacgggccggccggtacgacgggtactttccacgtcgtcttcgtcgtcggccttaccgtaacgtcgtacggaccaaccgtaccggtcccctcccgtacgtaacctaacgtccgttacgttcggtccttaccgacggtccgttagggacggtaacgacgggtcctacggtaccttaacgttaccgttcggtccttacgtccttacgtactttacgtcggtacgtttacggttttccctttcggttcgggtttccgggtttccgggtttaccggggtaccggggttaaccggggtttaacccgtaaacgggtttacccggttaaccccgggttaccggttaaccggggttacccggtaaccgtaaccccgggtaaccggttccccggttacccccgggttaccccccgttccgggttaccccttcccggtttacccccg

SEQ ID NO: 254179 - DNA, 247 bp, Homo sapiens
  misc_feature: GYAE6OF02JEG8C.13.25.C03.1.454.CMB.1.raw
  modified_base (234)..(234): a, c, t, g, unknown or other
  misc_feature (234)..(234): n is a, c, g, or t
  modified_base (240)..(247): a, c, t, g, unknown or other
  misc_feature (240)..(247): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggaggtccaaagtgaccgtcctaggtcagcccaaggctgccccctggtcactctgttcccgccctctctagtacgtgactgagcgggctggcaaggcncatagnnnnnnnn

SEQ ID NO: 254180 - DNA, 255 bp, Homo sapiens
  misc_feature: GYAE6OF02F0YF6.13.25.C03.1.454.CMB.1.raw
  modified_base (236)..(236): a, c, t, g, unknown or other
  misc_feature (236)..(236): n is a, c, g, or t
  modified_base (243)..(255): a, c, t, g, unknown or other
  misc_feature (243)..(255): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccacctcctctagtacgtgactgagcgggctggcaaggcncgatagnnnnnnnnnnnnn

SEQ ID NO: 254181 - DNA, 619 bp, Homo sapiens
  misc_feature: GYAE6OF02FUGWU.13.25.C03.1.454.CMB.1.raw
  modified_base (219)..(219): a, c, t, g, unknown or other
  misc_feature (219)..(219): n is a, c, g, or t
  modified_base (231)..(231): a, c, t, g, unknown or other
  misc_feature (231)..(231): n is a, c, g, or t
  modified_base (252)..(252): a, c, t, g, unknown or other
  misc_feature (252)..(252): n is a, c, g, or t
  modified_base (301)..(301): a, c, t, g, unknown or other
  misc_feature (301)..(301): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacatctctgcacnggaaacgcagtnatcgtggacttatacgacttntctctcgtaaccaacaccaccaggcaacgccccagagtcatcatttagngggacaagtcggcgcgtgagggtacttccactcgtacttctacgtcggtactcgaagtcgtacggaccaaacgcggtcccttcccagtaaccaacgttcctacgtcgtcctacggacgtcgtaggacggacggacgtctacgtaccttagttacgtgctcgtactactattcgacgtcgttacggtttcttcggttacggttacggtttccggttacgggacgggttacggtaccgtaacggttcggtacccgttacgtacggtaaccgacgtacccggacgtccgttccgtaccccggtcgttaccaccgtttcccg

SEQ ID NO: 254182 - DNA, 681 bp, Homo sapiens
  misc_feature: GYAE6OF02ICJFQ.13.25.C03.1.454.CMB.1.raw
  modified_base (539)..(539): a, c, t, g, unknown or other
  misc_feature (539)..(539): n is a, c, g, or t
tcagtcacgtactacacgaccggtgctcgatttagtagtgtagatttgggtttgggggggggtcacaagaggcagcgctctcgggacgtctccaccatggcctgggctctgctgctcctcactctcctcactcaggacacgagggtcctgggcccagtctgccctgactcagcctcgcctcgtgtcgtgggtctcctggacagtcgatcaccatcctcctgcacgtacggaaacagcagtgtattcgttagggtacttagtacgtcttcgtctccgtacgtaccaacacccacgaggaccaaccggcccagtagtcacttactagtttaggcgggactaagtacggccggtcgtagacggttacttaccacgtccgttcttccgtcgtcggtcctacgtacgttcgtacggaacctaacggcccgtacccttacccgtacgtaaaccttacgttcccgtttcgtccgggtacctcccgggtaacggtcgttacgggacgggtaaccggacgggttcctacgttaccttaacgtttacgngtcctcgtctactagttcgcgtaccgttacgttcctttcggtgtttccggtcggtaccgggtcggtaacggtacgtaacggtccgtacgtccgtacggtcgaaccgtccgacggtcctcccgtcccgtagtcctcgttccgg

SEQ ID NO: 254183 - DNA, 668 bp, Homo sapiens
  misc_feature: GYAE6OF02GMTUC.13.25.C03.1.454.CMB.1.raw
  modified_base (232)..(232): a, c, t, g, unknown or other
  misc_feature (232)..(232): n is a, c, g, or t
  modified_base (532)..(532): a, c, t, g, unknown or other
  misc_feature (532)..(532): n is a, c, g, or t
tcagtcacgtactacacgaccggtgctcgatttagtagtgtagatttgggtttgggggggggtcacaagaggcagcgctctcgggacgtctccacatggcctgggctctgctgctcctcactctcctcactcaggacacgagggtcctcgggcccagtctgccctgactcacgcctgcctccgtgtcgtgggtctccgtggacagtcgatcacatcctcctgcagtagaacngcagtgattcgttacgggtattacgtagtacgttcgtcctcgtacgtaaccaaaccacccaaccgacgacgaaccgccccagacgtactacgacttaagttacggtagggaactaaggtacgggccggtaccggtagtacggttactttaccggacttaccgtcgttacctcggtacgtaccgttacgttaacgtctacggaccaaccgacggtccctaccgtagaactaactcgtaccgttcggaccttaccgaggtcgtaggtaccgaacggcgtcgtacttccgttaacgtcgtacncgttcgtctacgtacgtatcgtacgtttacgttgttaccgttggttcgtcggtacggtaccggtaggttacgtagtacggtcgttacgtaacggtcacgtaccgtacgcttccccggactcggtaccgtcttccgg

SEQ ID NO: 254184 - DNA, 739 bp, Homo sapiens
  misc_feature: GYAE6OF02IOK8A.13.25.C03.1.454.CMB.1.raw
  modified_base (201)..(201): a, c, t, g, unknown or other
  misc_feature (201)..(201): n is a, c, g, or t
tcagtcacgtactacacgaccggtgctcgatttagtagtgtagatttgggtttgggggagcatcacccagcaaccacatctgtcctctagagaatcccctgagagcctccgttcctcaccatggactggacctggaggatcctctttcgttggtggcagcagccacagcacgcccacctacccaagtcgcctcctagaacncggtccgggctggaggtagaagacgccgtggggcctcgagtggaacggtctccgtgacgaacggtccttacggactacctaccctacaacgtacggtaaactagtaccgtacctacgttagtcgtacgacgaaccgtaccggaccccggaacggaacggtaacggggtcttccggtggtacgggtacggtgggggtacgtacttacccgtaaaaccgttaagtaggttacggtacgaacctaactaaacgtagtaggtaaacgtaaaggttaacgtttcgggaacggggtacccggtacaaccgtaggtacggaacccggacgggtaccaaccggttaccaacgttacaaacgttaccgtaccgtaccgttacgtaacggtacgtaaaccgtcgaaaccgtacgtacctaccgtacctcgtaacggaaccgtaacggtccgtcgttagtacttagtcggtacgtacggtacaacgtcgtacgtaccttaagttcgttaggtacgttcgacgtacggtctccgtgtcctaccgtctccg

SEQ ID NO: 254185 - DNA, 259 bp, Homo sapiens
  misc_feature: GYAE6OF02HXFTE.13.25.C03.1.454.CMB.1.raw
  modified_base (244)..(259): a, c, t, g, unknown or other
  misc_feature (244)..(259): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcgggagggtccaaagtgaccgtcctaggtcagcccaaggctcgcccctcgtcactctcgttcccacctcctctagtacgtgactgagcgggctggcaaggcgcatagnnnnnnnnnnnnnnnn

SEQ ID NO: 254186 - DNA, 798 bp, Homo sapiens
  misc_feature: GYAE6OF02JWUOB.13.25.C03.1.454.CMB.1.raw
tcagtcacgtactacacgaccggtgctcgatttagtagtgtagatttgggtttgggggagcatcacccagcaaccacatctgtcctctagagaatccctgagagctccgttcctcaccatggactcggacctggaggatcctcttcgttggtggcagcagccacagcagcccactcccaagtgctcctagaaacacggtccggggcttggaggtaggaagaacgtccgtcggggcctcgaagtaggaacggtctccgtagacgaacggccgtttaccggaactaccctacccttacgaaacgttacgggtaaaaccgtattccggtaccctacgttagtcgggttacgacccgaaccggaccgggaccccccgttaagggaaaccggaacggggttcctttacgtcgggtaccgggtagggtacgggggttacggttaaccgtacccgtaaaacccgtttaggtaacggttagggttaaccaaaccgtaaccctaaaacgttactaacggaaagggtaaacgtttaaaaggttccgggacgggtaacccggtacgaacccggtagtaaccggacggtaacgggtacccgtaaaccgtccgtaactacgtaactaacgacgtaccgtctaacggtacgactaccgtacgacgttccgagtacctacgtaccgaacggtaccgtaccggtggttaacttacgtcgtaccgtggacccggtataccgactacgttacctagttacgttacggtaagttccggaccggcgtaccgccggttacgtccgtacctccgtacccg

SEQ ID NO: 254187 - DNA, 261 bp, Homo sapiens
  misc_feature: GYAE6OF02HLK9Q.13.25.C03.1.454.CMB.1.raw
  modified_base (250)..(261): a, c, t, g, unknown or other
  misc_feature (250)..(261): n is a, c, g, or t
tcagtcacgtactacacgaccggtgctcgatttagtagtgtagatttgggtttggggggtgtggtggtctccactcccgccttgacgaggctgcctattactgctgctcatatgctaggttcttctgtggtcttcggcggagggtccaaagtgaccgtcctaggtcagcccaaggctcgcccctcggtcactctcgtcccacctcctctagtacgtgactggaggcgggctgggacaagggcacatacgnnnnnnnnnnnn

SEQ ID NO: 254188 - DNA, 260 bp, Homo sapiens
  misc_feature: GYAE6OF02GS9XL.13.25.C03.1.454.CMB.1.raw
  modified_base (216)..(216): a, c, t, g, unknown or other
  misc_feature (216)..(216): n is a, c, g, or t
  modified_base (245)..(260): a, c, t, g, unknown or other
  misc_feature (245)..(260): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtaccaaagtgaccgtcctaggtcagcccaaggctgccccctggtcactctcgtcccgccctctctagtacgtnacgtgaggcgggctggcaaggcgacatgnnnnnnnnnnnnnnnn

SEQ ID NO: 254189 - DNA, 697 bp, Homo sapiens
  misc_feature: GYAE6OF02I4WSV.13.25.C03.1.454.CMB.1.raw
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
  modified_base (322)..(322): a, c, t, g, unknown or other
  misc_feature (322)..(322): n is a, c, g, or t
  modified_base (385)..(385): a, c, t, g, unknown or other
  misc_feature (385)..(385): n is a, c, g, or t
  modified_base (408)..(408): a, c, t, g, unknown or other
  misc_feature (408)..(408): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacaacagggtcctgggcccagttctgccctgactcagcctcgcctccgtgtctgggtcctctggacagtcgatcacatctctncactaggaaacngtcagtcatcgttggacttatagacttgtctcctacgtaccaaccaccacccgacgaccaacggccccctaggactctatctagtttacggnggggacaagtacggcggccgtagcgggtcttccgacgtctcttcgtctcgtctacctaggtcncggaccacctacggtcccttccngtacctatctcgtacgtccgacgtaccgtcgtaggacggcggtacgtacctcgacctttcgtacgtcgtctagtccgtacttaagtgttccggtactttacgtttccgtttcgttcgggtttacggttttccggaaccggggttcggtaacccgggttaacgtttaaccgggttacccgggttaaccgttacccggggttaaccgtaccggtaccgggtaacccggtacccggttccgttaaccccggttccccccggtaccggtttacccgtacccgtttcccccggg

SEQ ID NO: 254190 - DNA, 290 bp, Homo sapiens
  misc_feature: GYAE6OF02IM0P1.13.25.C03.1.454.CMB.1.raw
  modified_base (245)..(249): a, c, t, g, unknown or other
  misc_feature (245)..(249): n is a, c, g, or t
  modified_base (253)..(253): a, c, t, g, unknown or other
  misc_feature (253)..(253): n is a, c, g, or t
  modified_base (255)..(290): a, c, t, g, unknown or other
  misc_feature (255)..(290): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgcccccctggtcactctgttcccgccctctctagtacgtgactgagcgggctggcaaggcctcatagcannnnnagtncnnnnnnnnnnnnnnnnnnnnnnnnnnnnnnnnnnnn

SEQ ID NO: 254191 - DNA, 648 bp, Homo sapiens
  misc_feature: GYAE6OF02ILLR1.13.25.C03.1.454.CMB.1.raw
  modified_base (230)..(230): a, c, t, g, unknown or other
  misc_feature (230)..(230): n is a, c, g, or t
tcagtcacgtactacacgaccggtgctcgatttagtagtgtagatttgggtttggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactaggaaacngcagtgatcgtggacttagtagtacttgtctccgtaggtaaccaacaccaaccgaggaccaacggcccccagtacgtcattactagtttaggacggggtacaacgtcggccggtccgtacgagggttactttaccgacgtcgtacttctacgtcggtacctaccgtaagtcgtcggaacctaaccgtaaccggtcccttacccgtagacctaacgttctacgtcggtacctaccgtaggcgtaggaacggtacgtaacggtcgtacgtaccttagttacgcgtcgtcgtactacgaattacgtacgtacgtacgtttcgttcgttaggttcgttcggtacggtcgggtacgtacgtaacgtcgaccgttacgtaggtacgacgacgacggccgtcccgtcccgtctaccgtacttccg

SEQ ID NO: 254192 - DNA, 699 bp, Homo sapiens
  misc_feature: GYAE6OF02H962Y.13.25.C03.1.454.CMB.1.raw
  modified_base (166)..(166): a, c, t, g, unknown or other
  misc_feature (166)..(166): n is a, c, g, or t
  modified_base (202)..(202): a, c, t, g, unknown or other
  misc_feature (202)..(202): n is a, c, g, or t
  modified_base (293)..(293): a, c, t, g, unknown or other
  misc_feature (293)..(293): n is a, c, g, or t
  modified_base (375)..(375): a, c, t, g, unknown or other
  misc_feature (375)..(375): n is a, c, g, or t
  modified_base (423)..(423): a, c, t, g, unknown or other
  misc_feature (423)..(423): n is a, c, g, or t
  modified_base (551)..(551): a, c, t, g, unknown or other
  misc_feature (551)..(551): n is a, c, g, or t
tcagtcacgtactacacgaccggtgctcgatttagtagtgtagatttgggtttgggggagcatcaccccagcaacccacatctgtcctctagagaatcccctgagagctccgttcctcaccatggactggacctggaggatcctcttcttgggtggcagcagccanagcacgccccacctcccaagtcgcctcctgaaacgnggtcccgggctagaggtgaagaagccgtgggcctcgagtgtaaggtctcctgacgaggcgtcgtggactacgaccgttacacttacgttangacttaagtacgtaagtttgggacgaccgagacggtccttccgtacggaacgaaggtcttggagtgtaggtgggatggtacncgaacagtaacaacgacgtaacggaaccctaaggtactcgaacccggnggtacctacgaacggtacggttacggttttctccgtttaccgtacccggtttaccggtaacccgttaccgtcgttccgttacgaccgtaaccggacggtacgttaacgtacgttacgaagaaccgtanaccgactaaccggacctaaacgggtcctaacggaacgacctccgacgttacgttaactttactcgtagtacggtagtaacgttaccgttacgttcctttaccgttagtaccgttacgttacgttacgttccgttaccgtcgtaaccgg

SEQ ID NO: 254193 - DNA, 301 bp, Homo sapiens
  misc_feature: GYAE6OF02JJTLG.13.25.C03.1.454.CMB.1.raw
  modified_base (198)..(198): a, c, t, g, unknown or other
  misc_feature (198)..(198): n is a, c, g, or t
  modified_base (259)..(301): a, c, t, g, unknown or other
  misc_feature (259)..(301): n is a, c, g, or t
tcagtcacgtactacacgaccggtgctcgatttagtagtgtagatttgggtttgggggggttgggtgggtgggtctcccactccccgcgttgaccgaggcttgcctattactgctgctcatatgcaggttcttctgtggtcttcggcgggaggtcaaaggtgaccgttcctaggtcagccaaggctcgcccctcggtnatctcgttcccgccctcgtctagtagtgacgtggaggtcgggctgggcgaagggcgcatgnnnnnnnnnnnnnnnnnnnnnnnnnnnnnnnnnnnnnnnnnnn

SEQ ID NO: 254194 - DNA, 703 bp, Homo sapiens
  misc_feature: GYAE6OF02JRDRM.13.25.C03.1.454.CMB.1.raw
  modified_base (140)..(140): a, c, t, g, unknown or other
  misc_feature (140)..(140): n is a, c, g, or t
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
  modified_base (242)..(242): a, c, t, g, unknown or other
  misc_feature (242)..(242): n is a, c, g, or t
  modified_base (267)..(267): a, c, t, g, unknown or other
  misc_feature (267)..(267): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacngggtcctgggcccagtctgccctgacctcagccctgcctccgtgtcgtggtcctcgtggaaccngttcgatccacctntctcctagccataggaaacngacncgtgattcgttggacttatagcttntctcctacggtaccacgaaccctacccgagtccaacggcccccagacgtcactcgtagttacggtgggactaactacgggccgtaccggtcgaacggtactttacccgctcgttccttgtccgtcggtactacccgacgttacgtcggtactaaaccgcccgtaccctccgtcgaactacgtacgtcggttccggtacctcgtacgtctaggtaacgggcgtacggcgtctccgtatttaaccgttcgcttctaccgtgttacgtacgttccgtcgttaaccgttcgtttacgttccgttgggttacccggtcggggaacgggttcccgggtaattaaccgggtacccgttacggtccgttaaccgggtccgttaaacccggccttaaccgggtcccttacccggttcccccgtcggtaccgtcccgtttaccccg

SEQ ID NO: 254195 - DNA, 687 bp, Homo sapiens
  misc_feature: GYAE6OF02JEJ11.13.25.C03.1.454.CMB.1.raw
  modified_base (232)..(232): a, c, t, g, unknown or other
  misc_feature (232)..(232): n is a, c, g, or t
  modified_base (255)..(255): a, c, t, g, unknown or other
  misc_feature (255)..(255): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctggcccagtctgccctgactcagcctgcctccgtgtctgggtctcctggaccagttcgatcacactcctccgtgacactggaaacngtcagtgactctttggactttancgtacttgtctcctcggtaccaacaccaccgagaccaacggccccagacgtcactctattacggtacggggactaacgtaacggtcggaccgtacgtacgggtactttccgacgtccgttcgttcctcgtcgtcccgtccgtaacgttcgtacggtaccaacgtacccggtcctacccgttcaacgtaactccgttcgtacggtctcgtacgtcgtacgaacggacggtcgtaccgtctaccttacgttacgtcgttaccgtcgtactacctagttaatccgtacgtttaaggtttcccttcgtttcgtttcggttaccgttggggaccggttaaccggttacgtaaacggttcggtaccccgttacggtcggtaacctacggaccccgtggtacccttcccgaccccggttacggttccctacgttacccg

SEQ ID NO: 254196 - DNA, 724 bp, Homo sapiens
  misc_feature: GYAE6OF02J0LR5.13.25.C03.1.454.CMB.1.raw
  modified_base (242)..(242): a, c, t, g, unknown or other
  misc_feature (242)..(242): n is a, c, g, or t
  modified_base (579)..(579): a, c, t, g, unknown or other
  misc_feature (579)..(579): n is a, c, g, or t
tcagtcacgtactacacgaccggtgctcgatttagtagtgtagatttggggtttggggggggtcacaagaggcagcgctctcgggacgtctccaccatggcctgggctctgctgctcctcactctcctcactcgaggacacacgggtcctcgggcccagtctgccctgactcagcctgcctccgtgtccgtgggtcctccgtggacagtcgatcaccactctccgtcacgacgtaggaaacngactaggtagacttcggttgggtaacctttagtacgtactttcgtacctcgtacggtacccaaccgtacccacccgacggacaaccgggcccctaagacgtcaactcgttaagttacggtacggggtacaaacggtccgggtccggaccgttacggtacggggtaaccttttcccgaccgttccgttccgtttctaccggtcgcccgttaaccgaacttcggtgaaccgaacgtacccgtcccttactaccggactaacgttccgtcgtacgtctccgaggtcttaggacggtacgacgtacgtactaccgtttagtccacgtcgtcagtctacgtnttacgacgtttactcgttacgtcgttacgttcgccgggtacgggttaccgaccgttaacggtccggtaaccgtccgtttaacggccggtaaccgtccggaacgttccgtccccggttcccgtcggtacccttaccggttaccccg

SEQ ID NO: 254197 - DNA, 338 bp, Homo sapiens
  misc_feature: GYAE6OF02H9B4T.13.25.C03.1.454.CMB.1.raw
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
  modified_base (265)..(265): a, c, t, g, unknown or other
  misc_feature (265)..(265): n is a, c, g, or t
  modified_base (268)..(338): a, c, t, g, unknown or other
  misc_feature (268)..(338): n is a, c, g, or t
tcagtcacgtactacacgaccggtgctcgatttagtagtgtagatttgggtttggggggtgtgggtggtctccactcccgccttgaccgaggctgcctattacctgctgctcatatgcaggttctctgtggtcttcggcggagggtccaaagtgaccgtcctaggtcagcccaaggctcgccccctggtcactctggttccccaccccttctaccgtagtaccgtggtatcgagccgggctaggcgaaggcncgtattacgnagnacnnnnnnnnnnnnnnnnnnnnnnnnnnnnnnnnnnnnnnnnnnnnnnnnnnnnnnnnnnnnnnnnnnnnnnn

SEQ ID NO: 254198 - DNA, 729 bp, Homo sapiens
  misc_feature: GYAE6OF02GNADE.13.25.C03.1.454.CMB.1.raw
  modified_base (204)..(204): a, c, t, g, unknown or other
  misc_feature (204)..(204): n is a, c, g, or t
  modified_base (364)..(364): a, c, t, g, unknown or other
  misc_feature (364)..(364): n is a, c, g, or t
  modified_base (478)..(478): a, c, t, g, unknown or other
  misc_feature (478)..(478): n is a, c, g, or t
tcagtcacgtactacacgaccggtgctcgatttagtagtgtagatttgggtttgggggagcatcacccagcaaccacatctgtccctctagagaatcccctgagagctccgttcctcaccatggactggacctggaggatcctcttcttggtggcagcagccacagcagcccactcccaagtgcctctagaaacaggtccgggntgaggtgaagaacgccgtggggcctacacggtagaacggtcctccgtgacgaacggtccttaccggactaccaccctcaaacgtacggtaaacttatcgtacctacgttaatggtacgcgaacgccggacccgaggaacgtaacggtcttcgtggtaggngtggggtgactaccgtaacctaagtaggtgacgtacaaactaagtactaagaagtaaagtaagtttcggacggggtccgtacacgtagtcgaacgtacgggaccacgtacctanacctaataccgtagtacccttagacggtacggtaacctacgaaccgagttacctaccgtacccttacggaacggaaccgaaccgtaccggtaccgttacgttaacgtttagtcgttcggaacccggttaaccgtaacgtccgtaaccgttacccttaaacggttttaacctttaggggttaacggttttaccgggaccgttaacggggtcccgtcggttacccggtacccgttacccgtccttaaccccgg

SEQ ID NO: 254199 - DNA, 284 bp, Homo sapiens
  misc_feature: GYAE6OF02HR6PP.13.25.C03.1.454.CMB.1.raw
  modified_base (257)..(284): a, c, t, g, unknown or other
  misc_feature (257)..(284): n is a, c, g, or t
tcagtcacgtactacacgaccggtgctcgatttagtagtgtagatttgggtttgggggggtgtgggtggtctccactcccgccttgacgaggctgcctattactgctgctcatatgcaggttcttctgtggtcttcggcggagggtccaaagtgaccgtcctaggtcacgcccaagcctcgcccccctcggtcactctcgttccccgccctcctctagtacgtgactggacgccgggctaggactaaggcgcaatgnnnnnnnnnnnnnnnnnnnnnnnnnnnn

SEQ ID NO: 254200 - DNA, 254 bp, Homo sapiens
  misc_feature: GYAE6OF02FPUWS.13.25.C03.1.454.CMB.1.raw
  modified_base (244)..(254): a, c, t, g, unknown or other
  misc_feature (244)..(254): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgcccccctggtcactctgttcccgccctcctctagtacgtgactgagcgggctggcaaggcgcatagnnnnnnnnnnn

SEQ ID NO: 254201 - DNA, 248 bp, Homo sapiens
  misc_feature: GYAE6OF02IHJAB.13.25.C03.1.454.CMB.1.raw
  modified_base (243)..(248): a, c, t, g, unknown or other
  misc_feature (243)..(248): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggaggtccaaagtgaccgtcctaggtcagcccaaggctcgccccctggtcactctgttccccacctcctctacgtacgtgactgagcgggctggcaaggcgcatgnnnnnn

SEQ ID NO: 254202 - DNA, 253 bp, Homo sapiens
  misc_feature: GYAE6OF02GJ44Y.13.25.C03.1.454.CMB.1.raw
  modified_base (119)..(119): a, c, t, g, unknown or other
  misc_feature (119)..(119): n is a, c, g, or t
  modified_base (230)..(230): a, c, t, g, unknown or other
  misc_feature (230)..(230): n is a, c, g, or t
  modified_base (239)..(239): a, c, t, g, unknown or other
  misc_feature (239)..(239): n is a, c, g, or t
  modified_base (243)..(253): a, c, t, g, unknown or other
  misc_feature (243)..(253): n is a, c, g, or t
tcagtcacgtactacacgaccggtgctcgatttagtagtgtagatttgggtttggggggtgtggtggtctccactcccgccttgacgaggctgcctattaaaactgctgctcatatgcnggttcttctgtggtcttcggcggagggtcaaagtgaccgtcctaggtcagcccaaggctcgccccctggtcactctcgttcccgccctcctctagtacgtgactgagcggntggcaggcnatgnnnnnnnnnnn

SEQ ID NO: 254203 - DNA, 250 bp, Homo sapiens
  misc_feature: GYAE6OF02JZL5C.13.25.C03.1.454.CMB.1.raw
  modified_base (244)..(250): a, c, t, g, unknown or other
  misc_feature (244)..(250): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttccccaccctcctctagtacgtgactgagcgggctggcaaggcgcatagnnnnnnn

SEQ ID NO: 254204 - DNA, 761 bp, Homo sapiens
  misc_feature: GYAE6OF02HWDS9.13.25.C03.1.454.CMB.1.raw
tcagtcacgtactacacgaccggtgctcgatttagtagtgtagatttgggtttggggggggtcacaagaggcagcgctctcgggacgtctccaccagtggcctgggctctgctgctcctacactctcctcactcaggacacgagggtcctcgggcccagtcctcgccctgactcacgcctgcctccgtgtcgtcggtcctcgtaggactaggtactactccaactctctccgtgactacgtaaggaaacctgacgtagtgtacgttaccggttaggtaacttaagtacgtcgttcgttcctccgtacgtaaccaacctacccaacccggaggacccgaacccggtccccgtaagtacgtacctacgttaccgttaaagtttagggcgggaactaaggtccggggcccgtaccggtacgtaaggttacctcctacgttccgtactttacgccgtcggtacctaccgtaacgtcgtaggaaacctcggacccgttccaccgtaagaacctcgttccgtacgttaccgtcgaccggtagtacggtacggtacggacggtacggtcgtccgtacttacgtcgtacgccgtactacgactaactacggtacctacgttccgtttacttccggttggttccggttcgtaacgggttacggtaccggtacgtaacggtaccgttacccggtaccggtacggtaccgtaacccggtccgtaaccggttcccgtcccggtacccccgttacgtacccgtcccgttacccg

SEQ ID NO: 254205 - DNA, 777 bp, Homo sapiens
  misc_feature: GYAE6OF02JV5JK.13.25.C03.1.454.CMB.1.raw
  modified_base (220)..(220): a, c, t, g, unknown or other
  misc_feature (220)..(220): n is a, c, g, or t
  modified_base (237)..(237): a, c, t, g, unknown or other
  misc_feature (237)..(237): n is a, c, g, or t
tcagtcacgtactacacgaccggtgctcgatttagtagtgtagatttgggtttgggggggtcgacgaagaggcagcgctctcgggacgtctccaccatggcctggctctgctgctcctcactctcctcactcaggacacaggtcctgggcccagtctcgcctgactcagcctgcctcgtcgtcgtggtctcctaggacacgtcgatcgaccactcgtccngaccacgtacgaaacgngccgtagtacgaacgttcgttacgggtaactttacgtacggtactttcgttccgtccgttacggaaccctaaccaccccgtaacccgacggaccgaaccggaccccccgaagaccggtactaactcgttaatttacggcggggtaacaagtacgggccggaccggttcggaacggttaccgtttaccgaaccgtcggttccttccgttcgtcggtacctaccgttaacggtcctacggaccgtaaacggaccgtccccgtacctacgtaaccgaacttcgttaccgtccgtacgtccgtacgggcttacgggacgggtaaccgacggttccgcgttaacccttaaggtttaccgtcgtaccgtcgttcctacgttacgtagttccgtaccgtttaacgtttccgtttacggtccgtttacgggttcgttaccgggtacggaaccggttaccgtaacgggtccggtacccgttacggttaccgggacgttaccgaccggtacgtcccgtaccgtccccgttaacgtctacccgtttacccg

SEQ ID NO: 254206 - DNA, 788 bp, Homo sapiens
  misc_feature: GYAE6OF02FPRVA.13.25.C03.1.454.CMB.1.raw
  modified_base (235)..(235): a, c, t, g, unknown or other
  misc_feature (235)..(235): n is a, c, g, or t
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactcgtcctcactcaggacacgagggtcctgggccccagtctcgccctgactcagcctgcctccgtgtctgggtctcctggacagtcgatccacatcctcctgcctactagaaacngcagtgactcgtgggactttaganacttntctccgtgaccaacaccaccaggacacggccccagactacatactagttagcggggacaacgtcggcggccgtacgagggtactttaccgactccgtctttcgtaccgtggcctaccgtaaggttcgtcgggtaccaaccgacgtccccgtttcccgtaggaacctacgttaccttcggttaacggtccctaccgtaagggtccgtagggaaacgggtaccggtaacgggtccgtccgtaaccgtttacgttacgttacgggtcccttagtaccctactacgttaacgtttcgaaccgttttacgggttttcccttggtttaccgggttcgggtttaccgtttcccgggggacggtttaaccgggggtacccgttaaacgggttacccggggttcccggtttaaacccggttacccggggttaacccgaacgggttaaccccccggtaaaccgggtccccgggttcccccgggttaacccccccggttttcgggtttacccccggtaacccgtttttcccccgg

SEQ ID NO: 254207 - DNA, 272 bp, Homo sapiens
  misc_feature: GYAE6OF02G9DMK.13.25.C03.1.454.CMB.1.raw
  modified_base (246)..(272): a, c, t, g, unknown or other
  misc_feature (246)..(272): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtcaaagtgaccgtctaggtcagcccaaggctcgccccctcggtcactctcgtcccgccctctctagtacgtgactggagtcggggctggcgaaggcgcatagnnnnnnnnnnnnnnnnnnnnnnnnnnn

SEQ ID NO: 254208 - DNA, 741 bp, Homo sapiens
  misc_feature: GYAE6OF02FQ49H.13.25.C03.1.454.CMB.1.raw
  modified_base (157)..(157): a, c, t, g, unknown or other
  misc_feature (157)..(157): n is a, c, g, or t
  modified_base (165)..(165): a, c, t, g, unknown or other
  misc_feature (165)..(165): n is a, c, g, or t
  modified_base (183)..(183): a, c, t, g, unknown or other
  misc_feature (183)..(183): n is a, c, g, or t
  modified_base (213)..(213): a, c, t, g, unknown or other
  misc_feature (213)..(213): n is a, c, g, or t
tcagtcacgtactacacgaccggtgctcgatttagtagtgtagatttgggtttggggggggtcacaagaggcagcgctctcgggacgtctccacatggcctgggctctgctgctcctcactctcctcactcaggacacagggtcctgggcccagtcngcctgacncagcctgcctccatcgtntgggtctccgtggacagtcgatcaccatcncctgaccacgtaggtaaatcggcacgtgagttggttacgggacttatcgtacttcgtcgtcctacggtacctaccgaacctacccgaggacctaaaaccgtacccccaaacttcgaacgtttacggtttacggggtacctaagtacggccggtaccttcggaccggggttcctagacgttcgctttctccgtcgtcctacgtacgttcgacgacgaaccgtacgtccctacccgtagacctagttccgtcgtacggtccctccggaggcgttacggtaggtcttacggtcgttaccgttagtacgtttacgtttacgacggttcttacgaccgttcgtagtacgttacggtacggtacgtaccgtaacggtacctttaaccgtaaccgttacggttaaaccgttacgggtccgggtacggggttaacccgtaaccggaaccggttaccggttacggtacccggttaccggttacggtaaccgtacccggtaacccggacggttcccgtacccggtccccgtttaccgg

SEQ ID NO: 254209 - DNA, 749 bp, Homo sapiens
  misc_feature: GYAE6OF02FNP9S.13.25.C03.1.454.CMB.1.raw
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
  modified_base (228)..(228): a, c, t, g, unknown or other
  misc_feature (228)..(228): n is a, c, g, or t
  modified_base (557)..(557): a, c, t, g, unknown or other
  misc_feature (557)..(557): n is a, c, g, or t
  modified_base (610)..(610): a, c, t, g, unknown or other
  misc_feature (610)..(610): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaacntctccngcactaggaaacngcagtcgtacttcggtagggtattatacggtacttcggtcttccgttggtaacccaaaacctacccccgaaccgaacgggacccgaaaaccggtaccccccgtaacggtaacggttccaacgttaccgttaaggttttaacgggtacggggggaactaaacgggttcgggggccccggttacccggttacggaacggggttaccgtttacctaaccggttccgtaccgtttcgtacggtcgtaccttacgtaaacggttccgagggtaccctaaacggtcccggtccctaccgtacggtaacctaccgttcgtcgtacggtcctaacgngtacccgtggacgacggacgtctaggttacttaacgtacgtcggccgtacttnaagttcgtaccgtgttaccggtttctgttacgttcggtcggttcggtacgggtacgttacgacgttccggtcgtacgtacggtacaccggtaccgaacggtccgtcccggttaccgtcggaccgtccttcgttaccccg

SEQ ID NO: 254210 - DNA, 251 bp, Homo sapiens
  misc_feature: GYAE6OF02F2H4U.13.25.C03.1.454.CMB.1.raw
  modified_base (245)..(251): a, c, t, g, unknown or other
  misc_feature (245)..(251): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaacggcgcatagnnnnnnn

SEQ ID NO: 254211 - DNA, 318 bp, Homo sapiens
  misc_feature: GYAE6OF02IEV35.13.25.C03.1.454.CMB.1.raw
  modified_base (229)..(229): a, c, t, g, unknown or other
  misc_feature (229)..(229): n is a, c, g, or t
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
  modified_base (267)..(318): a, c, t, g, unknown or other
  misc_feature (267)..(318): n is a, c, g, or t
tcagtcacgtactacacgaccggtgctcgatttagtagtgtagatttggggtttgggggggtgtggtggtctccactcccgccttgacgaggctgcctattactgctgctcatatgcgaaggtttccttctgtggttcttcggggagggtccaaaggtgacctcctaggtcagcccaggctcgccccctggtccattcctcgttaccccacccctcctactagttacgnactggacggcggggctggaccaagggccnaagtagncnnnnnnnnnnnnnnnnnnnnnnnnnnnnnnnnnnnnnnnnnnnnnnnnnnnn

SEQ ID NO: 254212 - DNA, 532 bp, Homo sapiens
  misc_feature: GYAE6OF02GFXH5.13.25.C03.1.454.CMB.1.raw
  modified_base (259)..(259): a, c, t, g, unknown or other
  misc_feature (259)..(259): n is a, c, g, or t
  modified_base (266)..(266): a, c, t, g, unknown or other
  misc_feature (266)..(266): n is a, c, g, or t
  modified_base (270)..(272): a, c, t, g, unknown or other
  misc_feature (270)..(272): n is a, c, g, or t
  modified_base (289)..(289): a, c, t, g, unknown or other
  misc_feature (289)..(289): n is a, c, g, or t
  modified_base (310)..(310): a, c, t, g, unknown or other
  misc_feature (310)..(310): n is a, c, g, or t
  modified_base (313)..(313): a, c, t, g, unknown or other
  misc_feature (313)..(313): n is a, c, g, or t
  modified_base (316)..(316): a, c, t, g, unknown or other
  misc_feature (316)..(316): n is a, c, g, or t
  modified_base (319)..(319): a, c, t, g, unknown or other
  misc_feature (319)..(319): n is a, c, g, or t
  modified_base (326)..(327): a, c, t, g, unknown or other
  misc_feature (326)..(327): n is a, c, g, or t
  modified_base (331)..(332): a, c, t, g, unknown or other
  misc_feature (331)..(332): n is a, c, g, or t
  modified_base (334)..(335): a, c, t, g, unknown or other
  misc_feature (334)..(335): n is a, c, g, or t
  modified_base (338)..(338): a, c, t, g, unknown or other
  misc_feature (338)..(338): n is a, c, g, or t
  modified_base (340)..(340): a, c, t, g, unknown or other
  misc_feature (340)..(340): n is a, c, g, or t
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
  modified_base (437)..(437): a, c, t, g, unknown or other
  misc_feature (437)..(437): n is a, c, g, or t
  modified_base (459)..(459): a, c, t, g, unknown or other
  misc_feature (459)..(459): n is a, c, g, or t
tcagtcacgtactacacgaccggtgctcgatttagtagtgtagatttgggtttggggggtggtgggtggtctccactcccgccttgacgaggctgcctatactgctgctcatatgcaggttcttctgtcggtcttcggcggagggtccaaagtcgaccgtctaggtcagcccaaggtctcgacccccctggtccacgtctacgttccccacccttctacgtagtacggtcgactggagtccgggactgggctaagggcncagtacnatcnnnagctgatcagctgaccntggatgatgatggcccttaanacngtnacnggtcacnncgtnncnngtncncnctgtctncatatgtcgtntacncgtcgtntacacactacgtgtctacgtcgtctcacgtacgactactcgagcgtcgtcgtacgtcgtcgcgtancgacgaccacgtcacgacgtanacctcgtaccgagtagtactcgtgaccgacgtacgtactatacgtaacgtacgtaacggtacgtagtaactac

SEQ ID NO: 254213 - DNA, 261 bp, Homo sapiens
  misc_feature: GYAE6OF02G3HR6.13.25.C03.1.454.CMB.1.raw
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
  modified_base (250)..(261): a, c, t, g, unknown or other
  misc_feature (250)..(261): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctcgcccccctggtcactcctcgttccccgccctcctcgtagtacgtgacctgngcgggctggcaaggcncatagnnnnnnnnnnnn

SEQ ID NO: 254214 - DNA, 679 bp, Homo sapiens
  misc_feature: GYAE6OF02JSO9E.13.25.C03.1.454.CMB.1.raw
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (322)..(322): a, c, t, g, unknown or other
  misc_feature (322)..(322): n is a, c, g, or t
  modified_base (466)..(466): a, c, t, g, unknown or other
  misc_feature (466)..(466): n is a, c, g, or t
tcagtcacgtactacacgaccggtgctcgatttagtagtgtagatttgggtttgggggggggtcacaagaggcagcgctctcgggacgtctccacatggcctgggctctgctgctcctcactctcctcactcgaggacacgagggtcctgggcccagtctcgccctgactcagcctgccctcgtgtcgtgggctccgtggacngtcgatacaccntccgtcagaccacgtaggaaacagcgtacgtagtattcgggttaggtacttatagtacttcgtcctcgtacgtaaccaacacccacgagcgaccggccacggactcnctacttagttacggtagggacaacggcggacggcgtacggaggtacttctaccgtcgttcgtcgtagtcggtactaccgtaacgtcgaccgggtacaaacccggtccggtcctacctagtacctacgttcctacgttcggtacncgtaacggcgtagacggtcgagtcctagtaccttatcgtgcctacgtacgtctaactcgtcgtacgttcgttacgttgtacggttaccggtcggtccgggtacgggtcggtaaccgtaacgtccggttaaccggttaccgttacggtaacggcccgtaacggtaccggttaccgccccgttaacccggtcggtaccccttacgggttaccccg

SEQ ID NO: 254215 - DNA, 595 bp, Homo sapiens
  misc_feature: GYAE6OF02HK1HE.13.25.C03.1.454.CMB.1.raw
  modified_base (248)..(248): a, c, t, g, unknown or other
  misc_feature (248)..(248): n is a, c, g, or t
  modified_base (251)..(252): a, c, t, g, unknown or other
  misc_feature (251)..(252): n is a, c, g, or t
  modified_base (255)..(255): a, c, t, g, unknown or other
  misc_feature (255)..(255): n is a, c, g, or t
  modified_base (258)..(258): a, c, t, g, unknown or other
  misc_feature (258)..(258): n is a, c, g, or t
  modified_base (261)..(261): a, c, t, g, unknown or other
  misc_feature (261)..(261): n is a, c, g, or t
  modified_base (272)..(273): a, c, t, g, unknown or other
  misc_feature (272)..(273): n is a, c, g, or t
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
  modified_base (305)..(306): a, c, t, g, unknown or other
  misc_feature (305)..(306): n is a, c, g, or t
  modified_base (310)..(310): a, c, t, g, unknown or other
  misc_feature (310)..(310): n is a, c, g, or t
  modified_base (313)..(313): a, c, t, g, unknown or other
  misc_feature (313)..(313): n is a, c, g, or t
  modified_base (316)..(316): a, c, t, g, unknown or other
  misc_feature (316)..(316): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
  modified_base (340)..(340): a, c, t, g, unknown or other
  misc_feature (340)..(340): n is a, c, g, or t
  modified_base (350)..(350): a, c, t, g, unknown or other
  misc_feature (350)..(350): n is a, c, g, or t
tcagtcacgtactacacgaccggtgctcgatttagtagtgtagatttgggtttggggggtgtggtggtctccactcccgccttgacgaggctgcctattactactgctcatatgcaggttcttctgtggtcttcggcggaggtccaaagtgaccgtcaggtcagcccaaggctgcccccgtggtcactctcgtccccacctcctatacgtcgtgactgaggcgggctgggacaaggccgaccagtagncgnntancgntancgtaacttgannacctncgaatgagtcntanctgctcnacgtcnntacncgngcncgaagcagttacncncgaancggnttcaaccgtnacgactacacgtgtacgactaactcgtacgtacgtacgacgtacgtaacgtcggtacgaacgtacgtacgacgtactacgtacgaacgtacgtacgtcaccgttaacgtacgtaccgtacgaaccgagtacgtaacgtccgttacgtacgtaacgtcgtacggtcgtccgtacggtacggtacgtcggtaccgtacctacggtagtccggtacgttcgttaacgtacggtacggtacgtaccacc

SEQ ID NO: 254216 - DNA, 267 bp, Homo sapiens
  misc_feature: GYAE6OF02HLXY8.13.25.C03.1.454.CMB.1.raw
  modified_base (209)..(209): a, c, t, g, unknown or other
  misc_feature (209)..(209): n is a, c, g, or t
  modified_base (244)..(244): a, c, t, g, unknown or other
  misc_feature (244)..(244): n is a, c, g, or t
  modified_base (250)..(267): a, c, t, g, unknown or other
  misc_feature (250)..(267): n is a, c, g, or t
tcagtcacgtactacacgaccggtgctcgatttagtagtgtagatttggggtttggggggtgtggtggtctccactcccgccttgacgaggctgcctattactgctgctcatatgcaggttcttctgtggtcttcggcggaggtccaaagtgaccgtcctcggtcagcccaaggctgccccatcggtcactctcgtacccaccctcctntacgtacgtgactggaggccgggctggacaaggcncatagnnnnnnnnnnnnnnnnnn

SEQ ID NO: 254217 - DNA, 236 bp, Homo sapiens
  misc_feature: GYAE6OF01C1QRO.13.83.H06.1.454.CMB.1.raw
  modified_base (234)..(236): a, c, t, g, unknown or other
  misc_feature (234)..(236): n is a, c, g, or t
tcagtcacgtactacacgaccggtgctcgatttagatcacgtgcgtcgcggggcacttttgatatctggggccaagggtcgatggtcatcgtctcttcagcctccaccaagggcccatcggtcttcccctggcgccctgctccaggagcacctccgagagcacagcggccctgggctgcctggtcaaggactacttcctagtacgtgactgagcgggctggcaaggcgcatagnnn

SEQ ID NO: 254218 - DNA, 254 bp, Homo sapiens
  misc_feature: GYAE6OF01A049G.13.83.H06.1.454.CMB.1.raw
  modified_base (235)..(254): a, c, t, g, unknown or other
  misc_feature (235)..(254): n is a, c, g, or t
tcagtcacgtactacacgaccggtgctcgatttagatcacgtgcgtcgcggggcacttttgatatctggggccaagggtcgatggtcatcgtctcttcagcctccaccaagggcccatcggtcttccccctggcgccctgctccaggagcacctccgagagcacagcggccctgggctgcctggtcaaggactacttcctagtacgtgactgagcgggctggcaaggcgcatagnnnnnnnnnnnnnnnnnnnn

SEQ ID NO: 254219 - DNA, 234 bp, Homo sapiens
  misc_feature: GYAE6OF01BKWE9.13.83.H06.1.454.CMB.1.raw
  modified_base (234)..(234): a, c, t, g, unknown or other
  misc_feature (234)..(234): n is a, c, g, or t
tcagtcacgtactacacgaccggtgctcgatttagatcacgtgcgtcgcgggcacttttgatatctggggccaagggtcgatggtcatcgtctcttcagcctccaccaagggcccatcggtcttccccctggcgccctgctcaaggagcacctccgagagcacagcggccctgggctgcctggtcaaggactacttcctagtacgtgactgagcgggctggcaaggcgcatagn

SEQ ID NO: 254220 - DNA, 237 bp, Homo sapiens
  misc_feature: GYAE6OF01DH0PW.13.83.H06.1.454.CMB.1.raw
  modified_base (233)..(237): a, c, t, g, unknown or other
  misc_feature (233)..(237): n is a, c, g, or t
tcagtcacgtactacacgaccggtgctcgatttagatcacgtgcgtcgcggggcacttttgatatctgggccaagggtcgatggtcatcgtctcttcagcctccaccaagggcccatcggtcttcccctggcgccctgctccaggagcacctccgagagcacagcggccctgggctgcctggtcaaggactacttcctagtacgtgactgagcgggctggcaaggcgcatagnnnnn

SEQ ID NO: 254221 - DNA, 240 bp, Homo sapiens
  misc_feature: GYAE6OF01CMK4C.13.83.H06.1.454.CMB.1.raw
  modified_base (234)..(240): a, c, t, g, unknown or other
  misc_feature (234)..(240): n is a, c, g, or t
tcagtcacgtactacacgaccggtgctcgatttagatcacgtgcgtcgcggggcacttttgatatctggggccaagggtcgatggtcatcgtctcttcagcctccaccaagggcccatcggtcttcccctggcgccctgctccaggagcacctccgagagcacagcggccctgggctgcctggtcaaggactacttcctagtacgtgactgagcgggctggcaaggcgcatagnnnnnnn

SEQ ID NO: 254222 - DNA, 281 bp, Homo sapiens
  misc_feature: GYAE6OF01CHN7U.13.83.H06.1.454.CMB.1.raw
  modified_base (241)..(281): a, c, t, g, unknown or other
  misc_feature (241)..(281): n is a, c, g, or t
tcagtcacgtactacacgaccggtgctcgatttagatcacgtgcgtcgcgggcacttttgatagtctgggccaagggtcgatggtcatcgtctcttcagcctccaccaagggcccatcggtcttccccctggcgccctgctccaggagcacctccgagagcacagcggccctgggctgcctggtcaaaggactacttccagtaccgtgactgagcgggctgggacaaagggcacattagcnnnnnnnnnnnnnnnnnnnnnnnnnnnnnnnnnnnnnnnnn

SEQ ID NO: 254223 - DNA, 247 bp, Homo sapiens
  misc_feature: GYAE6OF01C38JU.13.83.H06.1.454.CMB.1.raw
  modified_base (134)..(134): a, c, t, g, unknown or other
  misc_feature (134)..(134): n is a, c, g, or t
  modified_base (148)..(148): a, c, t, g, unknown or other
  misc_feature (148)..(148): n is a, c, g, or t
  modified_base (229)..(229): a, c, t, g, unknown or other
  misc_feature (229)..(229): n is a, c, g, or t
  modified_base (235)..(247): a, c, t, g, unknown or other
  misc_feature (235)..(247): n is a, c, g, or t
tcagtcacgtactacacgaccggtgctcgatttagatcacgtgcgtcgcgggcacttttgatatctggggccaagggtcgatggtcatcgtctcttcagcctccaccaagggcccatcggtcttccccctggcnccctgctccaggancacctccgagagcacagcggccctgggctgcctggtcaaaggactacttcctagtacgtgactgagcgggctggcaaggcncatagnnnnnnnnnnnnn

SEQ ID NO: 254224 - DNA, 248 bp, Homo sapiens
  misc_feature: GYAE6OF01D1921.13.83.H06.1.454.CMB.1.raw
  modified_base (239)..(248): a, c, t, g, unknown or other
  misc_feature (239)..(248): n is a, c, g, or t
tcagtcacgtactacacgaccggtgctcgatttagatcacgtgcgtcgcggggcacttttgatatctggggccaagggtcgatggtcatcgtctcttcagcctccaccaagggcccatcggtcttcccctggcgccctgctccaggagcacctccgagagcacagccggccctgggctgcctggtacaaggactacttcctagtacgtgactggagcgggctggacaaggcgacatagnnnnnnnnnn

SEQ ID NO: 254225 - DNA, 244 bp, Homo sapiens
  misc_feature: GYAE6OF01EXM83.13.83.H06.1.454.CMB.1.raw
  modified_base (237)..(244): a, c, t, g, unknown or other
  misc_feature (237)..(244): n is a, c, g, or t
tcagtcacgtactacacgaccggtgctcgatttagatcacgtgcgtcgcggggcacttttgatatctggggccaagggtcgatggtcatcgtctcttcagcctccaccaagggcccatcggtcttccccctggcgccctgctccaggagcacctccgagagcacagcggccctgggctgcctggtcaaggctacttcctagtacgtgactgaggcgggctggacaaggcgacatagnnnnnnnn

SEQ ID NO: 254226 - DNA, 237 bp, Homo sapiens
  misc_feature: GYAE6OF02GY8W5.13.83.H06.1.454.CMB.1.raw
  modified_base (234)..(237): a, c, t, g, unknown or other
  misc_feature (234)..(237): n is a, c, g, or t
tcagtcacgtactacacgaccggtgctcgatttagatcacgtgcgtcgcggggcacttttgatatctggggccaagggtcgatggtcatcgtctcttcagcctccaccaagggcccatcggtcttcccctggcgccctgctccaggagcacctccgagagcacagcggccctgggctgcctggtcaaggactacttcctagtacgtgactgagcgggctggcaaggcgcatagnnnn

SEQ ID NO: 254227 - DNA, 238 bp, Homo sapiens
  misc_feature: GYAE6OF02I0SFU.13.83.H06.1.454.CMB.1.raw
  modified_base (233)..(238): a, c, t, g, unknown or other
  misc_feature (233)..(238): n is a, c, g, or t
tcagtcacgtactacacgaccggtgctcgatttagatcacgtgcgtcgcgggcacttttgatatctggggccaagggtcgatggtcatcgtctcttcagcctccaccaagggcccatcggtcttccccctggcgccctgctccaggagcacctccgagagcacagcggccctgggctgcctggtcaaggactacttcctagtacgtgactgagcggctggcaaggcgcatagnnnnnn

SEQ ID NO: 254228 - DNA, 238 bp, Homo sapiens
  misc_feature: GYAE6OF02IX5HU.13.83.H06.1.454.CMB.1.raw
  modified_base (235)..(238): a, c, t, g, unknown or other
  misc_feature (235)..(238): n is a, c, g, or t
tcagtcacgtactacacgaccggtgctcgatttagatcacgtgcgtcgcgggcacttttgatatctggggccaagggtcgatggtcatcgtctcttcagcctccaccaagggcccataacggtcttcccctggcgccctgctccaggagcacctccgagagcacagcggccctgggctgcctggtcaaggactacttcctagtacgtgactgagcgggctggcaaggcgcatagnnnn

SEQ ID NO: 254229 - DNA, 237 bp, Homo sapiens
  misc_feature: GYAE6OF02GD4G5.13.83.H06.1.454.CMB.1.raw
  modified_base (234)..(237): a, c, t, g, unknown or other
  misc_feature (234)..(237): n is a, c, g, or t
tcagtcacgtactacacgaccggtgctcgatttagatcacgtgcgtcgcggggcacttttgatatctggggccaagggtcgatggccatcgtctcttcagcctccaccaagggcccatcggtcttcccctggcgccctgctccaggagcacctccgagagcacagcggccctgggctgcctggtcaaggactacttcctagtacgtgactgagcgggctggcaaggcgcatagnnnn

SEQ ID NO: 254230 - DNA, 516 bp, Homo sapiens
  misc_feature: GYAE6OF01BAOAL.21.39.D06.1.454.CMB.1.raw
  modified_base (396)..(396): a, c, t, g, unknown or other
  misc_feature (396)..(396): n is a, c, g, or t
  modified_base (512)..(512): a, c, t, g, unknown or other
  misc_feature (512)..(512): n is a, c, g, or t
tcagtcgtcgctcgcacgaccggtgctcgatttagtgacatctcgcagttctttgggggcaggagtcaggcccagtcaggacacagcatggacatgagggtccccgctcagctcctggggctcctgctgctctggttcccaggctccagatgcgacatccagatgacccagtctccatcctccgtgtctgcgtctgtaggagacagagtaaccatcacttgtcgggcgagtcagggtattagcagctggttagcctggtatcagcagaaaccagggaaagcccctaaactcctgatctatgctgcatccagtttggaaagtggggtccatcaaggttcagcggcagtgatctggacagatttcactctcaccatcagcagcctgcagcctgaagtnttttgactaactttattattgtacaactaggccttactaccggtttcccccggacgtttccggcggtacgggaccaagggtcggagatcgaaacgactaggtcggactgctaccgntccg

SEQ ID NO: 254231 - DNA, 501 bp, Homo sapiens
  misc_feature: GYAE6OF01DOWWE.21.39.D06.1.454.CMB.1.raw
  modified_base (420)..(420): a, c, t, g, unknown or other
  misc_feature (420)..(420): n is a, c, g, or t
  modified_base (491)..(491): a, c, t, g, unknown or other
  misc_feature (491)..(491): n is a, c, g, or t
  modified_base (495)..(495): a, c, t, g, unknown or other
  misc_feature (495)..(495): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcagtcagggtattagcagctggttagcctggtatcagcagaaaccagggaaaagcccctaaaactcctgatctatgctgcatccagtttggaaagtgggtcccatcaaaggttcagcggcagtggatctgggacagatttcactctcaccatcagcagcctgcagcctgaagattttgcaacttaattattgtntaacaggctcacggtttccccggacttcggcgagggaccgaaaggtaggagatacaaacgaaactgtaggntcgncctaac

SEQ ID NO: 254232 - DNA, 565 bp, Homo sapiens
  misc_feature: GYAE6OF01A0LCF.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggttagcctggtatcagcagaaaccagggaaagcccctaaactcctgatctatgctgcatccagtttggaaagtgggtcccatcaaggttcagcggcagtggatctgggacagatttcactctcaccatcagcagcctgcagcctgaagtattttgctaactttattattgtactaacgaggtcttaccgtacccgggttttcccccggacgttttccgggaccgggaacggggtacccgaaaggggttgggaacggtaacttaccgaaaaaccggtaaccgttagggttacgggaccgttcggacctaacccgtacg

SEQ ID NO: 254233 - DNA, 493 bp, Homo sapiens
  misc_feature: GYAE6OF01ENQXQ.21.39.D06.1.454.CMB.1.raw
  modified_base (345)..(345): a, c, t, g, unknown or other
  misc_feature (345)..(345): n is a, c, g, or t
  modified_base (485)..(485): a, c, t, g, unknown or other
  misc_feature (485)..(485): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcagtcagggtattagcagctggttagcctggtatcagcagaaaccagggaaacgcccctaaactcctgatctatgctgcatccagttgaagtggtccatcaagtcagcggcagtgatcngggacagtattcactctcacatcagcagcctgcagcctgaatatttagactaacttattattgtacaactaggtctctaccggtttccccggactttcggcggtacggacgaggtggagactacgaaagacgtgtacggntgcactag

SEQ ID NO: 254234 - DNA, 721 bp, Homo sapiens
  misc_feature: GYAE6OF01AKYGA.21.39.D06.1.454.CMB.1.raw
  modified_base (261)..(261): a, c, t, g, unknown or other
  misc_feature (261)..(261): n is a, c, g, or t
tcagtcgtcgctcgcacgaccggtgctcgatttagtgacatctcgcagttctttggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggttagcctggcacngacgacgaacgaacggaaggaaccaccctaactcgtagtactactagtcgtctcgactacgtaccgttaggttaacgggtaacgggttccgggtacctacgtaacggtaacggttacgacggcggtacgtaggtacggtacgtcgggtacgggtaacgtacggtttactttaccgtaccttccgtaaccctaacctactaccgacgaccgtaccgtccgtacgaccgtaccgtacgtaaggtaagtttacgtttacgaacctttaaactttactttaagttaccgtaaccgtaacggtaccgttacccgttacccgggttaacccccgggtttaccccggttaccgggttaccgggtaaccggggtaaccgggttaaaccgggtagggtacggtaaccgtaacgtaaacccggtaaaacgggtaccggttacggtacggtaccggtacgacccgtaaccg

SEQ ID NO: 254235 - DNA, 651 bp, Homo sapiens
  misc_feature: GYAE6OF01CECXY.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggttagcctggtatcagcaagaaaccagggaaacgcccctaaactcctagatctatgctgcatccgtagtttaggaaagtcgggacctactagtaacgtacggtacgacggcgagtggtacgtacgtcgggtacggaacgtagtttacttaccgtaccttacctaccaactacacgacgacgtaccgtcgtacgacgaccgtacgtaaggttaacttttagttacgtaactttaacgtttaatttacgttactaaccgaacggtcgttacccgttacccggtttaccccgggttacccggttacggttacccggggacggggtaaccggtaacgggtaagggtacggtaacgtaacgtaaaccggaaacgttacggtacggtacgtcgtacgtacccgtaaccg

SEQ ID NO: 254236 - DNA, 565 bp, Homo sapiens
  misc_feature: GYAE6OF01CLBWO.21.39.D06.1.454.CMB.1.raw
  modified_base (406)..(406): a, c, t, g, unknown or other
  misc_feature (406)..(406): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcgagggtattagcagctggttagcctggtatcagcagaaaccgagggaaacgcccctaaactcctgactctatgctgcatccgtagttggaagtcgggtccatcaagttcagcggcagtggatcgtggactagtattcactctcactatcagcagcctgccagtcctgtaagttntttagactaactttattattcgtactaacgcggtccttaccgtacccgggtttcccccggtagtttaccggggaccggtaacgggtacccgtaagggtgggtaaacgtacgtaaccgtaaaacggtacgttaggtacggacttcggacctaccgtaacg

SEQ ID NO: 254237 - DNA, 532 bp, Homo sapiens
  misc_feature: GYAE6OF01BFVHR.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcagtcagggtattagcagctggttagcctggtatcagcagaaaccagggaaacgcccctaaactcctgatctatgctgcatccagttggaagtgggtccatcgaaggttcagcggcagtggatcgtgggacagtatttcactctcacatcagcagcctgcagcctgaagtattttgactaactttattattgtactaacgtagtccttaccgtaccgggtttcccccggtacgtttccgggacgggtacgggaccgtaagggtggaagtactacgaaacgacgtggtacggactcgccgtactacg

SEQ ID NO: 254238 - DNA, 568 bp, Homo sapiens
  misc_feature: GYAE6OF01DXKHC.21.39.D06.1.454.CMB.1.raw
  modified_base (411)..(411): a, c, t, g, unknown or other
  misc_feature (411)..(411): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgcgggcgagtcagggtattagcagctggttagcctggtatcagcaagaaaccagggaaacgacccctaaactcctgatctatgctgcatcctagtttaggaaagtcgggtacccagtcgaaggttcaggcggcagtggatcgtgggacagtatttcactctacacatcagcacgcctgcagcctagaagtnttttagactaactttattaattgtactaacgtacggtcctacgtacccggtttccccggacgttttaccgggaccgggtaacgggtaaccgtaaggggtaggaacggtactaaccgaaaaccgtaacgttggtacggacttacgaccgtacctaacg

SEQ ID NO: 254239 - DNA, 546 bp, Homo sapiens
  misc_feature: GYAE6OF01DLFPT.21.39.D06.1.454.CMB.1.raw
  modified_base (282)..(282): a, c, t, g, unknown or other
  misc_feature (282)..(282): n is a, c, g, or t
  modified_base (412)..(412): a, c, t, g, unknown or other
  misc_feature (412)..(412): n is a, c, g, or t
  modified_base (439)..(439): a, c, t, g, unknown or other
  misc_feature (439)..(439): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggttagcctggtatcagcaagaaaccagggaaacncccctaaactcctagatctatgctgcatccagtttaggaaagtcgggtacccagtcgaaggttcaggcggcaggtgatcgtggactagtatttcactctacacctatcagcagcctgcagcctagaagtntttgactaatttatattgtactaacgngtcttacgtacccggtttccccggtagtttccgggacgggtacgggtaaccgtaacgggtggaacggtactaacgaaacgtacgtggtacggtatcgcctacgtacg

SEQ ID NO: 254240 - DNA, 542 bp, Homo sapiens
  misc_feature: GYAE6OF01CZETE.21.39.D06.1.454.CMB.1.raw
  modified_base (107)..(107): a, c, t, g, unknown or other
  misc_feature (107)..(107): n is a, c, g, or t
  modified_base (276)..(276): a, c, t, g, unknown or other
  misc_feature (276)..(276): n is a, c, g, or t
tcagtcgtcgctcgcacgaccggtgctcgatttagtgacatctcgcagttctttgggggcaggagtcagacccagtcaggacacagcatggacatgagggtccccgntcagctcctggggctcctgctgctctggttcccaggctccagatgcgacatccagatgacccagtctccatcctccgtgtctgcgtctgtaggagacagagtcaccatcacttgcgggcgagtcaggtattagcagctgtagcctggtatcagcagaaacagggaaacnccctaaactctagatctatgctgcatccagtttggaaagtgggtccagtcgaagttcagcggcagtgatcgtggacagtatttcactctctacatcagcagtcctgcctagctagtaagtattttagaaactttattattgtacaacgtagtcctacgtaccggtttccccggaagttttccgggacggacgggtaaccgaagggtacggaagaacgttacgaaaaccgtaacgttggtacggtactaggaccaccgtagttcccg

SEQ ID NO: 254241 - DNA, 588 bp, Homo sapiens
  misc_feature: GYAE6OF01BAH5Q.21.39.D06.1.454.CMB.1.raw
tcagtcgtcgctcgcacgaccggtgctcgatttagtgacatctcgcagttctttgggggcaggagtcaggcccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgcgggcgagtcagggtattagcagctggttagcctggtatcagcagaaaccgagggaaacgcccctaaactcctagatctatgctgcatccaggtttaggaaaggtgggtcccatacgaaggttcaggcggacgagtggatcgtgggactagtatttcactctcaccatcagcagcctgcagcctagaagttattttcgacttaactttatttaattcgtaccaacgtacggtccttaccgtacccgggtttcccccggtaacgtttccgggaccgggtaacggggtaacccgtaaaggggtggtaacggtaacgtaccgtaaaacggtaacgttagggtacggtaccgtacgtacccgtaccgtacg

SEQ ID NO: 254242 - DNA, 582 bp, Homo sapiens
  misc_feature: GYAE6OF01CK7VF.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggttagcctggtatcagcagaaaccagggaaagcccctaaactcctgatctatgctgcatccagtttggaaagtgggtcccatcaaggttcagcggcagtgatcgtgggacagtatttcactctcacatcagcagcctgcagcctagaagtattttgactaactttattattgtactaacgtacggtacttaccgtaccgggttttcccccggacgttttccggggaccgggtaacggggtaacccgtaaaggggttagggaacggtaacgttaaccggtaaaaaccggtaacgttacgggttacgggaccttacggacccgtaacccgttaacg

SEQ ID NO: 254243 - DNA, 572 bp, Homo sapiens
  misc_feature: GYAE6OF01BTFT5.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgcgggcgagtcagggtattagcagctggttagcctggtatcagcaaggaaaccagggaaacgacccctaaatcctagatctatgctgctatccgtaggtttaggaaaggttcgggtacccaagtacgtaaggttcaggcggacaggtggatcggtagggactagtactttcactctacacatcagcacgcctgcacgtcctagaagttatttagacttaactttattacgttacgtactaacgtacgtcttaccgtaccgggttccccggtacgtttcgggacgggtaacgggaccgtaagggtacgacgtacgtaacgaaacgtacgtacggtacgacgtcgctacgtacg

SEQ ID NO: 254244 - DNA, 598 bp, Homo sapiens
  misc_feature: GYAE6OF01DYQS2.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggttagcctggtatcagcagaaaccagggaaacgccctaaactcctgatctatgctgcatccagtttggaaagtgggtcccatcaaggttcagcggcagtggatcgtgggacagtatttcgactctacacatcagcagcctgcacgcctagaagtattttcgacttaacttttaattatttacgtacctaacgtacggtccttaccgttacccgggttttccccccgggtacgttttaccggggaccggggtaacggggtaacccgtaaaggggttacgggaacgtaacgttaaccgaaaaccgggtaaccgttagggttacggtacgttacggcccgtaacccgttaacg

SEQ ID NO: 254245 - DNA, 557 bp, Homo sapiens
  misc_feature: GYAE6OF01D2EU8.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggttagcctggtatcagcagaaaccagggaaacgcccctaaactcctgatctatgctgcatccagtttaggaagtgggtcccatcaaggtcagcggcagtggatcgtggacagtatttcactctacaccatcagcacgcctgcagcctgaacgtattttgacttaacttattaattgtactaacacggtctaccgtaccgggtttcccccggacgttttccgggaccgggtaacgggaacccgtaaagggtggaacggtactaaccgtaaaaccggaacgttcggtacgggcctaggccgtaccgtaacg

SEQ ID NO: 254246 - DNA, 533 bp, Homo sapiens
  misc_feature: GYAE6OF01B3OGQ.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggttagcctggtatcagcagaaaccagggaaacgcccctaaactcctgatctatgctgcatccagtttggaaagtgggtcccatcaaggttcagcggcagtggatcgtgggacagtatttcactctcaccatcagcagcctgcagcctgaagtattttgctaactttattattgtacaactaggtccttcgtaccggtttcccccggacgtttccgggcgggtacgggaccgtaagggtggaacgtagtacgaaacggtaacgtggtacggactcgccaccgtacg

SEQ ID NO: 254247 - DNA, 582 bp, Homo sapiens
  misc_feature: GYAE6OF01AXHB2.21.39.D06.1.454.CMB.1.raw
  modified_base (202)..(202): a, c, t, g, unknown or other
  misc_feature (202)..(202): n is a, c, g, or t
  modified_base (250)..(250): a, c, t, g, unknown or other
  misc_feature (250)..(250): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtagganacagagtcaccatcacttgcgggcagtcgaggtattagcagctggtanctgtatcagcagaaaccagggaacgaccctaaactcctagatctatgctgcatactagttggaaagtcgggtaccagtcaaggttcaggcgcaggtacgatcgtgggactagtacttcactctacacctatcagcacgcctgcagtcctagtaacgtagttttacgaccttaagtttatttattacgtacgtaacgtacggtaccttaccgtacccgggtttacccccggtacgtttaccgggacccgggtaacgggtaacccgtaagggttacgggacggtaaccgttacgaaaacgtacgtacggtacgggacttcggacctaccgtacg

SEQ ID NO: 254248 - DNA, 600 bp, Homo sapiens
  misc_feature: GYAE6OF01A079G.21.39.D06.1.454.CMB.1.raw
  modified_base (419)..(419): a, c, t, g, unknown or other
  misc_feature (419)..(419): n is a, c, g, or t
tcagtcgtcgctcgcacgaccggtgctcgatttagtgacatctcgcagttctttgggggcaggagtcaggcccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggttagcctggtatcagcaagaaaccgaagggaaccgtaccctaaacctcctagatactatcgctgcatccgtaggtttacggaaggttcgggtacccagtacgtaacggttcaggcggacgtaggtggattcggtagggactagtactttacactctcaccatcacgtacncgcctgcacgtctagtagttatttgaccttaactttatttagttacgtacctaacgtacggtaccttaccggttacccgggttcccccggttaggttccggggacgggtaccgggaaccgtaaggggtagacggtaacgtaacgtaaacgacgttaggtacggacctgtaccctacgtacg

SEQ ID NO: 254249 - DNA, 562 bp, Homo sapiens
  misc_feature: GYAE6OF01CPV2H.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgcgggcgagtcaggtattagcagctggttagcctggtatcagcagaaaccagggaaacgcccctaaactcctgactctatgctgcatccagtttaggaaagtcgggtacccagtcaaggttcagcggcaggtgatcgtgggacagtatttcactctacaccatcagcacgcctgcagcctggaagtattttagactaaacttttaattagttagtactaacgaggtacctccggttaccggtttccccccgggtacgtttccgggaccgggaacgggacccgaagggttagggaacgtaagtaccgaaaacgtacgttggtacggacgtcgcgaaccctacg

SEQ ID NO: 254250 - DNA, 625 bp, Homo sapiens
  misc_feature: GYAE6OF01BV57T.21.39.D06.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtagganacagagtcaccatcacttggtcgggcagtcgagggtattagcagctggttagcctggtatcagcaagaaaccagggaaacgacccctaaactcctgactctatgctgctatcctagtttaggaaagtcgggtccagtcaaggttcaggcggacagtggatcgtagggactagtattcactctcaccatcagcagcctgccagtccctagaacgtattttacgacttaactttattaacttcgtaacctaacgtacgggttacccttacccggtaacccgggttttaccccccggtacggttttacccggggaccgggtaaccggggtaacccggtaaacggggtacgggtaaacggtaacgttaacccgtaaaacgggtaacgttacgggtacggtaccgtcggtaaccgtaccgttaaccgg

SEQ ID NO: 254251 - DNA, 585 bp, Homo sapiens
  misc_feature: GYAE6OF01CY0M2.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtccaccatcacgttggtcgggcgagtcgagggtattagcagctggttagcctggtatcagcagaaacagggaaacacccctaaactcctagatctatgctgcatcctaggttaggaaagtcgggtaccagtcgaaggttcaggcggctaggtggatcgtagggactagtatttcactctacaccatcagcagcctgcacgtcctagtaacgttatttagacttaatttatttaagttcgtaacctaacgtacggtaccttaccggtacccgggttttacccccggtagtttccgggaccgggtacgggtaaccgtaagggtaggaacgtacgtaaccgtaaaccggtaacgtcggtacgcgtacgccgtaacctacg

SEQ ID NO: 254252 - DNA, 557 bp, Homo sapiens
  misc_feature: GYAE6OF01E4B38.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttggtcgggcgagtcagggtattagcagctggttagcctggtatcagcaagaaaccagggaaacgcccctaaactcctagatctatgctgcatccagtttaggaaagtcgggtccatcgtaaggttcagcggcagtggatcgtgggacagtatttcactctcaccatcacgcagcctgcagtcctagtaagtattttgactaactttaatttattgtaccaacgtaggtccttaccgtacccgggtttacccccggtagtttcccgggacgggacgggtaaccgagggttaggacggtacgtaccgaaacgtaacgtacggtcggactcgccacgtacg

SEQ ID NO: 254253 - DNA, 602 bp, Homo sapiens
  misc_feature: GYAE6OF01C2SN1.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttggtcgggcgagtcagggtattagcagctggttagcctggtatcagcagaaaccagggaaacgcccctaaactcctgatctatgctgcatcctagtttggaaagtgggtacccatcgaaggttcagcggcagtggatcgtgggacagtatttcactctacaccatcagcagcctgcacgcctagaagttatttcgacttaactttattatttacgtactaacgtaggtaccttccgtacccgggttttccccccggtaaccgttttccggggaccggggtaacggggtaaccccgtaaaggggttacgggaacggtaaacgttaaccgaaaaacgggtaaccgttcgggtacgggtacctacggtaccgtaacccgttaaccg

SEQ ID NO: 254254 - DNA, 590 bp, Homo sapiens
  misc_feature: GYAE6OF01BE6DN.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcagtcagggtattagcagctggttagcctggtatcagcaagaaaccagggaaacgcccctaaactcctgatactatgctgctatcctagttaggaaggtcgggtacccagtcgaaggttcaggcggacaggtaggatcgtagggactaggtactttcactctcaccatcagcagcctgcacgcctagtaacgtatttcgacttaactttaattagttacgtactaaacgtacggtccttaccgtacccggttttcccccggtacgtttacgggaccgggtaacgggtaccgtaacggggttaggaacggtaacgtaaccgaaaacggtaaccttggtacggtaccgtcggtacgtacccgtacg

SEQ ID NO: 254255 - DNA, 561 bp, Homo sapiens
  misc_feature: GYAE6OF01DRV77.21.39.D06.1.454.CMB.1.raw
  modified_base (281)..(281): a, c, t, g, unknown or other
  misc_feature (281)..(281): n is a, c, g, or t
  modified_base (416)..(416): a, c, t, g, unknown or other
  misc_feature (416)..(416): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttggtcgggcagtcagggtattagcagctggttagcctggtatcagcagaaaccagggaaacncccctaaactcctgatctatgctgacatacctaggtttaggaaagtcgggtacccagtacaaggttcaggcggcagtggatcgtagggacagtatttcactctacaccatcagcagcctgcacgcctagtaagtnttttagactaactttattattgtacaacgtacgtctccgtaccggtttcccccggtacgtttcgggaccgggtacgggaccgtaaggggtaggaagtaacgtaccgaaaacggtaccgttaggtaggacctacggccaccgtacg

SEQ ID NO: 254256 - DNA, 666 bp, Homo sapiens
  misc_feature: GYAE6OF01DX24Z.21.39.D06.1.454.CMB.1.raw
tcagtcgtcgctcgcacgaccggtgctcgatttagtgacatctcgcagttctttgggggcaggagtcaggcccagtcaggacacagcatggacatgagggtccccgctcagctcctgggctcctgctgctctggttcccaggctccagatgcgacatccagatgacccagtctccatcctccgtgtctgcgtctgtaggagacagagtcaccatcacgttgtcgggcagtcgagggtattagcagctggtagtcctggtatcagacaagaaaccgagggaacacccctaaactcctagactctatcgctcgctacttccgaaggttttaggaaacggttcgggtacccaagttacgaaacggtttcaacggtcggacgtaaggtcggtacgttcggtacggggaactacggttactttaccgaccttccgtacaacctatacgaacgccgacgtcccgtagaccgtacggtaccgttacgtaaggtttctttttagacctttaactttaacgtttaacttcgttaaccgaacctacggttccgttaccggttacccgggtttaccccggtacgtttacggggaccggtaaacgggtacccgtaagggttacggaacgtaacgtaccgtaaacgtacgtacggtacggacctacgtacgtacgtacg

SEQ ID NO: 254257 - DNA, 651 bp, Homo sapiens
  misc_feature: GYAE6OF01DF22F.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatcgacccagtcctccatccctccgtgtctgcgtctgtaggagacagacgtcacctatctacgttggtcgggcgagtcgagggttattagcagtcgttaggttacgccgtggtatcgagacaaacggaaaccgaagggaaacctaccccttaaactcctagactactatcgctgctactaccgtaggttaggaacggtcgggtaccaagtacgtaaggttcgaaggtcggagtaggtgtacgttcggtaggtatagttactttacgaccttctaccgactagtacgagtacctacgtccgtgaccgacgtccgtaagtacgtttatttacgactttaactttagttacgttacgtaactaacgtccggttaccttacccggttacccggtttaccccggtagttccgggaacggtaacgggtacggtaagggtagaacgtacgtaaaccgtaaacgtacgtcggtacgtacgtcgtaccgtacgttacg

SEQ ID NO: 254258 - DNA, 643 bp, Homo sapiens
  misc_feature: GYAE6OF01DU19G.21.39.D06.1.454.CMB.1.raw
  modified_base (286)..(286): a, c, t, g, unknown or other
  misc_feature (286)..(286): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttggcgggcgagtcgagggtattagcagctggttagcctggtatcagacaagaaaacgagggaaaacnccctaaactcctgaatctatgctgacactccgtaggtttaggaaaggttcgggtaccagtacgaaggttcaaggcggacaggtaggattcggtagggactaggtactttaccacttctacacctatcagcagccctgctacgtcctagtaacgttattttcgaactttaacgtttattacgtttacgtaacctaacgtacggttacccttaccggttaccccggggttttacccccggtacggtttccggggaccggggtaaaccgggtaaccggtaaacggggttagggtaacggtaaacgtaacccggtaaaacggtacggttggtacgggaccttacggaccctaccgttaacg

SEQ ID NO: 254259 - DNA, 728 bp, Homo sapiens
  misc_feature: GYAE6OF01C29DH.21.39.D06.1.454.CMB.1.raw
tcagtcgtcgctcgcacgaccggtgctcgatttagtgacatctcgcagtttctttgggggcaggagtcagacccagtcaggacacagcatggacatgagggtccccgctcagctcctgggctcctgctgctctggttcccaggctccagatgcgacatccagatgacccagtctccatccgtcgtgtctgcgtctgtaggagacagagtcacatcacgttggcgggcagtcgagggtatagctaggtcttggtagccgttaggtactcgacggacgaacggaaaacccgaaggggaaaaccctaccccttaaaacgtcccgtagtactacgttaagcgtctcgactacgttaccgtaaggtttacggaacggttcgggtacccagtacgaagttcgaacggtcggacgtagggtacgtacgttccggtaagggtaactaacggtttactttacccaaccgttcctaccgtaacctagtaccgaacgcgtaccgtcgtcgacgtacgtcctaaggtaacgtttacgttttagaacccgtttaaacgttttattaacgttaccgtaaacgtaacggtaccggttaccgtttacccggtaccccgggttttaccccggtaaggttttacccggggaccgggtaaccgggtaaaccgggtaacgggttaggaaccgtaacgttaaaccgaaaccggttaagtccggtaacgccggtacaccgtaccgttacg

SEQ ID NO: 254260 - DNA, 509 bp, Homo sapiens
  misc_feature: GYAE6OF01DUPJ7.21.39.D06.1.454.CMB.1.raw
  modified_base (201)..(201): a, c, t, g, unknown or other
  misc_feature (201)..(201): n is a, c, g, or t
  modified_base (424)..(424): a, c, t, g, unknown or other
  misc_feature (424)..(424): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggngacagagtcaccatcacttggtcgggcgagtcagggtattagcagctggttagcctggtatcagcagaaaccagggaaacgcccctaaactcctgatctatgctgcatccagtttggaaagtgggtcccatcaaggttcagcggcagtggatcgtagggacagtatttcgactctacaccatcagcagcctgcagcctgagtatttgactaactttattattntacaagtgccttcaccggtttccccgagtttcggacggacggaccgaagggtggagagacaacgaactggtagctcgctcctacg

SEQ ID NO: 254261 - DNA, 557 bp, Homo sapiens
  misc_feature: GYAE6OF01E3M3V.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttggtcgggcgagtcagggtattagcagctggttagcctggtatcagcagaaaccagggaaagcccctaaaactccctgatctatgctgcatccagtttggaaagtgggtcccatcaaggttcagcggcagtggatcgtgggacagtatttcacttctcaccatcagcagccctgcagcctagaagtattttgactaaactttattaattgtactaaacgtaggtccttccgtacccgggttttccccccggtacgtttccgggaccgggaacggggaccgaagggtaggaaggtacgtaccgaaaacgtaacgtggtacggacgtcgaccaccgtacg

SEQ ID NO: 254262 - DNA, 539 bp, Homo sapiens
  misc_feature: GYAE6OF01AP1VW.21.39.D06.1.454.CMB.1.raw
  modified_base (281)..(281): a, c, t, g, unknown or other
  misc_feature (281)..(281): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggttagcctggtatcagcagaaaccagggaaacncccctaaactcctgatctatgctgcatccagtttggaaagtcgggtccagtcaaggttcaggcggcaggtgatcgtgggacaggtatttcactctacaccatcagcacgcctgcagcctagaagtattttgactaatttattattcgtactaacgtacggtcttaccgtacccgggtttccccgacgtttccgggcgggtacgggaaccgtagggtggaacgataccgtaaacgaacttcggtgactcgctacctacg

SEQ ID NO: 254263 - DNA, 625 bp, Homo sapiens
  misc_feature: GYAE6OF01B6I5A.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtccaccatcacttgtcgggcgagtcagggtattagcagctggtagcctggtatcagcaaggaaaccaaggggaaacaccccctaaactcctagactctatgctgactactcctaggtttaggaaaggttcgggtaccaagtcgtaaggttcaggcggacgaggtggactgtacgggactaaggtactttacgacttcctaccaacctagtacccagacgtaacgcctagcgacgtaccgtagaagttatttacgacttaactttaacttagttacgtactaagacggttacctaccggttacccgggtttacccccggtagtttacccgggacgggtaacgggaccgtaaacggggtagaacggttaacgtaaccgtaaaaccgtaacgttaggtaccggtagtcgaccgtactacg

SEQ ID NO: 254264 - DNA, 644 bp, Homo sapiens
  misc_feature: GYAE6OF01BW2IW.21.39.D06.1.454.CMB.1.raw
  modified_base (440)..(440): a, c, t, g, unknown or other
  misc_feature (440)..(440): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttggtcgggcgagtcgaagggtattagcagtcttaggttacgccgtggtatcgagaccaagaaacccgagggaaaccgaccccctaaactcctagatctagtgctgctattaccgtaggtttacggaaacggttcgggtaccctagtacgtaaggttccaaggtccggagaggttgggaacttcggtagggactagttactttaccacttcctaccaacctntacgagcacgcccttagccctacgccgttaagaacgtttatttacgactttaaacgttatttaacgttcgtaaccgtaacgtacggtcccttacccggttaccccgggttttccccgtaacggtttaccgggaccgggtaacgggaccgtaaggttagggagtaacgtacgaaaacggtcgtcggtacggatcgtccacgtacg

SEQ ID NO: 254265 - DNA, 660 bp, Homo sapiens
  misc_feature: GYAE6OF01C8VIC.21.39.D06.1.454.CMB.1.raw
  modified_base (107)..(107): a, c, t, g, unknown or other
  misc_feature (107)..(107): n is a, c, g, or t
  modified_base (192)..(192): a, c, t, g, unknown or other
  misc_feature (192)..(192): n is a, c, g, or t
  modified_base (290)..(290): a, c, t, g, unknown or other
  misc_feature (290)..(290): n is a, c, g, or t
  modified_base (380)..(380): a, c, t, g, unknown or other
  misc_feature (380)..(380): n is a, c, g, or t
tcagtcgtcgctcgcacgaccggtgctcgatttagtgacatctcgcagttctttgggggcaggagtcagacccagtcaggacacagcatggacatgagggtccccgntcagctccgtggggctcctgctgctctggtcccaggctcagatgcacatccagatcgacccagtcctcatcctcgtgtctgcgtntgtaggagacagacgtacacctatcacttggcgggctagtcgaagggtatacgcagcgtggtagccgtggtatcagacgaagaaaaccgagggaaacncccctaaactcctgtatctatcgctgactactacgtaggttaggaagtacgggtaccaatacgaaggttcgaagtcggacaggttacggngttacggtacgggaactacgttacgttacctactactaccaacactcgaacgacacggtacctagaccgtacgacccgtagttaacgtacgttttagaaccttaaacgttttattaacgttacgtaacgtaacgtacggttaccttaccggttaccccgggtttacccccggtaggtttacccggggacggggtaaacggtaaccggtaaacgggttagggaaacggtacgtaaaccgaaacggtaacggtcgttacggacgtacggacctaacgtaacg

SEQ ID NO: 254266 - DNA, 651 bp, Homo sapiens
  misc_feature: GYAE6OF01CN2DW.21.39.D06.1.454.CMB.1.raw
  modified_base (108)..(108): a, c, t, g, unknown or other
  misc_feature (108)..(108): n is a, c, g, or t
tcagtcgtcgctcgcacgaccggtgctcgatttagtgacatctcgcagttctttgggggcaggagtcagacccagtcaggacacagcatggacatgacgggtccccgntcagctccgtggggctcctgctgctctggttcccaggctccagatgcgacatccagatcgacccagtcctccatcctcgtgtctgcgtctggtaggagacagacgtcaccatcacgttggcggcagtcgagggttatagcagtcgtggttacgcctggtaactcgagacaaaggaaacccgaaggggaaacctccccttaaactccgtagactctaatgcttgctagttccgtaaggtttagggaaacgttcgggtaccctaagtacgaaacggttcgaaggtcggacgtaggtgagttcggagggactagtacttcgaacttcgaccacatacgagacacgtcacgactacgtaccgtaagtaatttacgtttacgaacttaagttttataagttcgtaacaaccgtacgtaccgttaccggttacccggtttcccgtaacggttccggacgggtaaccggaacggtaaacgggtgggtaaacctacggtaaccgtaaaacggacgttacggtacgggtacctacgaccgttaccgttaacg

SEQ ID NO: 254267 - DNA, 574 bp, Homo sapiens
  misc_feature: GYAE6OF01C260P.21.39.D06.1.454.CMB.1.raw
  modified_base (227)..(227): a, c, t, g, unknown or other
  misc_feature (227)..(227): n is a, c, g, or t
  modified_base (391)..(391): a, c, t, g, unknown or other
  misc_feature (391)..(391): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggngagtcagggtattagcagctggttagcctggtatcagcaagaaaccgaagggaaacgacccctaactcctagatctatgctgcatcctagttggaaacgtgggtacccagtacaaggttcaggcggacgaggtgatcgtaggactagtattcactctacaccancagcacgcctgcacgtccgtagtaagttactttacgacgttaactttagttaatttcgtaactaacgtacggtaccttaccggtacccggtttcccccggtacgtttccgggacgggtacgggaaccgtaagggtacgggaagaacgtaccgaaacgtactggtacgactcgcgtaccgtacg

SEQ ID NO: 254268 - DNA, 725 bp, Homo sapiens
  misc_feature: GYAE6OF01AFRH4.21.39.D06.1.454.CMB.1.raw
  modified_base (207)..(207): a, c, t, g, unknown or other
  misc_feature (207)..(207): n is a, c, g, or t
  modified_base (357)..(357): a, c, t, g, unknown or other
  misc_feature (357)..(357): n is a, c, g, or t
tcagtcgtcgctcgcacgaccggtgctcgatttagtgacatctcgcagttctttgggggcaggagtcagacccagtcaggacacagcatggacatgagggtccccgctcagctcctgggctcctgctgctctggttcccaggctccagatgcgacatccagatcgacccagtcctccactccgtccgtgtctgccgtctggtagganacaggacgtccaacctatccgtacgttcggtcggggaccgtagtccgaagggttacttacggcaggtccgttggttacgtccgttaggtactcgagacgaacgaaaccgaagggtaacctacccctaaacgtcctagactctagtcgctnctactcgtaggttacggacggtcggacctagtacgtacggttcgacggtcgtacgtaggtcgtacgtcggtaggtactagttaccttccaccgttcctaccgacgtacgtcgacggtacctaccgtcccgtacgaccgtacggtacccgttaagttaacgtttagtttacgaacctttaacgtttgtttaacggtcgaaaccgttaaccgtaccggttcccgtttaaccccgggttaccccggtttccccgggtaacggttaccggggtaacccgggtaacggtaacccgggtaagggtacggtaacggttaacccgtaaacggtaaaccggtacgttcggacgtaccgcgttaccccgtaacgtccg

SEQ ID NO: 254269 - DNA, 632 bp, Homo sapiens
  misc_feature: GYAE6OF01ANVL4.21.39.D06.1.454.CMB.1.raw
  modified_base (373)..(373): a, c, t, g, unknown or other
  misc_feature (373)..(373): n is a, c, g, or t
  modified_base (448)..(448): a, c, t, g, unknown or other
  misc_feature (448)..(448): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcagtcgagggtattagcagctggttagcctggtatcagcgaacgaaaccgaggggaaacgcccctaaactcctgatctatgctgcacttccgtaaggtttacggaaacggttcggggtacccaagtacgtaacggttcaaggtcggngtaggtggatcgtagggactagtactttcacttctacacctatcacgcacgtccctagcctagcctagtaagttnttttacgacttaactttatttacgttgtaacctaacgtcggtaccttacccggtacccgggtttcccccggtaacggttccggggtacccgggtaacggggtaacccggtaaggggttacgggacgttaacgtaaccgtaaaacggtacgttacggtacggaccgtacggccgtaaccgttacg

SEQ ID NO: 254270 - DNA, 643 bp, Homo sapiens
  misc_feature: GYAE6OF01DEJTK.21.39.D06.1.454.CMB.1.raw
  modified_base (294)..(294): a, c, t, g, unknown or other
  misc_feature (294)..(294): n is a, c, g, or t
  modified_base (320)..(320): a, c, t, g, unknown or other
  misc_feature (320)..(320): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagacgtcaccatctacgttggtcgggcgagtcgagggtattagcagctggttacgccttggtatcagacaacgaaaccgaagggaaaccnccctaaactccgtagatctatgcctnctactccgtaggttaggaaacgtcgggtaccagtacaaggttcaaggcggactaggtgatcgagggtacagtacttacactctacacatcagcacgcctgactacgtcctagtaacgtttagtttacgaactttaactttaatttacgttacgttaaccaacgtgggtacccttacccggtttaccccggggtttacccccggttaggtttacccggggaccggggtaacggggtaacgtaaacggggttgggtaaacgtaacgtaaacccgtaaaacggttaccggttcggtacgggtccttaacggcctaaccggttaccg

SEQ ID NO: 254271 - DNA, 581 bp, Homo sapiens
  misc_feature: GYAE6OF01D1L2B.21.39.D06.1.454.CMB.1.raw
  modified_base (378)..(378): a, c, t, g, unknown or other
  misc_feature (378)..(378): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttggtcgggcgagtcgagggtattagcagctggttagcctggtatcagcaagaaccagggaaacgccctaaactcctagatctatgctgctatccagttaggaagtcggtaccagtcgaagttcagcggacaggtgactcgtagggacagtattcactcncacatcagcgagcctgcgacgtccgtagtaacgtagttttcgactaactttagttaattcgtactaacgtacggtaccgttaccgtacccggtttaccccggtaccgtttccggggaccggtaacgggtaaccggtaaggggtaggaacggtacgtaaaccgtaaacggaaccgttggacggtactacggacctaaccgtacg

SEQ ID NO: 254272 - DNA, 585 bp, Homo sapiens
  misc_feature: GYAE6OF01BEAOK.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggtagcctggtatcagcaagaaaccagggaaacgcccctaaactcctagactctatgctgctatcctagttaggaaaggttcggggtaccagtacgaacggttcacggcggtacgagtggagtcgtagggactagtactttcacttctacaccatacagccagcctgccacggcctagaacgttgttttacacttaactttagttacttacgtactaacgtcggtactcccggtaccccggtttccccggtacgtttaccggggcgggtaacgggtaccgtaagggtcggacgtacgtaaccgtaaacgtacgtggtacggactcgtccgaccgtacg

SEQ ID NO: 254273 - DNA, 747 bp, Homo sapiens
  misc_feature: GYAE6OF01AXCCW.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctgggctcctgctgctctggttcccaggctccagatgcgacatccagatgacccagtctccatcctccgtgtctgcgtctggtaggagacagacgtcaccatcacgttggtcgggcgagtcgagggtattagcgagtcgttggttacgccgtggtatcgagacgaagaaaccgaagggaaaccgtacccctaaactcctagactctagtcgactgacctagttaccgtaaggttttaacgggaaacgggttccggggttacccctaagttaccgtaaacggttcgaacgggtcgggacgtagggtacggacgttacggtacgggaactaagttactttaccgaaccttccgtacctaaccgtactacgaacggaccacggtcctcgaccgtacgtaccgtaagtaacgtttacgttttacgaacgtttaactttagttaacttacgtaaccgtaacgtaccggttacccgttacccggttaccccgggttttcccccggtaaggtttacccggggaaccggggttaaaccggggtaaccggtaaacggggtacggtaacggtaacccgttaaaacggtaaaccggttacggttcgggttaacggtcccgtacggtaacccgttaaccgtaccg

SEQ ID NO: 254274 - DNA, 561 bp, Homo sapiens
  misc_feature: GYAE6OF01BEC7B.21.39.D06.1.454.CMB.1.raw
  modified_base (283)..(283): a, c, t, g, unknown or other
  misc_feature (283)..(283): n is a, c, g, or t
  modified_base (422)..(422): a, c, t, g, unknown or other
  misc_feature (422)..(422): n is a, c, g, or t
tcagtcgtcgctcgcacgaccggtgctcgatttagtgacatctcgcagttctttgggggcaggagtcaggcccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggttagcctggtatcagcaagaaaccgagggaaacncccctaaactcctgactctatgctgcatccgtagtttaggaaagtcgggtaccagtacgaaggttcaggcggcagtgatcgtagggactagtactttcacttctacacctatcgagcacgcctgcacgcctagaagttntttgacttaacttattattgtactaacgtgtacctccgtacccggtttccccggtagtttccgggcgggtaacgggaccgtaagggtggaacgtactacgaaacggtacgtcggtacggtacctacggcctaacgtacg

SEQ ID NO: 254275 - DNA, 744 bp, Homo sapiens
  misc_feature: GYAE6OF01D07FH.21.39.D06.1.454.CMB.1.raw
  modified_base (322)..(322): a, c, t, g, unknown or other
  misc_feature (322)..(322): n is a, c, g, or t
tcagtcgtcgctcgcacgaccggtgctcgatttagtgacatctcgcagttctttaggggggcaggagtcagacccagtcaggacacagcatggacatgagggtctccgctcagctcctgggctcctgctgctctggttcccaggctccagatgcgacatccagatgacccagtctccatcctccgtgtcgtgcgtctgtaggagacagagtcaccatcacgttggtcgggcgagtcgagggtattagcagctggttacgccgtggtatcgagcgaacgaaaccgaggaacgtacccctaacgtcctagactcgtactcgctncctacgtccgtaaggtttaggaacggttcgggtaccctaagtacgtaacggtttcgaacggtcggtacgtaggtcggtacgtaccggtacgggtaacgtaacgttacgtttacccaccgtttaccgtacctaacccgtacgttaccgaacgtaccgtacggtacccgtacggtaaccttacggtaccgttacggttaaacgtttacgttttaaccgaacgtttaaaacgttttacgtttaacgttttacggttaaccgtaaacggtacgggttaccctacccgggtttaacccggggtttaccccccgttaagggtttcccgggacggggtaaaccgggtaaccgtaaggggttacggtaacggttaactaaccggtaaaaccggtacggttaggttaccgggtcgttacgacccgttaccg

SEQ ID NO: 254276 - DNA, 578 bp, Homo sapiens
  misc_feature: GYAE6OF01BY85Y.21.39.D06.1.454.CMB.1.raw
  modified_base (280)..(280): a, c, t, g, unknown or other
  misc_feature (280)..(280): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtcctccatcctccgtgtctgcgtctgtaggagacagagtcaccatcacgttgtcgggcagtcagggtatagcagctggtagcctggtatcagcagaaaccagggaaacncccctaaactcctgatctatgctgcatccagtttaggaaagttgggtccctatcgaaggttcaggcggcagtgatcgtgggacagtatttcactctacacctatcgagcagcctgcagcctagaagtattttcgactaactttagttattacgtactaaacgtggttaccttaccggtaccccggttttacccccggacgtttacccgggacgggtaaccgggtaaccgtaaggggttagacggtaacgtaaccgaaaacggtaacgttcggtacggaccttacgccgaaccgttacg

SEQ ID NO: 254277 - DNA, 560 bp, Homo sapiens
  misc_feature: GYAE6OF01EZFSZ.21.39.D06.1.454.CMB.1.raw
  modified_base (285)..(285): a, c, t, g, unknown or other
  misc_feature (285)..(285): n is a, c, g, or t
  modified_base (356)..(356): a, c, t, g, unknown or other
  misc_feature (356)..(356): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttggtcgggcgagtcgagggtattagcagctggttagccgtggtatcagcaagaaaccagggaaacncccctaaactcctgatctatgctgcatccgtaggtttaggaaggtcgggtccatcgtaaggttcaggcggnaggtggatcgtagggactagtatttcacttctaccacatcagtcagcctgcagcctagaatattttcactaattattagttcgtacaacgtagtccttacgtacccggtttaccccggtagtttccgggacggtaacgggtacgtaacgggtggaacgtaacgtaaccgaaacgtaacgtcggttacggcctacgcgacctacg

SEQ ID NO: 254278 - DNA, 811 bp, Homo sapiens
  misc_feature: GYAE6OF01B93M9.21.39.D06.1.454.CMB.1.raw
  modified_base (107)..(107): a, c, t, g, unknown or other
  misc_feature (107)..(107): n is a, c, g, or t
  modified_base (282)..(282): a, c, t, g, unknown or other
  misc_feature (282)..(282): n is a, c, g, or t
tcagtcgtcgctcgcacgaccggtgctcgatttagtgacatctcgcagttctttgggggcaggagtcagacccagtcaggacacagcatggacatgagggtccccgntcagctcctggggctcctgctgctctggttcccaggctccagatgcgacatccagatgacccagtctccatcctccgtgtctgcgtctgtaggagacagagtcaccatcacgttgcgggcagtcagggtattagcagctggttagcctggtatcagcaaggaaaccagggaaacncccctaaatcctgatctatcgctgactatcctaggtttacggaaaggttcgggtaccccaagttaccgaaaggttcaacggtcgggtacaagggttaggagttacgttaggggaactacggttaattttccaactttcctaccaaccgtacttccgaacggccgaacgcccgttacggccctaaaggtccccgtttaaggaaacgttttaacgttttttcggaaaccctttaaaaacttttttagttttaacggtttacgttaacccgaaaacccggttacgggtaacccctttttaccccgggtaacccccgggggttttttacccccccggggttaaacgggttttttacccccggggggaaccggggtaaaacggggggtttaaacccccggtaaaacggggggtttaggggtaaaacccggtaaaccggttttaaaaccccgaaaaaaaccgggggtaacccgttttacgggggtaacggggttaaccccgtttaccgggaaaccccgttaaccccgttaaaccg

SEQ ID NO: 254279 - DNA, 790 bp, Homo sapiens
  misc_feature: GYAE6OF01BN2X4.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctccgtggggctcctgctgctctggtcccaggctccagatgcgacatccagatcgacccagtcctccatccctcgtgtctgcgtcgtgtaggagacagagtccaaccatcctacgttggcgggacgtaggtcgagggttattaggctagtcgtaggttacgccgttaggtactcgagacgaaacggaaaacccgagggaaaaccacccccttaaaacgtccgtagtaactctagtcgactcgactacgtaccgtaggtttacgggaacggtccggtacctaagtacgtaaggttcgacgggtcgacgtagggtacggtacgtacggtacgggaacttacgttactttaccgacccgttcctaccgaacctacgtacgacgtaccgtaccgtcccgttacggaccgtacggttaccgttaaggtaacgttttacgttttacgaaccgttttaactttaacgttttaccgtttaacgtaacccgtaaccggttaccggttccctttaaccccgggttacccccggggttttacccccggttaacgggtttcccggggaaaccgggtaaccggggtaaaccgggtaacgggttaacgggaacggtaaaccggttaacccggaaaaacggttcccggttagggtacccggttaaccgtacccggtaacccgtaccgttaccgg

SEQ ID NO: 254280 - DNA, 627 bp, Homo sapiens
  misc_feature: GYAE6OF01EAN53.21.39.D06.1.454.CMB.1.raw
  modified_base (464)..(464): a, c, t, g, unknown or other
  misc_feature (464)..(464): n is a, c, g, or t
  modified_base (621)..(621): a, c, t, g, unknown or other
  misc_feature (621)..(621): n is a, c, g, or t
tcagtcgtcgctcgcacgaccggtgctcgatttagtgacatctcgcagttctttgggggcaggagtcaggcccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttggtcgggcgagtcgaggtattagcagctggttagcctggtactcagcaagaaaccgaaggaaacgccctaaactcctgactctatcgctgacatcctaggtttaggaaacgtcgggtacctagtacgaaggttcgaggtcggcgaggtggatcgtacgggtacaggttactttacaccgttcctaccaacctagttacgacggacctaacggtccctagccgtaacgtcccgttaggaacgttnttttaacgaccttaactttactttagttacgtacgaacgtacggtccttacccggtacccgggtttcccccggtaacgtttcggggaccgggtaagggtacccgtaagggttcggaacgtacgaacgtaaacggtacgtggtacgactacggtaccncgtacg

SEQ ID NO: 254281 - DNA, 587 bp, Homo sapiens
  misc_feature: GYAE6OF01AFO82.21.39.D06.1.454.CMB.1.raw
  modified_base (287)..(287): a, c, t, g, unknown or other
  misc_feature (287)..(287): n is a, c, g, or t
  modified_base (393)..(393): a, c, t, g, unknown or other
  misc_feature (393)..(393): n is a, c, g, or t
  modified_base (399)..(399): a, c, t, g, unknown or other
  misc_feature (399)..(399): n is a, c, g, or t
tcagtcgtcgctcgcacgaccggtgctcgatttagtgacatctcgcagttctttgggggcaggagtcagacccagtcaggacacagcatggacatgaggggtccccgctcagctcctggggctcctgctgctctggttcccaggctccagatgcgacatccagatgacccagtctccatcctccgtgtctgcgtctgtaggagacagagtcaccatcacttggtcgggcgagtcgagggtattagcagctggttagcctggtatcagcaagaaaccgaggggaaacncccctaaactcctagatctatgctgctatcctaggttaggaaacggtcgggtcccatcgaaggttcaggcggacaggtggtatcgtagggacagtactttcactcncacctntcagcagcctgcagcctagaagttactttagaccttaatttattacttgtactaacgtcgtcgttaccgtacccggtttccccggtacgtttccgggaccgggtaacggggtacccgtaaaggggtcggaacggtacgtaaccgtaaaacggtacgtacggttacggaccgttcgaccgaccgttacg

SEQ ID NO: 254282 - DNA, 744 bp, Homo sapiens
  misc_feature: GYAE6OF01BGBS2.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtccaccatcgtacttggtcgggcgtagtcgagggttattagcgagtcgtggttacgccgtaggtactacgagacaaacggaaaacccgaaggggaaaccgtacccccttaaaactccgtagtacttacgtatgctgactacgttaccgtaggttaggaacggtcggtaccctagtacgtaacggttcgaacggcggacgtaggtacggacgtcggtacgggtaactaacggttaccttttaccacctttccctaaccgtaaccgtacgttaccgaacggtccgtaacgtcccgtacggaccgtacggtacccgtagttaacgtttacgttttacgaaacctttaagttttaatttacggttacgtaacgaaaccggttacggttacccgttaccccgggtttaccccgggtttaccccggttaacgggttcccgggaacggggtaaccgggtaaccggtaacgggtggaacgtaaccgtaaccgtaaaacggttaccgttcggtaacgggtaccgtaccgtcccgtaaaccgttcg

SEQ ID NO: 254283 - DNA, 932 bp, Homo sapiens
  misc_feature: GYAE6OF01EX2P9.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatcgacccagtcctccactccgtccgtgtctgcgtctggtaaggagacagtacgtaccaaccgtaacttccgtacgtttcgggtaccgggggaccgtaacggttaccgtaaggggtttaattacggctaaggtccgttgggttaacgtcccgttaggttaactcgaacggacaaaccgggaaaacccgaaaggggggaaaacccttacccccttaaaaacgttcccgtagtaaccttaccgttaacgtcgtccgttacggacttaaccggttaccggttaaagggttttaacggggaaaaccggggtttccgggggttaaccccctaaggttaacccggttaaagggggttccaaggggacccgggtaacggtagggttacggtacgtttaccgggtacgggtaacgttaacggtttaccttttaccgaacccttttaccctaaccctaaccttaacggtacccgaaacggtacccgtaccgtcccgtaacggtaccgttaaccgtacccggttaagtaacgttttaacgtttaaccgtaactttaaaaccgtttagttttaacgttacggtaccgtaaaaccgggtacgttacccgttacccgggtttacccccggttaacccccgggttggtttaccccggggaacgggttaaccggggaaaccggttaacggggtaaaggtaacggttaaccgttaaaacccggtaaaccggtaacggtttacggggtaccggttaacgtcccgtaaacccggttacgttaacccgg

SEQ ID NO: 254284 - DNA, 663 bp, Homo sapiens
  misc_feature: GYAE6OF01C78GA.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgaccagtctccatcctccgtgtctgcgtctgtaggagacagagtcaccatccacttggtcggcgagtcagggtattagcagctggttagcctggtatcagcaagaaccgagggaaacgacccctaactctgatctatgctgacagtaccgtaggtttaggaaaggtcgggtaccctagtacgaaggttcgaggcggctaggtggtatcggtagggactagtacttcactctacaccactcagacacgtcctgacctacggctaggtaatttacgtttacgaacgtttaaacttttagtttaacgtttacgtaaccgtaacgtaccgggttacccgtttacccggttaccccgggttttacccccgggttacgttttacccgggggacgggttaaccggggtaaacgggttaaggggacggtaacggttaaaccgttaaacccgtaaaaccgggttaacttacggggttacggttaccgtacggtaccctccgtttaacg

SEQ ID NO: 254285 - DNA, 872 bp, Homo sapiens
  misc_feature: GYAE6OF01D99RK.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctccgtgggctcctgctgctctgtccagctccagatgcgacatccagatcgaccctagtctccactcctccgtgtctgcgtctggtaggagacagacgtccaacctatccgtacgtttggccgggacgtaaggtacgtaaggggttattaacggctaaggtcgttacggttaacgccgttagggtaactcgaacggacaaaacgggtaaaaacccggaacggggtaaaaacccgtacccccctttaaaaacgttccccgtaagtaaccgttaccttaacgttcggacttcggtacctaacgttacccggttaaggttttaaccggggaaaacgggtttcccggggaacccttaagtacggttaaacgggtcgaaccgggtcggaacgtaagggttacgggtacgttacggtaacgggtaactaacggttactttaccgtaccttacctaacccgtaacccgtaaacttaccgaacggtaccgtacgtacccgtacggtaccgtacggtacccgttaaagggttaacttacgttttacgaacctttaaatttacgtttaacttacggtaaacgttaaccgtaccggttacccgtttaaccccggttaccccggggttttacccccggtaacgggttttaccgggaaaccggggttaaacggggtaacccggttaaaggggtacggtaaacggtaacccgttaaaccgggaaaaccgttaacggttcgggtacggttacccgaacgtaccgtaaccgttacgg

SEQ ID NO: 254286 - DNA, 622 bp, Homo sapiens
  misc_feature: GYAE6OF01CYRL2.21.39.D06.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatcgacccagtctccatcctccgtgtctgcgtctgtagganacagagtcaccatcacttgtcggcgagtcagggtattagcagctggttacgcctggtatcagacaacgaaaccgagggaaacgacccctaaactcctgactctatgctgcatccgtaggttacggaaggtcgggtaccatacgaaggttcaggcggcgagtggatcggtaggactagtactttcgactctacacatcagcacgcctgcacgtacctaggtaagttactttcgacttaacttaatttattacgtacacgtacggtccttacccggttacccgggtttacccccggtcggtttaccggggaccgggtaagggtaacccggtaagggggttacggtaaaacggttacgtaaacccgggtaaaaccggtaacccgttcggggacggtccctaacggacccgtaccgttaaacg

SEQ ID NO: 254287 - DNA, 742 bp, Homo sapiens
  misc_feature: GYAE6OF01DI48F.21.39.D06.1.454.CMB.1.raw
  modified_base (109)..(109): a, c, t, g, unknown or other
  misc_feature (109)..(109): n is a, c, g, or t
  modified_base (153)..(153): a, c, t, g, unknown or other
  misc_feature (153)..(153): n is a, c, g, or t
  modified_base (169)..(169): a, c, t, g, unknown or other
  misc_feature (169)..(169): n is a, c, g, or t
  modified_base (524)..(524): a, c, t, g, unknown or other
  misc_feature (524)..(524): n is a, c, g, or t
  modified_base (543)..(543): a, c, t, g, unknown or other
  misc_feature (543)..(543): n is a, c, g, or t
tcagtcgtcgctcgcacgaccggtgctcgatttagtgacatctcgcagtttctttgggggcaggagtcagacccagtcaggacacagcatggacatggacgggtccccntcagctccgtgggctcctgctgctctcggtccagcctacagacngacacataccgagtancgacctactcctacctacttcccttccgtgtccgtcggtaccgttcgttaaggacggaacgacgagaccgtacaacctactccgtacggttggtaccgggacgtaacggtaggtaagggttactaggccgtaggtagtttacgggtactcgttaggtactacgacgaacgaaacggaaacgacgggaaacctaccctaagtctactactacgatccgactacgtctacgttacggttaagggttaacggtaaaccggtccggtaacctaagtacgtaacggtacggacgacgggacgttggtacggaacggttcggaacggttacaacgtttacttccggacttacgaccgtaancgtacgtacgacctacggnaccgactacgacttaagttagttaactttacgaaactttacttagtttaactctaacgtaccgtagtcccggttaacccgttaccccgggtaccgttacgggttaccgggaacgggttacggaacggttacgggtaacgtaacctaacggtaaccgtaacgttacgggtaccgtcgacgttaaccgcgttaacgttacg

SEQ ID NO: 254288 - DNA, 546 bp, Homo sapiens
  misc_feature: GYAE6OF01BKSK4.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggttagcctggtatcagcagaaaccagggaaacgcccctaaactcctgatctatgctgcatcctagtttggaaagtcgggtccatcaaggttcagcggcagtgatcgtgggacagtatttcactctcaccatcagcagcctgcagcctgaagtatttgactaacttattattgtactaacgtaggtccttccgtaccggtttcccccggtacgtttccgggaccggtacgggaccgtaagggtggaacggtacgtaccgaaaacggtacgtggtacgggtacctacggcctaccgtacg

SEQ ID NO: 254289 - DNA, 845 bp, Homo sapiens
  misc_feature: GYAE6OF01AU62E.21.39.D06.1.454.CMB.1.raw
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
tcagtcgtcgctcgcacgaccggtgctcgatttagtgacatctcgcagttctttgggggcaggagtcaggcccagtcaggacacagcatggacatgagggtccccgctcagctcctgggctcctgctgctctggttcccaggctccagatgcgacatccagatcgacccagtctccatcctccgtgtctgcgtctgtagganacagacgtcacctatccacgtttcggccgggngtagttcgaagggttactttaagcgtagtcgttaggttaacgtccgttagggttactcgaaggtaccaaaggaaaacccgaacggggtaaaaccgacccccttaaaacgttccccgtagtaacttcctaacgttcgtccgtaggtacctaaccgttaccgtttaaggtttacgggtaaaagggttcccggggttacccaacgtttaccgtaacgggttcgaaacggtcgggacctaagggtcggaacgttcggtacgggaactaacggttacgtttacctaccgttactaccgtacactccgaacgtacgtaaccgtccgtagacccgtacgtaccgtacgtaaacggtttcgtttaacgtaacccgtttaactttaacgttttacgttaccggttaacctaaaccggtacgggtttaccctaacccggttacccgggttttttaaccccccgggcggttttacccggggaaccgggttaacccgggggtaaacccgtaacgggggtaccggtaaaacggttacccggttaaaacccgtaaaaacccggggtttcgggtaaaccggttacggggtaaccctttaacggaacccttacccgggtttaaaccc

SEQ ID NO: 254290 - DNA, 797 bp, Homo sapiens
  misc_feature: GYAE6OF01CB0MS.21.39.D06.1.454.CMB.1.raw
  modified_base (186)..(186): a, c, t, g, unknown or other
  misc_feature (186)..(186): n is a, c, g, or t
  modified_base (315)..(315): a, c, t, g, unknown or other
  misc_feature (315)..(315): n is a, c, g, or t
  modified_base (786)..(786): a, c, t, g, unknown or other
  misc_feature (786)..(786): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtntctgcgtctgtaggagacagacgtacaccatctacttggtcgggcgagtcgagggttattagcctagctggttagcctggtatcgagcaagaaacctagggaaacacccctaaactcctagattcgtangtctgcattccgaggttttaggaacggtcgggtacccagtacgtaacgttcgaacggccgggtacgacggttcgggaagttccggttaggggacctaacgggttacttttacccgacttacccttaccgaaaccttcgttaaccgaacggttcccaaagggtccccgttacgggaccgtaaaccggtaccccgtttaggttaaaaccggtttacttttttaacgggaaccccgtttaaaatttttaacgttttaaccggtttaacttttaaacccggaaaccggtcggttttaacccccggttaaccgggttttcccccgggttttaacccccgggtttacgggttttaccgggggaacccgggttaaaccggggtaaccccggtaaaggggttaccgggaaacgtaaacccgtaaacggaaaacccgttaaacgggtttcgggacggttaccctaacgggtaaccccgtnttaaacccggg

SEQ ID NO: 254291 - DNA, 751 bp, Homo sapiens
  misc_feature: GYAE6OF01D2W8D.21.39.D06.1.454.CMB.1.raw
  modified_base (743)..(743): a, c, t, g, unknown or other
  misc_feature (743)..(743): n is a, c, g, or t
tcagtcgtcgctcgcacgaccggtgctcgatttagtgacatctcgcagtttctttggggggcaggagtcaggcccagtcaggacacagcatggacatggacgggtccccgctcagctccgtggggctcctgctgctcgtcggttccgaggctccagatgcgacactaccagactacgaccacgtcctacctacttcccttccgttcgttcgtcgtcgttcgttaggtaggacgacgtttttttttagacgtaccacctactaccgtacgttcggtcgggcggtagtacggtaagggttaagttacgacgaggtcgttaggttacgtccgtggtactacgacgacgaacggaaaccgaacgggaaaccgtaccccgttaaacccgtacgtacgtacttacgtacgtcgtacgactacgtacgttacggttagggtaaggtacggtcgtacgtacgtacggtacgtacggtacggacggtagtaggtacgtacgtacggtacgtacgttacgttacactcctacaacctatacgacgacgtaccggtctacgacgtacgtaacgtagttaacgttactttactacgttaactttaagtttcgtaacgcgttaacgccggtttaccgttccccggtttaacccggggtttacccctcggggttcggaacgggggtaaccggtaaacggtaacggtcgggaacctaacgtaacggaacggttacgtcggtacgggctacgtacccgngtcttccg

SEQ ID NO: 254292 - DNA, 842 bp, Homo sapiens
  misc_feature: GYAE6OF01DU04O.21.39.D06.1.454.CMB.1.raw
  modified_base (189)..(189): a, c, t, g, unknown or other
  misc_feature (189)..(189): n is a, c, g, or t
tcagtcgtcgctcgcacgaccggtgctcgatttagtgacatctcgcagttctttgggggcaggagtcaggcccagtcaggacacagcatggacatgagggtccccgctcagctcctgggctcctgctgctctggttcccaggctccagatgcgacatccagatcgacccagtctccatcctccgtgtcngcgtctggtaggagacagacgtccaccatacctacgttcggtccgggacgagttcggaagggttattacggacgtacggtcgttagggttaacggtccgttagggttaacttcgaacggtaccgtaaacggaaaacccgtaagggggtaaaacccgtacccccgttaaaacgttacccgtagtaacttactacgtcgtactacgtacctacgttaccggttaaggtttaacgggtaaacggtcggggttacccctaagttaccgtaaacggttcgaacggtaccggacgtaacggtggtaacgttcggtaacgggaacgtaacgttacgtttacgaaccttcctaaccaacgtacttacgaacgtaccgaccgtccgtacgacctacggtacccgttaaggtaacgttacgttttacggtaaccttaaacgttttacgttttaacgttacggttaacccgtaaaccggttaccggttccccgtttaaacccccgggttccccgggttttaaccccggttacccgggtttaccggggacccgggtaaaccggggtaaaccgtaacgggggttaacgaacggtaacgtaaacccgtaaacggtaacccggttcgggaaccggttaccgtaaccggtacccgttaccggttaaccg

SEQ ID NO: 254293 - DNA, 720 bp, Homo sapiens
  misc_feature: GYAE6OF01DZU9B.21.39.D06.1.454.CMB.1.raw
  modified_base (233)..(233): a, c, t, g, unknown or other
  misc_feature (233)..(233): n is a, c, g, or t
  modified_base (701)..(701): a, c, t, g, unknown or other
  misc_feature (701)..(701): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctggtaggacgacagagtccacctatctacttggtcgggngagtacgaggggttattagctagcgttgggttacgccgttggtaatcaacggcaaacggaaaccgaaggggtaaaccgacccccttaaactccgtagtacttaccgtagtcgtcgtacgactattacccggtaaggtttacgggaaacgggtttcgggaccctaagtacgaaggttcgaacggcggtacgtaggtggacgttacgacggggaactacggttactttaccgacccgttaccgtaccaccctagtaccgacgaccgtacgccctacgcctaaccggtccttaaggaaccgttttagtttacgaacttttaacgtttattaacgtttcgaaacgtaaccgttacggtcccgttaaccgttccccgggttaccccggttaacgggttcgggaccgggtaacgggtaccgtaagggttagggaacgtaccggtaaaccgtaacggtaaggttccggcggtacncccggtaacctcgttaccg

SEQ ID NO: 254294 - DNA, 780 bp, Homo sapiens
  misc_feature: GYAE6OF01DO6F9.21.39.D06.1.454.CMB.1.raw
  modified_base (396)..(396): a, c, t, g, unknown or other
  misc_feature (396)..(396): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatcgacccagtcctccactccctccgtgtctgtcgtctggtaggagacagacgtccacctatcctacgttggcgggcgagtcgtaggttatgcagtcgtggttacgcgtaggtatacgagacgaacggaaaccgaaggaaacctaccccttaaacgtccgtagaactctatcgtactgacctacgtacgtaggttacggaacggtcggtacctagtacgtacggtcacggtcgngtaggtacggagtcggtagggtactaagttctttaccgacttcccgtaacactacgtacgacgtaccgacggtcccgtacggaccgtaacgggtaccgttaaaggtaacgttttacgttttaacgtaaccttttaaagttttacgtttaacggttaacccggtaaccgtaacccgggtaccggtttaccccctttaacccgggggtttacccccgggttttacccccgggttaacggggtttacccggggaacccgggggttaaaccgggtaaccgggttaaaggggtaaccggtaacggttaaaccggttaaaaccgtaaacccggttaaccgggttcgggttaacccgggtaccttacccgggaacccgttacgttaaccgg

SEQ ID NO: 254295 - DNA, 652 bp, Homo sapiens
  misc_feature: GYAE6OF01CMK25.21.39.D06.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagtgacatctcgcagttctttgggggcaggagtcaggcccagtcaggacacagcatggacatgagggtccccgctcagctcctgggctcctgctgctctggtcccaggctccagatgcgacatccagatgacccagtctccatcctcgtgtctgcgtctgtagganacagactcaccatcactttggcgggcgagtcgagggtattagcagctggttacgtcctggtatcagcaagaaaccgagggaaacgtaccctaaactcctagactactatgctacgcactactaggttaggaaggtcgggtaccagtacgtaaggttcaggtcggcgtaaggtcggtagtcggtacgggtaactaggttactttaccaccgttcctacctacctacttaccgaacgccgtacggccttacgaccgacgtacccgttaaggtaacgtttaacgttttacgtaacctttaaacttttagtttaacgttacgttaaccgtaacgtacggttaccgttacccggttaccccggggtttaccccgtacggtttaccgggacgggtaacggtacccggtaggtacgagtacgtacgtaaacgtacgtggtactcgacgtccgacgttacg

SEQ ID NO: 254296 - DNA, 706 bp, Homo sapiens
  misc_feature: GYAE6OF01BLPIN.21.39.D06.1.454.CMB.1.raw
tcagtcgtcgctcgcacgaccggtgctcgatttagtgacatctcgcagttctttgggggcaggagtcaggcccagtcaggacacagcatggacatgacgggtccccgctcagctccgtggggctcctgctgctctggtcccaggctccagatgacgacatccagatcgaccctagtcctaccactcctcgtgtctgcgtcgtggtagagacgagacgtaccactatcgtacgttggacgggacgtagtacgtagggttatacgacagtacgttggttagccgttaggactacgacgacgaacggaaaccgaacgggaaacctaccctaaacgtccgtagtactacgtagacgtctacgactacgttacgtagggttaaggtaaccggttccggtaactagtaacggtaacggtcgacggtcggacgtagtacgggtacgttccggaaggtaccgtaggtttacttacgtacctactaccgactacgtacgacgacgtacgtccgagtaccgtacgttaccgttaaggtactttacgtaacgttaccttaagttattaccgttactaccggacgttaccgttccggttaacccgttacccgggttacccgggtacggtaccggggaacgtacgggtaaaccgtagggtacggaactaacggtaaacgaaccgttacggtacggtacggtactactacgtcgttacgg

SEQ ID NO: 254297 - DNA, 686 bp, Homo sapiens
  misc_feature: GYAE6OF01COPVX.21.39.D06.1.454.CMB.1.raw
tcagtcgtcgctcgcacgaccggtgctcgatttagtgacatctcgcagttctttgggggcaggagtcagacccagtcaggacacagcatggacatgagggtcccccgctcagctcctggggctcctgctgctctggttcccaggctccagatgcgacatccagatcgacccagtctccactccctccgtgtctgcgtctggtagagacagagtaccaccatcgtacgttggtccgggcgtagtcgaagggttattacggctaaggtcgttaggttaacgccgttaggttactaccgaacgacgaacggaaaaccgtacggggaaaacccgtaccccttaaaactccgtacgaacttacgtaatcggctacgtacacgttaccgtaaggtttacggaaacggttcgggtacccaagttacgtaacggttcgaacggtcggacgtaggtcggtaatcggtagggactagttacttacacctctacctactactaccagaccacgccgtacacgaccgtcgtaggtaatttacgtttacgaactttaactttatacgttacgactaacgtcggttaccctacccgggttacccgggtttaccccgtagggttacccgggcggaacgggtaccgaaagggtcgacgtaacgtacgaaaccggtgacggttgaccctacggacctacgtcg

SEQ ID NO: 254298 - DNA, 761 bp, Homo sapiens
  misc_feature: GYAE6OF01DXFI7.21.39.D06.1.454.CMB.1.raw
  modified_base (430)..(430): a, c, t, g, unknown or other
  misc_feature (430)..(430): n is a, c, g, or t
tcagtcgtcgctcgcacgaccggtgctcgatttagtgacatctcgcagttctttgggggcaggagtcagacccagtcaggacacagcatggacatggacgggtccccgctcagctcctggggctctgctgctctgtccaggctccagatcgcgacatccagatcgaccagtcctcactccctcgtgtctgcgtcgtagaggagacagacgtccacattccgtacggttggcgggacgtacgtcggtaagggttattacggctacggtccgttagggtttaccgccgttagggttactccgaaggtaaccgaaacggtaaaacccgggaaacgggaaacccgtaccccttaaaccgttccgtagtaaccttcgtagtcgactacgctaacgtcgtaagggttacggaacggtcgtaccagtacgtaggtcnggacgtgtagtcgtagtcggtaagtacgtattacgttcctacgtacctaacgactacgtacgacgtacgtacaccgttacgtacgtaccgtaacgttaagttaacgtttacgttaacttaaccgtttaaagttttaacgtttacgttaacgaaccggttacggttaccggttacccgtttaccccggtttaccccgggggtttaacccgttacgggttccgggggaaccggtaccggggttaaacggtaacgggttaacgggacgtaaaccggtaaaccgtaaacgggtacggtacgggttacgtccgttaaccggacttaacccgttacg

SEQ ID NO: 254299 - DNA, 714 bp, Homo sapiens
  misc_feature: GYAE6OF01A3Q2B.21.39.D06.1.454.CMB.1.raw
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
tcagtcgtcgctcgcacgaccggtgctcgatttagtgacatctcgcagttctttgggggcaggagtcagacccagtcaggacacagcatggacataagggtccccgctcagctcctggggctcctgctgctctggttcccaggctccagatgcgacatccagatgacccagtcctccatcctccgtgtctgcgtctgtaganacagntcacatcacgttggtcgggcgagtcgaagggttattagcagtcgttggttacgccgttagggtactcgacgaccgaaacgaaaaccgaacgggtaaaccgaccccttaaacctccgtacgtacttactagtcgctacgctacgttccgtaggtttaagggaacggttcggggtaaccagttaacgtaggttacgacggccgggtactacgggtaggtacgtcggtacggtaagtacgtttacgtttacctaccgttacctacccttaaccacgtacgacctacgacgtcctcgacacgtaccgtaagttacgtttactttacgtaactttaactttagttacgttacgtacgaacggtaccggttccgttacccggtttacccccgggttcccggttaccggttacgggaccggggtaaccggtaacgggtaacgggttacggtacgtaacggtaaacgtaacccgtaggttcgtacgacccggtaacgccttacgtcggtttaccg

SEQ ID NO: 254300 - DNA, 833 bp, Homo sapiens
  misc_feature: GYAE6OF01D2HCW.21.39.D06.1.454.CMB.1.raw
  modified_base (157)..(157): a, c, t, g, unknown or other
  misc_feature (157)..(157): n is a, c, g, or t
  modified_base (176)..(176): a, c, t, g, unknown or other
  misc_feature (176)..(176): n is a, c, g, or t
tcagtcgtcgctcgcacgaccggtgctcgatttagtgacatctcgcagttctttggggggcaggagtcaggcccagtcaggacacagcatggacatgagggtccccgctcagctcctgggctcctgctgctctcggtccaggctccagatgcgactntccagatcgacccagtccncctactccctcgttcgtctgtcgtctaggtaggagacagacgtccactactcgtacgttggtaccgggcgtagtcggtaaggtattagctagtcgttagggtacgtccgttggtactcgacgacgaaacggaaaccggaacgggaaaacccgtaccccttaaaacgtccgtaagtacttacgttacgtacgtcttacgtcgtaaccgttaccggttaagggttttaacgggaaaccgggtttcccgggttacctaaaggtttaacccggtaaacggtttccgaacgggttaccgggtaagtaggggttacggaacggttcggtagggaaacttaacggttttacctttaccggactttacccgtaaccgaaccgttcgttaaccggaacgtccgtaaccgtcccggtacggaccgtacggttacccgttaagtttaacggtttaacgttttacgtaacctttaaacgttttgtttaactggtaaacccacggttacggttcccgttaaccccggttaccccgggttttacccggtaacgggtttaccgggaccgggttaaaccggtaacggggtacggtaaggttaaccgtacgtaaaccgttaaaacccgggttgttaccgggtacggttaccaccggtaaccgtccgtttaacgg

SEQ ID NO: 254301 - DNA, 881 bp, Homo sapiens
  misc_feature: GYAE6OF01BU0ZK.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctgttcccaggctccagatgcgacatccagatcgacccagtctccatcctccgtgtctgcgtctgtaggagactagagtcaccatcacgttcggtcgggcgtagtcgaagggtattacgcgagtcgttaggttacgtccgtaggtactacgagtaccgaacggaaaaccgaacggggtaaaaccgtacccccgttaaaacgtcccgttagtacgttaccttacgtcgtcgttagacctaacgttaccgttaagggttttaacgggtaaacggggttccgggttaacccgtaacgtacggttaacgggtttaccgaacgggcggtaacggtacggtaggggtacttaccgggtaggggtactaaggttaccgtttacctacccgttaccgtacctaaccgtaacgtacccgacgtccgtaacgttccccgtaacggtccgtaacggtacccgtttaaggtaaaccgtttacgttttacgaaccgttttaaagttttaacctttacggtttaacgtaaccgtaaacccgttaccgggttacccgtttaaccccgggtttaccccggggttttaaccccccgtaacggggttttaccccggggaaccggggttaaacccgggggtaaacccgggttaaacggggttaaggaacccgggtttaaaacgtaaacccgggtaaaacccgttaaacgggggtttaccggtacgggtaaaacccgtttcccggaaaccgttaaaccccgtttacccgg

SEQ ID NO: 254302 - DNA, 752 bp, Homo sapiens
  misc_feature: GYAE6OF01ANMDG.21.39.D06.1.454.CMB.1.raw
tcagtcgtcgctcgcacgaccggtgctcgatttagtgacatctcgcagttctttgggggcaggagtcaggcccagtcaggacacagcatggacatgagggtccccgctcagctcctggggctcctgctgctctggttcccaggctccagatgcgacatccagatcgacccagtctccatcctcgtgtctgcgtctagtaggagacagagtcacatcacttggtcgggcgagtacgaggtattacgctagtcgttggttacgccgtaggttactcgacgacgaaacgaaaacccggaaggggtaaaccaccccttaaacgtcccgtagtacttacgtagtcggtctacgactacgttaccggttaaggttttaacgggaaacggtccgggttaacccaacgttaccgaaacgggttcaacgggtccggacgtaaggtcggtacgtacggtacggaacttacgtactttcgaccttctacctactacgtcaacggctacgtccgtagaccgtacgtacctaggttaacgttacgtttacgaaccgtttaattttaacttacgttacgtaccgtaaacgtaccggttacccgttaccccggtttaccccgggttacccccgggtttcggttacccggggtaacccgggggtaacgggtaaaccggttaacggggtaccgggtaaaagttacccggttaaaccggaaaacggttccgttacgggtaccggtactaacggtcccttaaaccgtacgg

SEQ ID NO: 254303 - DNA, 725 bp, Homo sapiens
  misc_feature: GYAE6OF01A3C1O.21.39.D06.1.454.CMB.1.raw
tcagtcgtcgctcgcacgaccggtgctcgatttagtgacatctcgcagttctttgggggcaggagtcaggcccagtcaggacacagcatggacatgagggtccccgctcagctcctggggctcctgctgctctggtcccaggctccagatgcgacatccagatgacccagtctccatcctcgtgtctgcgtctgtaggagacagagtcaccatcacgttggtcgggcgagtcgagggtattaggcagtcgtggttacgccttggtatcgaagccaaacggaaaccgaggggaaaccaccccgttaaactccgtaggacttacgtagtcgcgtcgactacgttaccgtaaggtttacgggaaacggttcggggtaccctagtacggtaacggttcgacggcggcgtaggtggtacgttcgagggtactaggtacttcgaccttctacctaccgtatccgaagccgtacgtccgtcgaccgtacgtaccgttaggtaacgtttatttacgaaccttaaacgttttgtttaacgttacgtacctaaccggttacgttcccgttacccggttaccccgggtttaccccggtaacggtttacccggggaccggggtaaaccgggttaacccgggtaaaggggttaccggtaaacggtaaaccgttaaaccggtaaaccggttaacgggttcggtacgggttaccctacggtacccgttaaccgttaccgg

SEQ ID NO: 254304 - DNA, 752 bp, Homo sapiens
  misc_feature: GYAE6OF01C2DSL.21.39.D06.1.454.CMB.1.raw
  modified_base (108)..(108): a, c, t, g, unknown or other
  misc_feature (108)..(108): n is a, c, g, or t
tcagtcgtcgctcgcacgaccggtgctcgatttagtgacatctcgcagttctttgggggcaggagtcaggcccagtcaggacacagcatggacatgagggtcccccgntcagctccgtgggctcctgctgctctggttcccaggctccagatgcacatccagatgacccagtctccatccctccgtgtctgcgtgtgtaggagacagacgtcaccatcctagttcggcgggacgagtacgaagggttattagcgagtcgttaggttacgccgttaggtactcaagtacgaaaggaaaacccgaaagggtaaaaccgaacccccttaaaacgtccgtacgtaacttcctaagtacgtctcgaactacgttaccgtaagggtttaggaaacggttccggtaccaagtacgtaaggttccgaggccggagtacggtactaacgttcggtagggtaatacgtaatttcccaactacctaccaacgtactcgaacgtaccggtaacctccgacgactagtacccgtaaggttaaacgtttcttacgtaaaccttaagtttaattacgttacgtaacaaggtacccgttaccgttacccgtttacccccggggttacccgttaggttaccggggaccggttaaaccgggtaacccgggttaaagggtacgtaaacccggttaacggtaaaacccgtaaaacggggttaccccgttggggaaccgttaaccccgtcgggtaaccctaaaacgggttttc

SEQ ID NO: 254305 - DNA, 766 bp, Homo sapiens
  misc_feature: GYAE6OF01C5GG0.21.39.D06.1.454.CMB.1.raw
  modified_base (196)..(196): a, c, t, g, unknown or other
  misc_feature (196)..(196): n is a, c, g, or t
  modified_base (214)..(214): a, c, t, g, unknown or other
  misc_feature (214)..(214): n is a, c, g, or t
  modified_base (757)..(757): a, c, t, g, unknown or other
  misc_feature (757)..(757): n is a, c, g, or t
tcagtcgtcgctcgcacgaccggtgctcgatttagtgacatctcgcagttctttgggggcaggagtcagacccagtcaggacacagcatggacatggacgggtccccgctcagctccgtgggctcctgctgctcgtcggtccaggctcagatcgcgacatccaagactcgaccctagtcctacctactccctcgtntctgcgtcgtaggagganacgagtacgtacacctatcgtacgtttcgggaccgggacgtaaggtacggtaaggttactacggactacggtcgttagggttaacgccggttagtactacgaacgaacgaaaccggaaaaccggtaacgggaaaccctacccgtaacttccgtaagtacgttactagcgtacgtacacgttacggtacggttaagggtaacggttacgggtaccggtaacctaagttaccggtaaggtcgaacggtccgggataggttacggacgttacgggaagttacgtacgttaccttaccgaccttacgtaaccgacgtactacgacgacgtacgaccgtacgacgtacgtaccgttaagttaacgtttacgtttaactaactttaacgtttaattacgttacgtaaaccgtaccgtaacgttacccggttacccggttaccccgggttaacccggtacggttaccgggaaacccggtaggtaaccgggtacggtaacggtacgtaaccgttaacgtaaacggtcgtacggacgggtctaccggtaacncggttaccg

SEQ ID NO: 254306 - DNA, 752 bp, Homo sapiens
  misc_feature: GYAE6OF01EAU0Z.21.39.D06.1.454.CMB.1.raw
  modified_base (558)..(558): a, c, t, g, unknown or other
  misc_feature (558)..(558): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatcgacccagtcctccgatccctccgtgtcctgcgtctggtaggagacagagtaccaccatctacgttggccgggactagtcgagggttattacgcaggtcttgggttacgccgtagggtactcgaacgtacgaaacggaaacccggaagggaaaaccctaccccgttaaaacctccgtagacttacgtatcgtactgacctacgttaccgtaggtttacggaaacggtcggtacctaagtcgtaaggtcacggcggtcaggtcgactcggtaggactagttactttaccaccgttcctaccaccgtaacgtacgacgacgtaccgtacccgttacgaccgttacgtacccgttaagtaaaccggtttcgttttaaccggaactttaaacgttttnttaacggttaccgtaacctaacggttaaccggttccccgttaacccggtttacccccggggttttcccccgggtaaggtttacccgggggaccgggttaaacggggtaaccccgtaaggggtaacggtaacctaaaccggtaaacccgtaaacggtaccggtaggtaccggtcctacccggtactacccgtacg

SEQ ID NO: 254307 - DNA, 886 bp, Homo sapiens
  misc_feature: GYAE6OF01E52P6.21.39.D06.1.454.CMB.1.raw
tcagtcgtcgctcgcacgaccggtgctcgatttagtgacatctcgcagttctttgggggcaggagtcagacccagtcaggacacagcatggacatgacgggtccccgctcagcctccgtgggctcctgctgctctgtccaggctcagctgcgacatccagactcgacccagtctccatccctcgtgtctggtcgttcgtaggtaggacaacgagtacgtaccacctataccgtacgttgggtccgggacgtaggtacgtaagggttactagctagtccgtttaggtacgtccgttaggtactacgacgtaccgaaacgaaaacccggaacgggaaaaccctacccccttaaaagtccctagtaactttctaagtcggtcctaggactaacggttccgttaagggtttaacggaaacggggttccgggtaccctaagtaaccggtaaggttaccgacgggtaccgggagtaacggttcggtaacgttcgggaagggtaactaacgtttaccgtttaccgtacccgttaccaccgtaacccgtacgttaccgaacggtaccgtaacgtaccggttacgaccgtaaccggtaccgttaacggttaacggtttaactttttacgaaaccgtttaacgttttaacgtttaacgtttaccgtaaccgttaaaccggtacccgttacccggtttacccgggtttacccccggggttttacccccggttaaccgggtttacccgggggtaaacccggggtaaaccggggttaaccgggtaaacggggttaacgggtaaaccgttaaacccgggtaaacccgggttaaaaccggtaccgggtttacgggtaccggggttaccctttacccgggaaacccgttaaccgttacccgg

SEQ ID NO: 254308 - DNA, 757 bp, Homo sapiens
  misc_feature: GYAE6OF01BQPV8.21.39.D06.1.454.CMB.1.raw
  modified_base (501)..(501): a, c, t, g, unknown or other
  misc_feature (501)..(501): n is a, c, g, or t
tcagtcgtcgctcgcacgaccggtgctcgatttagtgacatctcgcagttctttgggggcaggagtcagacccagtcaggacacagcatggacatgagggtccccgctcagctccgtggggctcctgctgctctggttcccaggctcagatgcacatccagatgacccagtctccatcctcgtgtctcgtcgtcgtgtaggacgacagtagtacaacctatcacttggtcgggactagtcgaaggtatagctagtctaggttagcctaggtatacgaagtacaacggaaaaccgaagggaaaaccgtacccctaaaacgtcctaggaacttacctagtagactacgactaacgtaccgtaaggtttaacggtaaaacggttccggggtacctaacgtaacgtaaacggttcgaacggtccggtaacgtaaggttaccggagttacgtaagggtaacctaaggttactttaacccgtaacttacccgtaccaaaccgttaanaccggacttaccgaacggtcccgtaagaccgtaacggtacccttaaaggaagtttaacgttttacaacgtttaaacgtttaattaacgtttaacgaacgttaaacgtcgggttaaccttacccgggttaccccggtttaacccccggtacgtttaccggggaaaccggtaaacggtaaccggaagggttaagaaccggtaaagtaaccgaaaacggtaacgttcggtaacggtaccgtaacgcccgaaacgttacg

SEQ ID NO: 254309 - DNA, 774 bp, Homo sapiens
  misc_feature: GYAE6OF01DTGRS.21.39.D06.1.454.CMB.1.raw
tcagtcgtcgctcgcacgaccggtgctcgatttagtgacatctcgcagttctttgggggcaggagtcagacccagtcaggacacagcatggacatgacgggtccccgctcagcctcgtcgggctccgtgctgtctcgtcgttcccgaggtcctacagatcgcgacactccaagtactaccgacctacgtcctacctactcccgtccgttgtcgtcggtcgttacgtaggtaggacgacgagtaccgtaccacctacgtacgttaccggttcgggtccggagtacggttacggtaggttacttaggacgtacgtcggttacgggttacgtccggttagttacacgagaccgaaacgggtaaccggaaaaccggtaacctaacccgttaacgtccgtataaccgtactagtcgtactcgacgtactacggttaggttaaggtaaccgggtcgtacctagtacggtacgtcgacggccgtagtacgggtgtacggttaggaacgtacgtaacgtttacttccgtacctacctaactacgtaccgtagtacggacctacgtccgtacgccgttaacctacggtttaagttaacgtttacttacgttaacctttaatttacgttaacgtacgtaaccgttactcgggttaccccgttttaacccgggtccccgttttaacccgggtacgtaccggggacggtaacgggtaaccgtaggggtaacaaccggttaccgtaacgtaacggtcgttggtacgaccgtaccctcgtcttaccgg

SEQ ID NO: 254310 - DNA, 732 bp, Homo sapiens
  misc_feature: GYAE6OF01A1XJ0.21.39.D06.1.454.CMB.1.raw
  modified_base (208)..(208): a, c, t, g, unknown or other
  misc_feature (208)..(208): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatcgacccagtcctccatcctccgtgtctcgcgtctaggaggaganacgagtaccacctatactacgttggccgggacgagtacgtagggtattacgcgagtcgttggttacgccgttaggtactcgagacaacgaaaccggaacgggaaccctaccctaaacgtcctgtactctatgctagtactacgtacgtaaggttacggaacggtcgggtacctcgtacgtaacggtcgacggtcggacgtaggtgacgttccggtaggacttacggttactttaccgtaccgtacctaaccgaccctagtaccgacgtaccgagttcccgagtccgtaaccgtacgttaacggttaacgtttacgtttaacgtaacctttaaacttttagtttaccgtacgttaaccgtaacggtaccggttacccggttaacccgtttacccccggggtttacccggttaccgggtttacccgggacggggtaaaccggtaaccgggtaacggggtaacggaacgttacccgtaaaccggtaacgtacggttcggtacggtacgccgtacccgtaacgttcgg

SEQ ID NO: 254311 - DNA, 825 bp, Homo sapiens
  misc_feature: GYAE6OF01B6LR1.21.39.D06.1.454.CMB.1.raw
tcagtcgtcgctcgcacgaccggtgctcgatttagtgacatctcgcagttctttgggggcaggagtcagacccagtcaggacacagcatggacatgacgggtccccgctcagcctccgtgggctcctgctgctctcggtcccaggctccagatgcgacatccagactcgacccagtcctccacgttcccgtccgtgtctcggtccgtcgtaggtaaggacgtacgaggtacgtccaacctacttccgtacgtttcgggcgggacgtaaggttaccggtaaggggttaattacggaccgtaggtcgttacgggttaacgtcgttacggtactcgacggaacgaaacggaaaacccggtaaggggtaaacccctaccccgttaaactccggtaagtacgttactacgttacgctcggtaacctacggttacgttaggttacgggaaacgggttccggtacctaagtacggtaacggttccgagggtaccgacgtaggtacgtagtacgtagggtaactggttaactaccgtacctacgtaccgaacttacgtacgacgaccgtacgtcctacgtaccgtaccggtaaccgttaaggttaacgtttacgtttaacggttaaaccgtttaacgttttctttaacgggttacccttaaccgttaaaccggttccggtttaccccgttaacccggttaccccgggtttccccggtaacggggtttacccggggaaccggttaccggggtaaacgtcggggtaagtaacgtaaaccggtaaccgttaaacccggaggttccggtacgtaccgtccgtaccgtaaccgttacg

SEQ ID NO: 254312 - DNA, 758 bp, Homo sapiens
  misc_feature: GYAE6OF01DZSOL.21.39.D06.1.454.CMB.1.raw
tcagtcgtcgctcgcacgaccggtgctcgatttagtgacatctcgcagttctttgggggcaggagtcagacccacgtcaggacacagcatggacatgagggtcccgctcagctcctgggctctgctgctctggtcccaggctcagatgcgacatccagatcgaccagtctccatcctcgtgtctgcgtctgtacgagacagcgtcacctatcacgttggcggcagtcgaggtatagcagtctggttacgcctggtatccagacaacgtaaaccgagggtaaacctaccctaaaacgtccgtaggtaacttacgttacgtcgacgttagacctacgttacccgtaagggttttacgggaaaacgggtttccgggtaaccctaacggttaccgtaaaggtttccggaaacgggtaccgggacgttaacggggtacggtaacgttcggtaacggggtaaaccgtacggtttaaccttttaccaaccgttcccgttaacccaaccgtaagtttacccgaacgtaccgtaaccgggtcccgttaacgggacccgttaaccgggtaccttacggttaaacggtttcttttaacgaacggttttaacctttaagtttacgttacgtaaccgtaaccggtacggttacccgttaccggttaccccgggttttacccggaccggtttccgggaacgggtaccggtaaccgtagggtacgtacacgtaaaccgaaccgtcgtaggtacgtacctacggacctcgtacg

SEQ ID NO: 254313 - DNA, 730 bp, Homo sapiens
  misc_feature: GYAE6OF01DUUOY.21.39.D06.1.454.CMB.1.raw
tcagtcgtcgctcgcacgaccggtgctcgatttagtgacatctcgcagttctttggggggcaggagtcaggcccagtcaggacacagcatggacatggacgggtccccgctcagctccgtggggctcctgctgctctcggttccaggctccagagtcgcgacactccagactacgacccagtcctcctactccctccgtcgtcgtgtcgtcgtggtagacgacagtacgtcacctatacctacgttaggcgggacgagtacggtaggttatagcgtagtcgtaggttacgtcgtagtactacgagacgaaacgaaccggaagggtaaaccctacccttaacgtccgtagtactacgtagtcgtacgtacgactacgttacgttaagggtttaacgggtaaaccgggttccgggaaccttaacggttaacggttaacggtacgacgggccgtaggaacggtcggtacgtcgggtacgaacttacggttacttccgtacctaccgtaccacgtacttacgataccgtactccgtacgacctacggactaagttacggttacttaacgttaactagttttactagttacgtaccgtactccggttaccttacccggttacccgggttaacccggtacggttaccgggacgggtaaccggacggtacgggtaggtaaacttccggaaaaccggttaggaccgttgggttaccgaccggtctaacgtcgttaccg

SEQ ID NO: 254314 - DNA, 888 bp, Homo sapiens
  misc_feature: GYAE6OF01DB0UT.21.39.D06.1.454.CMB.1.raw
  modified_base (107)..(107): a, c, t, g, unknown or other
  misc_feature (107)..(107): n is a, c, g, or t
tcagtcgtcgctcgcacgaccggtgctcgatttagtgacatctcgcagttctttgggggcaggagtcagacccagtcaggacacagcatggacatgagggtccccgntcagctccgtgggctcctgctgctcgtggttcccaggctccagatgacgacactccgagtatccgacctacgtcctacctactccgttcgtcgttcgtacggtccgttacgtaggtaacggaacgtacgaacgtacgtacccaacctacgttaccgttacggttcggggtaccgggtacgtacggtacgggttaaagggtttactacggacgtacggttcggttaacgggttccgttacggttaggttaccaacgaccggaaacggaaaaccggtaaaaccggaccgggtaaacccctaaccccgtttaaaccgtccgtacgtacctttacgtaccgttctaccgtacgttaccgtaccgtttaacgggttaacgggttaccggggtaccgtacccggttaaccgtaacggttaccgtacggtaacgtccgggtaaggttaccgggtaggttaccggacgggtttaaacccggtaggaaacccttttaccgtaacctacccggttaactacccctaacgtaccgtacgtaccgtaaaccgggtcctacgggtaccctaccggaccgttaaccggtaacgttaacgtttaacgttacttttaaacgttactttaaacgtttacgttaaccgttaaacgtccggtaaaccggtttcccggtaacccggtttaccccgggtaccggttttaccccgggagggttacccgggacgtaaacggtacgggtacgtaacgtacgtaacgtaaccgtaggtacgtcgacgtacgacctacgtcctacgg

SEQ ID NO: 254315 - DNA, 768 bp, Homo sapiens
  misc_feature: GYAE6OF01ETWAS.21.39.D06.1.454.CMB.1.raw
  modified_base (152)..(152): a, c, t, g, unknown or other
  misc_feature (152)..(152): n is a, c, g, or t
  modified_base (284)..(284): a, c, t, g, unknown or other
  misc_feature (284)..(284): n is a, c, g, or t
tcagtcgtcgctcgcacgaccggtgctcgatttagtgacatctcgcagttcttgggggcaggagtcagacccagtcaggacacagcatggacatgaggtcccgctcagctcctgggctcctgctgctctggtcccaggctccagatgcgacnctccgagatcgaccctaggttcctccgacttccgtaccgtgtctagccgtactggtaacggacgactaggacgtaccacctatcctacgttgggcgggtacaggtcgaggttattacgcagtctgggttacnccgttggtactcgacgacgaaacggaaccgtaggggaaacctaccccgttaaaactcgtacggtactacgttacgtcggtctgaaccgttacgttaccgttaagggtttaccgggtaaacggggttccggtaccctacggtaacggtaacggttcgaacgggccggttacgtacggtcggtaaccgtttacggacgggttaaacttaccgttaacgtttacgtaacccgtttaccgtaacctaacccgtaacgtaccggtaaccgtaccgtacgttcccggtcgtacggtaccggttaaccgttaagtaacgtttacgtttacgtaaccgtttaatttactttaaggttaccgtacgtaaaccggtccgttacggttaccccgggttaccggttacccccggttagttcccgggacggtaaccgggtacggtacgtaggacgtacgttaccgaacgtcgtacgtcggtactcgtacgcgttacg

SEQ ID NO: 254316 - DNA, 885 bp, Homo sapiens
  misc_feature: GYAE6OF01BKLML.21.39.D06.1.454.CMB.1.raw
  modified_base (189)..(189): a, c, t, g, unknown or other
  misc_feature (189)..(189): n is a, c, g, or t
tcagtcgtcgctcgcacgaccggtgctcgatttagtgacatctcgcagttctttgggggcaggagtcagacccagtcaggacacagcatggacatgagggtccccgctcagctccgtgggctcctgctgctctggttcccaggctccagatgcgacatccagactcgacccagtcctcactcctccgtntctgcgtctaggtagagacagtacgtcaccatcctacgttcgggtaccggacgtaggttcgaagggttattaacgcgacgtcgttaggtacgccgtaggtactcgagacaagaaaccggaggaaaccgtccctaaacgtccgtagtactctagtcgcgtacgtcctactaccggttaggttacggaacgggttccggtaccctaagtaccgtaacggttaccgacgggtacggacgtagggttacggtacgtacggggtacggtaaccgttacggttaacccgttttacgacccgtttacccggtaaccgtaaccccttaccggttacggaaccgtacccgtaaccggttacccggtaccgtacggtaccgttaaccgggtttaacggtaacggttttaacgttttaccggaaacccttttaagttttaccggtttaacttaccgggtaaacccgttaaccggttaccggttcccccggtttaacccccggggtttacccccgggtttaaccccgggtttaaccggggttttaccgggggaacccgggttaaaacccgggggttaccttaaaacggggggtacccggttaaaacgggttaaacccggtaaaaccccggttaaaaccgggtttaccgggtaacggtacccccgggttaaagggtttaccccaaacccggttttcccgttaacccggg

SEQ ID NO: 254317 - DNA, 890 bp, Homo sapiens
  misc_feature: GYAE6OF01BRB7Y.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctccgtggggctcctgctgctcgtcggtccaggctcagatgcgactactccgagtactcgaccacgtcctcctactcctcggtgtccgtcgcgttcgtggtacggagaacgacgaagtaccaacctactccgtacgtttcgggacgggcggtaggtacggaagggttaatacggactggtacgttggttaccgcgttacggttatcgaacgaccgaacggaaaaccggtaaccggggaaaccctaaccccgttaaaaccgtccgtacgtaactaccgtagtcgtactagtacccgttacgtaccgtttaagggttaacgggtaaccgggttaccgggtacctaaacggtttaccggtaaacggttacggacggggtacggtacggtaaggttacggtacgttacggggtaaccgggtaacgttagttaacccgtcgttaacccttcgtaaccctaccgtaactacgtaccggtaccgaccggttacccgtagaccggttacgaccgttaaaggttacgtttaaacgtttacgtaactttaactttaacggtttacttaggtaaccctaacgggttcccgtaacccggttttacccgggttacccccgggtttacccgggttaaccggggttttacccggggaaacccggggttaacgggggtaaacccgggtacggggtttaagaaacccgggttaaaccgtaaaccgggttaaaacccggttcgggttaccgggttacccgggtaaagtacccggttaaaccccggttccgtttaacg

SEQ ID NO: 254318 - DNA, 780 bp, Homo sapiens
  misc_feature: GYAE6OF01A46D5.21.39.D06.1.454.CMB.1.raw
  modified_base (108)..(108): a, c, t, g, unknown or other
  misc_feature (108)..(108): n is a, c, g, or t
  modified_base (117)..(117): a, c, t, g, unknown or other
  misc_feature (117)..(117): n is a, c, g, or t
  modified_base (210)..(210): a, c, t, g, unknown or other
  misc_feature (210)..(210): n is a, c, g, or t
tcagtcgtcgctcgcacgaccggtgctcgatttagtgacatctcgcagttctttggggggcaggagtcagacccagtcaggacacagcatggacatgagggtccccgntcagctccnggggctcctgctgctctcggttcccaggcctccagatgcgacactaccagatcgaccagtctccactcctcgtgtctgtctcgtaggtagganacgagacgtccaccatcctacgtttcggcgggacgaggtaccggtagggttacttacgcgtaggtcgttagggtaacgtcccgtaggtacacgaacgaccgtaaaccggaaaacggaacggggtaaacccaccccttaaaacttccgaggtactacgttagtcggctcgtaactacgttaccgttaaggggtttaacggaaccggggtaccggtacctaaggtacgttaaccggtgaccgggacggtcgtaaggtcggaacgttcggacggtaatacggtttaacttaccgtaccgttaccctaccgtaaccgtactacccggaacggttaccgtaaccggttaccggactaccggtaacgtaccgttaacgtacgtttacgtttacgtaacccttttaagtttaactttaacggtaccgttaacgtaaccggtcggttacccgttttaaccccggtacccggggtttccccgtacgggttaccggggaccggtaaggggaacccgtaggggtacgaaacgtaccgaacggtaacgtaccggtcggtacggaccgtcgtacgtacgttcg

SEQ ID NO: 254319 - DNA, 842 bp, Homo sapiens
  misc_feature: GYAE6OF01EI9FG.21.39.D06.1.454.CMB.1.raw
tcagtcgtcgctcgcacgaccggtgctcgatttagtgacatctcgcagtttcttttggggggcaggagtcagacccagtcaggacacagcatggacatgacgggtccccgctcagcctccgtggggctcctgctgctcgtggttccaggctccagatgcgcatccagatacgaccctagtcctccacttcccttccgtgtcgtcggtcgttcgtggtaggacgacgagacgtaccaaccattccgtacgtttggcgggacgtacgtacgtaagggttattacgcgtagtcgttaggttacgtccgttaggtactacgagtaccgaaccggaaaccggaacgggaaccctaccccttaaacgtccgtagtaactcgtaatcggtactacgacttaaccttaccggttagggttaacgggaacggttccgggtacctagttaacggtacggttaccgaggaccgggtacgtaggtacggtacgtacgggtaggtactacggttactttaccgaccgtttaccgtaacctaaccgttacgtacgaacggcctacggcccgttacggacgtacgtaccgtttaaggttaaattttaactttttaacggtttaaactttttaaggtttcttaacccggtaacgttaaccggtacccgggtttcccgtttaaccccgggttttaccccccggggtttaccccggtttaaggggtttacccggggaacccggggttaaacggggaaacccggttaaagggggttcggtaaaccgtaaacccggttaaacgggaaacccgttaacggtttcggtaaccggtccttaacggtaccgccctttaggttcccg

SEQ ID NO: 254320 - DNA, 838 bp, Homo sapiens
  misc_feature: GYAE6OF01DUSA8.21.39.D06.1.454.CMB.1.raw
  modified_base (195)..(195): a, c, t, g, unknown or other
  misc_feature (195)..(195): n is a, c, g, or t
tcagtcgtcgctcgcacgaccggtgctcgatttagtgacatctcgcagttctttgggggcaggagtcagacccagtcaggacacagcatggacatgagggtccccgctcagcctcctgggctcctgctgctctcggttcccaggctccagatgcgacactccagtactcgaccctagtcctccactccctccgtntctgcgtctagtaggagacagtacgtaccaaccatacctacgttgggtccgggacgtacgtacggtaagggttactacggacgtacggtcgttagggttaccgtccgttaggtactacgaagaccgaaacggtaaaaccggaacgggtaaaaccctaaccccgttaaactccgtagtaacttcgtacgtcgtctacgtacctacgttaccggttaagggtttacggtaaacgggttccgggttaaccaacgttaacgggttaacggttcggaacgggtaccggtacggtaagggtcgggtaacgtcggtacggtaacgttacgttacgttcccaaccgttccgtaaccaacgttacgtaccggacgtaacctacggtcctacgggactaccggtacttaaggttaacgttttcgttaccgtaaccttttaaaattttcccgttaagtttaaccgaacccgtaacgggtcccggtttacccggttaccccggtttaccccggggttacccgggtttaacccggttacggggggaaccggttaacgggaaacccggttagggggtaacggtaacggtaaacccgtaaaaaggttacccggttaacggtacggttacggacctaacccgggtcccaaaccgtttcg

SEQ ID NO: 254321 - DNA, 885 bp, Homo sapiens
  misc_feature: GYAE6OF01AX56F.21.39.D06.1.454.CMB.1.raw
  modified_base (109)..(109): a, c, t, g, unknown or other
  misc_feature (109)..(109): n is a, c, g, or t
tcagtcgtcgctcgcacgaccggtgctcgatttagtgacatctcgcagttctttgggggcaggagtcagacccagtcaggacacagcatggacatggacgggtccccgntacagccttccgtggggcctcctggcctgctcgtcggtcccaggctccagactgcgacatccagatcgaccagtcctcctagtccgtccgtgtacgtgtacgtcgtgacggtagacgtaggtataccactactaccgtacgtttcggccggggtacggtacgttcggtaagggttaacttacgggacctaggtaccggttttaggggtttaaccgtcccggttacgggtaacgttaccgaacggtaccccggtaaaaacgggaaaaaccccggaaacggggggtaaaacccccttaaaccccccgtttaaaacggtttccccggttaacggaaccttacggtttaacgtccgtacgttaccgtaccgtaaccgtttaaccggttagggtttaacgggtaaccgggttacgggttacccctaacggtttaccggtaaggttacccgacgggtaccggtacggtaacggttcgggtacggttaccgggtagggtaaaccttaagtttccgttaaccgttacctaccgttacccgtaaccgtaccgttacgacggtaccgtaccggtaccggtacgtacccgtaccgttaccgttaagttaacggtttacgttttacgaacgtttaacgtttacgtttaaccgttacgtttacgaaccgtaccgttaaccgttcccggtttaccccgggttacccgttacggttaccggacgggtaccggtacggacggttagaacgtacgaccgtaaacgcgttaggtcgaacgtcacgtacgtaccg

SEQ ID NO: 254322 - DNA, 250 bp, Homo sapiens
  misc_feature: GYAE6OF01EM2J6.21.39.D06.1.454.CMB.1.raw
  modified_base (133)..(133): a, c, t, g, unknown or other
  misc_feature (133)..(133): n is a, c, g, or t
  modified_base (149)..(149): a, c, t, g, unknown or other
  misc_feature (149)..(149): n is a, c, g, or t
  modified_base (193)..(193): a, c, t, g, unknown or other
  misc_feature (193)..(193): n is a, c, g, or t
  modified_base (221)..(250): a, c, t, g, unknown or other
  misc_feature (221)..(250): n is a, c, g, or t
tcagtcgtcgctcgcacgaccggtgctcgattttagtgacatctcgcagttctttgggggcaggagtcagacccagtcaggacacagcatggacatgacgggtccccgctcagctcctgggctcctgctgctntggttccagctcagangcacatccagatcgacccatctccatcccgtcgtgtctgccgtnttggaaggagacagatcaccatcctacnnnnnnnnnnnnnnnnnnnnnnnnnnnnnn

SEQ ID NO: 254323 - DNA, 543 bp, Homo sapiens
  misc_feature: GYAE6OF02FZD11.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggttagcctggtatcagcagaaaccagggaaagcccctaaactcctgatctatgctgcatccagttggaaagtgggtcccatcaaggttcagcggcagtgatcgtgggacagatttcactctcaccatcagcagcctgcagcctgaagtattttgactaactttattattgtacaacagtctccgtaccggtttcccccggacttttccgggcgggtacgggtaccgtaagggtcgggtaacggtaacgttacgaaaccggtacgttacggtacggacgtacggacctaccgtacg

SEQ ID NO: 254324 - DNA, 590 bp, Homo sapiens
  misc_feature: GYAE6OF02H7K50.21.39.D06.1.454.CMB.1.raw
  modified_base (238)..(238): a, c, t, g, unknown or other
  misc_feature (238)..(238): n is a, c, g, or t
  modified_base (281)..(281): a, c, t, g, unknown or other
  misc_feature (281)..(281): n is a, c, g, or t
tcagtcgtcgctcgcacgaccggtgctcgatttagtgacatctcgcagttctttgggggcaggagtcaggcccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtnttagcagctggttagcctggtatcagcagaaaccagggaaacncccctaaatcctgatctatgctgcatccagtttggaaagtgggtcccatcaaggttcagcggcagtgatcgtgggacagtatttcactctcaccatcagcagcctgcagcctgaagtatttgacttaactttatttacgttgtacaacgtacgggtccttaccggtaaccccgggttttccccccggtacgttttccggggaccggggtaacggggtaacccgtaaagggggttcgggaacgtaacgttaacccgaaaaccggtaacgttcgggtacgggtaccgtacggtaccccgtaacgttaaccg

SEQ ID NO: 254325 - DNA, 579 bp, Homo sapiens
  misc_feature: GYAE6OF02H3MZE.21.39.D06.1.454.CMB.1.raw
tcagtcgtcgctcgcacgaccggtgctcgatttagtgacatctcgcagttctttggggcaggagtcaggcccagtcaggacacagcatggacatgagggtccccgctcagctcccggggctcctgctgctctggttcccaggctccagatgcgacatccagatgacccagtctccatcctccgtgtctgcgtctgtaggagacagagtcaccatcacttgtcggcagtcagggtattagcagctggttagcctggtatcagcagaaaccagggaaacgcccctaaactccgtgatctatgctgcatccagtttggaaagtcggggtcccattcaaggttcaggtcggcagtggatcgtgggacagtattttcgactctcaccatcagcaacgcctgcagcctgaagtattttcgacttaactttattattgtacctaacgtaggtccttaccgtaccgggtttcccccggtaacgttttccggggaccgggtacggggtacccgtaaggggtcgggtaacgtacgtaaccgaaaaccgtaacgttacggtcgggaccttcggacctacccgattaccgg

SEQ ID NO: 254326 - DNA, 539 bp, Homo sapiens
  misc_feature: GYAE6OF02JV3QL.21.39.D06.1.454.CMB.1.raw
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
tcagtcgtcgctcgcacgaccggtgctcgatttagtgacatctcgcagttctttgggggcaggagtcagacccagtcaggacacagcatggacatgagggtccccgctcagctcctgggctcctgctgctctggttcccaggctccagatgcgacatccagatgacccagtctccatcctccgtgtctgcgtctgtaggagacagagtcaccatcacttgtcgggcagtcagggtattagcagctggttagcctggtatcagcagaaaccagggaaagcccctaaactcctgatctatgactgcatccagttggaaagtcgggtccatcaaggttcagcggcagtgatcgtgggacagatttcactctcacatcagcagcctgcagccngaatntttgactaacttattattcgtacaactggtacttccgtaaccggtttccccgagtttccgggacggtacgggtaaccgtaagggttacggaaggtaacgttaccgaaaacggtacgttcgggtaggacctcggaccgacccgtag

SEQ ID NO: 254327 - DNA, 553 bp, Homo sapiens
  misc_feature: GYAE6OF02IBDVN.21.39.D06.1.454.CMB.1.raw
  modified_base (226)..(226): a, c, t, g, unknown or other
  misc_feature (226)..(226): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgcgggnagtcaggtattagcagctggttagcctggtatcagcagaaaccagggaaagcccctaaaactcctagatctatgctgcatccagttggaaagtgggtccatcaaggttcagcggcagtgatcgtgggacagtatttcactctacaccatcagcagcctgcagctgaacgtattttgactaactttattattgtacaaacacgctaccacggttttacccccggagttttccggacgggtaacggaaccggtaaagggtcggtaaggaacgttaacaaaacggtaaacccgtaggttacgggtaccgttacggacctaacccgtaacg

SEQ ID NO: 254328 - DNA, 561 bp, Homo sapiens
  misc_feature: GYAE6OF02GYK7L.21.39.D06.1.454.CMB.1.raw
  modified_base (252)..(252): a, c, t, g, unknown or other
  misc_feature (252)..(252): n is a, c, g, or t
  modified_base (281)..(281): a, c, t, g, unknown or other
  misc_feature (281)..(281): n is a, c, g, or t
  modified_base (403)..(403): a, c, t, g, unknown or other
  misc_feature (403)..(403): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcagtcagggtattagcagctggttancctggtatcagcaagaaaccagggaaacncccctaaactcctgatctatgctgcatccagtttggaaagtcgggtcccatcaaggttcagcggcagtggatcgtgggacagtatttcactctcacatcagcagcctgcacgcctagaagtnttttgactaactttattattagtacaacgaggtcttacgtacccggtttccccggacgtttccgggaccgggtaacgggacccggtaagggtacggaacggtaacgtaccgaaaacggtaacgttcggtacggtaccgtacggtacctaacccgtacg

SEQ ID NO: 254329 - DNA, 560 bp, Homo sapiens
  misc_feature: GYAE6OF02IOUTC.21.39.D06.1.454.CMB.1.raw
  modified_base (375)..(375): a, c, t, g, unknown or other
  misc_feature (375)..(375): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggttagcctggtatcagcagaaaccagggaaacgcccctaaaactcctgatctatgctgcatccagtttggaaagtgggtcccatcaaggttcagcggcagtggatcgtgggactagatttcacttcncaccatcagcagcctgcagcctagaagtattttgactaacttattatttgtactaacgtagtccttaccgtaccggtttcccccggacgttttccgggcgggtaacgggacccgtaagggttacgggacggtaacgttaccgaaaacggtaaccgttcggtacggtccgtaggtaccaccgtacg

SEQ ID NO: 254330 - DNA, 541 bp, Homo sapiens
  misc_feature: GYAE6OF02F2AOI.21.39.D06.1.454.CMB.1.raw
  modified_base (398)..(398): a, c, t, g, unknown or other
  misc_feature (398)..(398): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggttagcctggtatcagcagaaaccagggaaacgcccctaaatcctgatctatgctgcatccagtttggaagtcgggtccatcaaggttcagcggcagtgatcgtgggacagatttcactctcaccatcagcagcctgcagcctagaagtnttttgactaactttattattgtacaactaggtcctccgtaccggtttccccggacgtttccgggcgggacgggtacccgtaaggggtacggaacggtactaccgaaacggtacgttcggtagggtcctacggactaccgtacg

SEQ ID NO: 254331 - DNA, 530 bp, Homo sapiens
  misc_feature: GYAE6OF02I2WTJ.21.39.D06.1.454.CMB.1.raw
  modified_base (395)..(395): a, c, t, g, unknown or other
  misc_feature (395)..(395): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgcgggcagtcagggtattagcagctggttagcctggtatcagcagaaaccagggaaagccctaaactcctgatctatgctgcatccagttggaaagtgggtaccatcaaggttcagcggcagtgatcgtgggacagatttcactctcacctatcagcagcctgcagcctagaatntttagctaacttattattgtacaactagccttaccgtaccggtttccccgacgtttccgggacggtacgggaccgtaagggtacggagtacgtaaccgtaaacgtaccgtggtaccggactacggaccacgtacg

SEQ ID NO: 254332 - DNA, 553 bp, Homo sapiens
  misc_feature: GYAE6OF02JJWVY.21.39.D06.1.454.CMB.1.raw
  modified_base (279)..(279): a, c, t, g, unknown or other
  misc_feature (279)..(279): n is a, c, g, or t
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
  modified_base (411)..(411): a, c, t, g, unknown or other
  misc_feature (411)..(411): n is a, c, g, or t
tcagtcgtcgctcgcacgaccggtgctcgatttagtgacatctcgcagttctttgggggcaggagtcaggcccagtcaggacacagcatggacatgagggtccccgctcagctcctgggctcctgctgctctggttcccaggctccagatgcgacatccagatgacccagtctccatcctccgtgtctgcgtctgtaggagacagagtcaccatcacttgcggcagtcagggtattagcagctggttagccttggtatcagcagaaaccaggggaaacncccctaaaactcctagactactatcgctgcactcctagtttaggaaagtcgggtacccatcgaaggttcagcggacagtgatcgngggacagtnttcactcncacatcagcagcctgacagtcctagaagtntttcgacttaattattattagtacgtaacacgtactaccgtaccggtttaccccgtacgtttcggcggtacgggtaccgaagggtacgtagtacgtaaccgtaaacggaacttacggtacggtccgtacgacctaccgtacg

SEQ ID NO: 254333 - DNA, 545 bp, Homo sapiens
  misc_feature: GYAE6OF02G5D23.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgcgggcgagtcagggtattagcagctggttagcctggtatcagcaagaaaccagggaaacgcccctaaactcctgatctatgctgcatccagtttaggaaagtgggtcccagtcaaggttcagcggcgagtggatcgtgggactagtatttcactctcaccatcagcagcctgcagcctagagtatttcgactaacttattattgtacaacgtagtctccgtacccggtttccccggacgtttccgggacgggtacgggaccgtaaagggtcggaacgtaacgtaccgaaacggtacgttcggtacggctacggacctacctacg

SEQ ID NO: 254334 - DNA, 509 bp, Homo sapiens
  misc_feature: GYAE6OF02GJ5WS.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggttagcctggtatcagcagaaaccagggaaagcccctaaaactcctgatctatgctgcatccagtttggaaagtgggtcccatcaaggttcagcggcagtggatcgtgggacagatttcactctcaccatcagcagcctgcagcctgaagtattttgactaactttattattgtacaacagtctcgtaccggtttccccgagtttccggcggagggaccgaagggtggagatacgaaacgacgtggtggctcgacactacg

SEQ ID NO: 254335 - DNA, 552 bp, Homo sapiens
  misc_feature: GYAE6OF02GBDJ8.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcagtcaggtattagcagctggtagcctggtatcagcagaaaccagggaaacgcccctaaactcctgatctatgctgcatccagtttggaaagtgggtcccatcaaggttcagcggcagtgatcgtgggacagatttcactctcaccatcagcagcctgcagcctagaagtattttgaccttaactttattattgtacaacgtaggtccttaccgtaccggttttcccccggacttttccgggacggtacgggtacccgaaagggttcggaagtaacgttacgaaaaccggtacgttggtacggtaccgtacggacctaccgtaacg

SEQ ID NO: 254336 - DNA, 568 bp, Homo sapiens
  misc_feature: GYAE6OF02H7C1Q.21.39.D06.1.454.CMB.1.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtagganacagagtcaccatcacttgtcgggnagtcagggtattagcagctggttagcctggtatcagcaagaaaccagggaaacacccctaaactcctagactctatgctgcatcctagtttaggaaagtcgggtcccatacgaaggttcaggcggacaggtagatcgtagggactagtactttcactctacacctatcagcacgcctgcagtcctagaacgttatttgacttaactttattattacgtacaacgtacgtctaccgtaccggtttaccccgtagtttccgggacgggtaacgggtaccgtaagggtacggaagtacttaaccgaaacggtacgtacggtacggtacgtcgtaccgacctacg

SEQ ID NO: 254337 - DNA, 564 bp, Homo sapiens
  misc_feature: GYAE6OF02F2GCN.21.39.D06.1.454.CMB.1.raw
  modified_base (403)..(403): a, c, t, g, unknown or other
  misc_feature (403)..(403): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcagtcagggtattagcagctggttagcctggtatcagcagaaaccagggaaacgcccctaaactcctagatctatgctgcatccagttggaaagtgggtacccatcgaaggttcagcggcagtggatcgtgggacagtatttcactctacaccatcagcacgcctgcagcctgaatntttacgacttaacttattatttcgtacaaacgtcggtctaccgtacccgggtttccccgtacgtttacgggccgggaacgggtaacccgtaagggtcggaacggtaacgttaaccgtaaacggtacgttacggttaccgggacttacggacctaccgtacg

SEQ ID NO: 254338 - DNA, 565 bp, Homo sapiens
  misc_feature: GYAE6OF02GLTSJ.21.39.D06.1.454.CMB.1.raw
  modified_base (350)..(350): a, c, t, g, unknown or other
  misc_feature (350)..(350): n is a, c, g, or t
  modified_base (408)..(408): a, c, t, g, unknown or other
  misc_feature (408)..(408): n is a, c, g, or t
tcagtcgtcgctcgcacgaccggtgctcgatttagtgacatctcgcagttctttgggggcaggagtcaggcccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcagtcagggtattagcagctggttagcctggtatcagcaagaaaccgagggaaacgcccctaaaactcctagatctatgctgcatccagtttggaaagtcgggtaccatacaaggttcagcggnagtgatcgtgggacagtatttcgactctacacatcagcagcctgcacgcctagaagtntttagacttaactttattattagtacaacgacggtccttaccgtacccggtttcccccgtacgtttccgggacgggtaacgggtaccgaaggggtcggaacgtaacgttaaccgaaaaccggtaacgttcgggtacggacctcggacctaccgtacg

SEQ ID NO: 254339 - DNA, 852 bp, Homo sapiens
  misc_feature: GYAE6OF02IP3WW.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctcgttcggttcccaggcctaccgagatgcgacactccgagatcgacccagttcctccatccctccgtgtctgtcgtctaggtaggagacagacgtaccacctattcctacgtttgggtccgggagtacgtacggaagggttattagcagtcgttaggttacgccgtggtatcgagacgaaacggaaaaccggaacgggaaacccgtaccccttaaaaccgtccgttaggtaacttaccgttaagtcgtactacggacctacttaccgttagggttttaacgggaaagggttccggggtaccccaagttacggtaacgggtttacacgggacggtacgtaggtcggtattacggtacggggaactagttacgtttacctaccgtttaccgtaccaaccgtataccgaacgtaccgtaccgtcccgtacggaccgacggtaccgttaacggttaaacgtttacgtttttaccgaaccttttaaacgttttaacttttaacgtttaccggtaaccgtaaacggttacggttaacccggttacccggtttaacccccggggttttacccccggttaccgggtttttacccgggggaccggggttaaccggggtaacccgggtaaggggtttaaccgggaacgggtaaaccttaaacccgggtaaaacccgttaaccggggtttcggttaccgggtaccggtaccggtaacccaacccgtttaacgg

SEQ ID NO: 254340 - DNA, 553 bp, Homo sapiens
  misc_feature: GYAE6OF02JV4I9.21.39.D06.1.454.CMB.1.raw
  modified_base (106)..(106): a, c, t, g, unknown or other
  misc_feature (106)..(106): n is a, c, g, or t
  modified_base (198)..(198): a, c, t, g, unknown or other
  misc_feature (198)..(198): n is a, c, g, or t
  modified_base (201)..(201): a, c, t, g, unknown or other
  misc_feature (201)..(201): n is a, c, g, or t
  modified_base (349)..(349): a, c, t, g, unknown or other
  misc_feature (349)..(349): n is a, c, g, or t
  modified_base (397)..(397): a, c, t, g, unknown or other
  misc_feature (397)..(397): n is a, c, g, or t
  modified_base (451)..(451): a, c, t, g, unknown or other
  misc_feature (451)..(451): n is a, c, g, or t
  modified_base (513)..(513): a, c, t, g, unknown or other
  misc_feature (513)..(513): n is a, c, g, or t
tcagtcgtcgctcgcacgaccggtgctcgatttagtgacatctcgcagttctttggggcaggagtcagacccagtcaggacacagcatggacatgagggtccccgntcagctcctgggctcctgctgctctggttcccaggctccagatgcgacatccagatgacccagtctccatcctcgtgtctgctactgtaganacngagtcacatcattgcgggcagttcagggtacttagcagcttggttacgccttggtatcagacagaaaaccagggaaacgacccctaaagtccctaggactctaatgcctgcatcgagtttgaaagtggtacccatcaagttcagtcgnaggtgactcggtggacatagtcactctcacatactagcagccctgacncggtcctagtaaagtctttgacctttaaacttattttaacgtagtaccctaaanacggtcttacccggttacggtttcccccggtagttccgtacgggacggtaccgaagggtcgngaactacgtaaccggactcggtagcgtactcgaaccgtcg

SEQ ID NO: 254341 - DNA, 547 bp, Homo sapiens
  misc_feature: GYAE6OF02GSDNM.21.39.D06.1.454.CMB.1.raw
  modified_base (395)..(395): a, c, t, g, unknown or other
  misc_feature (395)..(395): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctggtaggagacagagtcaccatcacttgtcgggcgagtcagggtattagcagctggttagcctgtatcagcagaaaccagggaaacgcccctaaaactcctgatctatgctgcatccagtttggaaagtgggtcccagtcaaggttcagcggcagtggatcgtgggacagtatttcactctcaccatcagcacgcctgacngcctgtaagtatttcgactaacttattattgtactaacgacggtcttacccgtaccggtttacccccggacgtttccgggacgggtacgggacccgtaagggtacggagtacgtaacgaacgtaacgtgtacggtacgtcgtaccacgtacg

SEQ ID NO: 254342 - DNA, 546 bp, Homo sapiens
  misc_feature: GYAE6OF02HQEYT.21.39.D06.1.454.CMB.1.raw
  modified_base (107)..(107): a, c, t, g, unknown or other
  misc_feature (107)..(107): n is a, c, g, or t
  modified_base (396)..(396): a, c, t, g, unknown or other
  misc_feature (396)..(396): n is a, c, g, or t
  modified_base (412)..(412): a, c, t, g, unknown or other
  misc_feature (412)..(412): n is a, c, g, or t
  modified_base (433)..(433): a, c, t, g, unknown or other
  misc_feature (433)..(433): n is a, c, g, or t
tcagtcgtcgctcgcacgaccggtgctcgatttagtgacatctcgcagttctttgggggcaggagtcagacccagtcaggacacagcatggacatgagggtccccgntcagctcctggggctcctgctgctctggttcccaggctccagatgcgacatccagatgacccagtctccatcctccgtgtctgcgtctgtaggagacagagtcaccatcacttgtcgggcagtcagggtattagcagctggttagcctggtatcagcaagaaaccagggaaaacgcccctaaaactcctagactctatgctgcatccagtttaggaaagtcggtccaatcaaggttcagcggacagtggatcgtgggactagtatttcactctacacatcagcacgctncagcctagagtatttnactaattattaattgactaanacgtctaccgtaccggttaccccggtattccgggacggtaacggtaccgaaacgggtaggaggtaactaaccgaaacgtaacgtacggtacggacgttacgaccgtactaacg

SEQ ID NO: 254343 - DNA, 570 bp, Homo sapiens
  misc_feature: GYAE6OF02GV43H.21.39.D06.1.454.CMB.1.raw
  modified_base (418)..(418): a, c, t, g, unknown or other
  misc_feature (418)..(418): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgcgggcgagtcagggtattagcagctggttagcctggtatcagcaagaaaccgagggaaacgcccctaaactcctagactctatgctgcatcctagtttaggaaaggtcgggtacccagtcgaaggttcaggcggcgtagtgatcgagggacagtatttcgactctcacatcacgcacgcctgcacgcctagaacgtntttcgacttaactttattattcgtacaacgtacgtaccttaccgtacccggtttccccgtacgtttccgggacgggtaacgggtaccgtaagggtacggaacgtaacgtaacgaaacgtacgttggtacggtacgtcggtacctaccgtacg

SEQ ID NO: 254344 - DNA, 609 bp, Homo sapiens
  misc_feature: GYAE6OF02HAZ96.21.39.D06.1.454.CMB.1.raw
  modified_base (282)..(282): a, c, t, g, unknown or other
  misc_feature (282)..(282): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgcgggcagtcagggtattagcagctggttagcctggtactcagcaagaaaccgagggaaacncccctaaactcctagactctatcgctgctatccgtaggtttaggaaacgttcgggtacccagtcgaaggttcaggcggacaggtgatcgtaggacagtattcactctcacctatacgagcacgccctgacctacgtccgtagtaacgttacttttacgacctttaaactttagttacttacgtaaccgtaacgtacggttccttaccggttaccccgggtttacccccggtaacgttttccgggaccgggtacgggtaaccgtaagggttacggaacgtaacgtaaccgaaacgtacgtcggtacggccgtacgaccgtaccgtacg

SEQ ID NO: 254345 - DNA, 538 bp, Homo sapiens
  misc_feature: GYAE6OF02GYJFC.21.39.D06.1.454.CMB.1.raw
  modified_base (425)..(425): a, c, t, g, unknown or other
  misc_feature (425)..(425): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgaccccagtctccatcctccgtgtctgcgtctgtaggagacagagtcaccatcacttgtcgggcgagtcaggggtattagcagctggttagcctggtatcagcaagaaaccagggaaacgcccctaaaactcctgatctatgctgcatccagtttggaaaggtcgggtcccatcaaggttcaggcggcaggtgatcgtgggactagtactttcactctcaccatcagcagcctgcagcctagaactatttgacttaacttnttattgtacaactacggtcttaccgtaccggtttccccgtacgtttccgggcgggagggtaccgaagggtggagtactaccgaaacgtacgtggtcggctacgactacctacg

SEQ ID NO: 254346 - DNA, 852 bp, Homo sapiens
  misc_feature: GYAE6OF02JSM6X.21.39.D06.1.454.CMB.1.raw
tcagtcgtcgctcgcacgaccggtgctcgatttagtgacatctcgcagttctttggggtcgaggagtcagacccagtcaggacacagcatggacatgagggtcccgctcagctcctgggctcctgctgctctggtccctaggctccagatggccgacactccagtatcgacccgtagtcctccattccctccgttgtctggcgttcctggttaggacgacacggacgttacacccaatccgtaacttcggtccgggggacaacggttccgaaaggggttacgtttacggacgtacggtaccgttaggggttactccgggttaggttacgttaccggtacggtaccgaacggtaaaaccggaacggggtaaaccggtaacccccgttaaaaccgtccctaacggtaccttacgtacggtacgtacgtgtacctacgtaccgtacggtttacgggtaaggtaccgggtacccgtacgttacggtaacggttacacgggtacggtacgtagggtacgtacgtaccggtagggtaaccgaagttaacgttcttaccgtacttacgacctacgttacgaacgtcgtaccgtaccgtcggtaccgtacggtccctaaagggtacgtttacgttttaaagcccgttttaaactttaaggtttacgtttaccgttacgtaaacgtaccgggtttacacccggttttaaacccggggttttcccccgttaaccggttcggggtaacccggggtaacgtttacccgggggaaaacggggttttacggaaacggtccggttaaaaccgttaacggttaacccgttagggttaccggtcggtacgtaaccccggttataccggg

SEQ ID NO: 254347 - DNA, 619 bp, Homo sapiens
  misc_feature: GYAE6OF02JKMH4.21.39.D06.1.454.CMB.1.raw
  modified_base (291)..(291): a, c, t, g, unknown or other
  misc_feature (291)..(291): n is a, c, g, or t
  modified_base (380)..(380): a, c, t, g, unknown or other
  misc_feature (380)..(380): n is a, c, g, or t
  modified_base (431)..(431): a, c, t, g, unknown or other
  misc_feature (431)..(431): n is a, c, g, or t
  modified_base (463)..(463): a, c, t, g, unknown or other
  misc_feature (463)..(463): n is a, c, g, or t
tcagtcgtcgctcgcacgaccggtgctcgatttagtgacatctcgcagttctttggggcaggagtcagacccagtcaggacacagcatggacatgagggtccccgctcagctcctgggctcctgctgctctggttcccaggctccagatgcgacatccagatcgacccagtctccatcctcgtgtctgcgtctagtaggagacagactcaaccatccacttgcgggcagtcgagggtattagcagtcgtggttagccgttggtatcagtcaaggaaacccgaggggaaacncccctaaactccgtagaactactagtggacctgacacttctaggttttacggaaaggtcgggtcccaagttcgaaggtttcacggcggntaggttgacgtcggacgggtacaggttactttcgactctacactactacgngacctgacctcgacgtacgtccgtagacgttntttacgacttaactttattagttacgtacaaacgtcgttcctaccggttacccggtttaccccggttagttccggacggggtaacggtacccgtaaggggtacgtaaggaccgttaacggaaaccgtacggttacgcggtaccgcgtacacccgta

SEQ ID NO: 254348 - DNA, 543 bp, Homo sapiens
  misc_feature: GYAE6OF02HRGFC.21.39.D06.1.454.CMB.1.raw
  modified_base (107)..(107): a, c, t, g, unknown or other
  misc_feature (107)..(107): n is a, c, g, or t
  modified_base (150)..(150): a, c, t, g, unknown or other
  misc_feature (150)..(150): n is a, c, g, or t
  modified_base (156)..(156): a, c, t, g, unknown or other
  misc_feature (156)..(156): n is a, c, g, or t
  modified_base (170)..(170): a, c, t, g, unknown or other
  misc_feature (170)..(170): n is a, c, g, or t
  modified_base (174)..(174): a, c, t, g, unknown or other
  misc_feature (174)..(174): n is a, c, g, or t
  modified_base (186)..(186): a, c, t, g, unknown or other
  misc_feature (186)..(186): n is a, c, g, or t
  modified_base (201)..(201): a, c, t, g, unknown or other
  misc_feature (201)..(201): n is a, c, g, or t
  modified_base (233)..(233): a, c, t, g, unknown or other
  misc_feature (233)..(233): n is a, c, g, or t
  modified_base (263)..(263): a, c, t, g, unknown or other
  misc_feature (263)..(263): n is a, c, g, or t
  modified_base (363)..(363): a, c, t, g, unknown or other
  misc_feature (363)..(363): n is a, c, g, or t
  modified_base (386)..(386): a, c, t, g, unknown or other
  misc_feature (386)..(386): n is a, c, g, or t
  modified_base (394)..(394): a, c, t, g, unknown or other
  misc_feature (394)..(394): n is a, c, g, or t
  modified_base (406)..(406): a, c, t, g, unknown or other
  misc_feature (406)..(406): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (423)..(423): a, c, t, g, unknown or other
  misc_feature (423)..(423): n is a, c, g, or t
  modified_base (441)..(441): a, c, t, g, unknown or other
  misc_feature (441)..(441): n is a, c, g, or t
tcagtcgtcgctcgcacgaccggtgctcgatttagtgacatctcgcagttctttgggggcaggagtcagacccagtcaggacacagcatggacatgagggtccccgntcagctcctggggctcctgctgctctggttcccaggctccagntgcganatccagatgacccngtcnccatcctccgtnctgcgtctgtaaggngacagatcaccagttcacgttgcgggatagtnaggtattagcagctggttagcctggtatcngcagaaaaccagggaaatcccctaaaatcctgaactctatgctgacactaccaggtttaggaaacgcgggttacccaagttcgaaaggttcaagcggtanaagttggatcgtgggacaaggtntttcactntacgacagtcanctagccngcntcatatnttagactaattagttatntacaacgcgtctaccgtacccgttcccgtagttcggacggtacggacgaaggtcgtaagaacgtaacgaacgtagtcggtacgacgtacgtacctacgtacg

SEQ ID NO: 254349 - DNA, 596 bp, Homo sapiens
  misc_feature: GYAE6OF02IVCFJ.21.39.D06.1.454.CMB.1.raw
  modified_base (107)..(107): a, c, t, g, unknown or other
  misc_feature (107)..(107): n is a, c, g, or t
  modified_base (204)..(204): a, c, t, g, unknown or other
  misc_feature (204)..(204): n is a, c, g, or t
tcagtcgtcgctcgcacgaccggtgctcgatttagtgacatctcgcagttctttgggggcaggagtcagacccagtcaggacacagcatggacatgagggtccccgntcagctcctggggctcctgctgctctggttcccaggctccagatgcgacatccagatgacccagtcctccatcctccgtgtctgcgtctggtagganacagagtcaccatcacttggcgggcagtcgagggtattagcagctggttacgccgttggtatcgagacaagaaacccgaggggaaactaccccctaaactcctagactctatgctgcacgtcctaggtttacggaaaggttcgggtaccctaagtcgtaaaggttcaggcggctaggtggactcgtagggactagtatttaccactctaccactactcgagcacgtcctagactacgtctagtaagttacgtttgacttaacttattagttacgtactaacgtacggtccttaccgtacccggttccccgtacgtttccggacgggtacggtaccgaagggtacgaaggtactaacgaacgtacgtcggtacggtacgtcgacctacctacg

SEQ ID NO: 254350 - DNA, 789 bp, Homo sapiens
  misc_feature: GYAE6OF02HM69L.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacgttgtcgggcgagtcgagggtattagcagcgtggttacgcctggtatcgagacaagaaaccgagggaaaccgacccccttaaaactcctagactactatcgctcgctactccgtaagtttagggaaacggttcgggtacccaagttacgtaaggttcaaggcggactaagggtggtacgttcggtacgggtactacggttactttccaaccgttcctaccgtaaccctaatccgaacgtccgtacggtcccgtacggacccgtacggtacccttaggttaaacgtttagttttacggtaacctttaaacgttttaacgtttaacgtttaccggtaaccgtaaaccggtacgggttacccgtttacccgggtttaaacccccggggttttacccccccggttacgggttttaccccgggggacccgggggttaaaccgggggttaaacccggtaaagggggttaccgggttaaaccggtaaaccggttaaaccccgggtaaaaaccgggttaccggttacgggggtaaccggtacccggtttaccggtaaccccgttaacccgttaacccgg

SEQ ID NO: 254351 - DNA, 646 bp, Homo sapiens
  misc_feature: GYAE6OF02IPUBM.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtcctccatcctccgtgtctcgcgtctgtaggagacagacgtcaccatcacgttggtccggggcagtcagggtattagcagcgttaggttacgccgttggtatcagtacagaaaccagggaacgaccctaaactcctgactctagtgctcgctactcgtagttaggaagtcgggtaccatacgtaggttcaggcggactagtggtacgtcgtacgggactagttatttcgaacctactccaacctatacgacggtcacggtccctagccgtacgtaccgtacgaaagtttacgtttacgacttaactttacgttaagttcgtaaccgtaaacgtcggacctttacccggtacccggttttaccccgggtacgtttaccggggaccgggttaacgggaacccggtaagggtacggaacgtaacgtaaccggttaaaacgtcggttacgtcgggaaccgtacgtaccgtaccgttacg

SEQ ID NO: 254352 - DNA, 622 bp, Homo sapiens
  misc_feature: GYAE6OF02H4H16.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcacatcacttgtcgggcagtcagggtattagcagctggttagcctggtatcagcaagaaaccagggaaacacccctaaactcctagatctatgctgctatccgtaggtttaggaaaggttcgggtacccagtcgtaaggtcaggcggtacaggtgatcggtaggactagtactttcactctaccaccatcacgcacgcctgacacgtccgtagtaagttattttacgaacttaactttatttagttacgtactaaaccgtacggtccgttacccggtacccgggttttacccccggtacgttttacccgggaccggggtaacgggaaccggtaacggggttacggtaaggtaaccgttaaccgaaaccggttaacgttcgggttacggtaccgtacggaccctacccgtaacg

SEQ ID NO: 254353 - DNA, 564 bp, Homo sapiens
  misc_feature: GYAE6OF02G1U0U.21.39.D06.1.454.CMB.1.raw
  modified_base (284)..(284): a, c, t, g, unknown or other
  misc_feature (284)..(284): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttggtcgggcgagtcgagggtattagcagctggttagcctggtatcagcaagaaaccagggaaacncccctaaactcctgatctatgctgcatccaggtttaggaaggttcgggtacccagtacgaaggttcaggcggacagtggatcgagggacagtatttcactctcactatcagcagcctgcacgcctagtaagttactttacgacttaacttatttacttagtaccaacgtacggtccttaccggtacccggtttaccccggtagttccgggacgggtacgggtaaccgaagggtacggaagtactaacgaacgtacgtcggtacgactacggaccacgtac

SEQ ID NO: 254354 - DNA, 689 bp, Homo sapiens
  misc_feature: GYAE6OF02GXXFB.21.39.D06.1.454.CMB.1.raw
tcagtcgtcgctcgcacgaccggtgctcgatttagtgacatctcgcagttctttgggggcaggagtcaggcccagtcaggacacagcatggacatgagggtccccgctcagctcctggggctcctgctgctctggttcccaggctccagatgcgacatccagatgacccagtctccatcctccgtgtctgcgtctgtaggagacagacgtcaccatcacttggtccgggcgagtcgagggtattagcagctggttagccgtggtactcgagcaagaaaccgagggaaacacccctaaactcctagatctatgtcgtcgctacgtccgtaaggtttacgggaaaggttcgggtacccaagttacgtaacggttacgaggtcggtacgtaggtaggtacgtccggtaggggtactaaggtacttttaccacttccgtaccgtaaccgtactacgaacggtaccgaacgtcccgtacggaccgtacggtaccgtaaggtaacgttacgttttacgaacgttaaacttttaacgtttaactttacgtaacctaacggtacggttaccgttacccggttaccccggtttacccccggtacggtttaccgggaccgggtaagggtaacccggtaaggtaccggtaacgtaacgtaaccgaaacggtacgtcggtacgtcgtacgtacaccgtacg

SEQ ID NO: 254355 - DNA, 572 bp, Homo sapiens
  misc_feature: GYAE6OF02IZHYR.21.39.D06.1.454.CMB.1.raw
  modified_base (399)..(399): a, c, t, g, unknown or other
  misc_feature (399)..(399): n is a, c, g, or t
tcagtcgtcgctcgcacgaccggtgctcgatttagtgacatctcgcagttctttgggggcaggagtcaggcccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggttagcctggtatcagcagaaaccgagggaaacgacccctaaactcctagactctatcgctgactatccgtaggtttaggaaacggtcgggtacccaagtccgtaaggttcaggcggacaggtggatcgtagggactagtactttcactcncaccatacagcagcctgcgacgtcgtagtaatagtttcgacttaactttattagttcgtaacaacgtacgtccttaccggtacccggtttaccccggagtttccgggacggtaacgggtaccgtaagggtcgaagtaacgtacgaaacgtacgtggtacgctagacctactac

SEQ ID NO: 254356 - DNA, 739 bp, Homo sapiens
  misc_feature: GYAE6OF02HOSAK.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatccacgttgtcgggcgagtcgaggtattagcagcgttggttacgccttggtatcagacaagaaaaccgaagggaaacgacccctaaactccgtagactctatcgctgactacttaccgtaaggtttaggaaacggttcgggtaccctagtacgtaaggttcgaaggcggacgtaggtacgacgttcggtagggaactaggttaactttactaccttccgtaaccgaacctacgttaccgagaccgacgtcccgtagaccgtacgtaccttaggtaacgttaacgtttttacgaacctttaaacttttagtttaacgttacgtaaccgtaaacggtaccgttaacccgtttaccccggtttaacccgggtttaccccccgggttaacggttttacccggggaccggggtaaaccggggtaacccggttaaaggggttccgggtaaacggttaaccgttaaacccggtaaaacggttaccggtttaggggtaccggttaccgtaaccggtaccgtaaccgttaaccg

SEQ ID NO: 254357 - DNA, 572 bp, Homo sapiens
  misc_feature: GYAE6OF02FL34Q.21.39.D06.1.454.CMB.1.raw
  modified_base (360)..(360): a, c, t, g, unknown or other
  misc_feature (360)..(360): n is a, c, g, or t
tcagtcgtcgctcgcacgaccggtgctcgatttagtgacatctcgcagttctttgggggcaggagtcagaccccagtcaggacacagcatggacatgagggtccccgctcagctcctggggctcctgctgctctggttcccaggctccagatgcgacatccagatgacccagtcctccatcctccgtgtctgcgtctgtaggagacagagtcaccatcacttgtcgggcgagtcagggtattagcagctggtagcctggtatcagcagaaaccagggaaacgcccctaaactcctgatctatgctgcatccagttggaagtgggtcccatcaaggttcagcggcaggtgatcgtgggacngatttcactctcaccatcagcagcctgcagcctagaaacgtattttcgacttaaactttattaagttcgttacaacgtaggtaccttccgtaccgggttttcccccggacgttttccgggccgggaaggggtaaccgtaacgggttacggaaggtaacgttaccgaaaacggtaacgttcggtacgggaccgtcggtaccgtaccgtaaccg

SEQ ID NO: 254358 - DNA, 862 bp, Homo sapiens
  misc_feature: GYAE6OF02ILCAU.21.39.D06.1.454.CMB.1.raw
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtagganacagagtcaccatcacttgcgggnagtcgaggtattagcagctggttancctggtatcagcaagaaaccgagggaaacacccctaaactcctagactactatcgctgcctacgtccgtaggtttacgggaaacggttcgggtacccctaagttaccgtaaagggtttccgaaacgggtccgggtaaccgtaagggttacgggtaacgtttcccgggtaagggggtaaaccgtaaggttaaccgttttttacccgaaccgttttacccgtaacccgtaaaccccgtaacgttacccgaacggtacccgtaacggtccccgttaggtacccgtaccggttaccccgttaagggttaaacgttttacgtttttaccggaaaccgttttaaacgttttacgttttaacgttttaccggttaaaccgtaaaccggtttaaccgggttaccccttttaaccccgggtttaaacccccggggtttttaccccccccggtaacggttttaccccgggtacccgggggtaaaccggggtaacccgggggtaaaccccggttaaaggggggttaccgggtaaacggttaaaccgttaaacccggtaaaaccgggttaacccggtttacgggttaccgggtacccgttaccggtaaccccgttaaacccgg

SEQ ID NO: 254359 - DNA, 716 bp, Homo sapiens
  misc_feature: GYAE6OF02HZ75Z.21.39.D06.1.454.CMB.1.raw
  modified_base (464)..(464): a, c, t, g, unknown or other
  misc_feature (464)..(464): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagacgtcaccatctacttggtcgggacgagtcgagggtattagcagcgtggttagcctggtatcgacgacgaaacgaaaaccgaacggggaaaccgaccccttaaaacgtcctagtactactagtcgactgctacgtaccgtaggtttaggaaacggtcgggtaccccagttacgaaggttcgaacggtcggacgtaggtaggtacgtcggtacgggactaagttactttaccaccttacctaccaaccgtataccgacncgacgtcctacgaccgtacgtccgttaagtaacgtttacgttttacgaactttaacgtttaacttagtttacgaaccgtaaacgtccgggttaaccttaccccgggttaaccgggttttacccccggttaggtttacccgggaccggggtaaaccgggtaccgggtaaggggttaccggtaaggtaaccgttaaaccgaaaccggtaacggttgggtaccggtaccgtacggtacccgtaacctttaaccgg

SEQ ID NO: 254360 - DNA, 723 bp, Homo sapiens
  misc_feature: GYAE6OF02GX1EX.21.39.D06.1.454.CMB.1.raw
tcagtcgtcgctcgcacgaccggtgctcgatttagtgacatctcgcagttctttgggggcaggagtcaggcccagtcaggacacagcatggacatgagggtccccgctcagctcctgggctcctgctgctctggttcccaggctccagatgcgacatccagatgacccagtctccatcctccgtgtctgcgtctgtagagacagagtcaccatccgacttggtccgggcgagtcgaaggggttattagcaggtcgttaggttacgccgttaggtactcgaggccaaggaaacccgaaggggaaacctcccccgtaaaacttcccgtagtactacttagtcgtcttgacctacttaccgtagggttttaggaaacggttccgggtaccctaagtaccgaaggttccaaggcggtactaagggttcgacgttacggtagggaactagttacgtttacctacttcgtaccaaccagtacgacgaccgtacgtccgttacgaccgtacgtcccgtaaggtaacgttagttttccgaacctttaaacgttttagtttacgttcgttaaccaacgttacgggtcccttacccggttaccccggttttacccccggtaggtttacccgggacgggtaacgggtaaccggtaacggggtacgggtaaccgtaacgttaaaccgtaaacggttaaccgtcgggtacggtaccgtcggtacccaccgttaccg

SEQ ID NO: 254361 - DNA, 536 bp, Homo sapiens
  misc_feature: GYAE6OF02FSRV9.21.39.D06.1.454.CMB.1.raw
  modified_base (400)..(400): a, c, t, g, unknown or other
  misc_feature (400)..(400): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggtagcctggtatcagcagaaaccagggaaacgcccctaaactcctgactctatgctgcactcctagtttggaaagtgggtcccatcaaggttcagcggcagtgatcgaggacagtatttcactctcacatcagcagcctgcagcctagaatntttcgacttaactttattagttacgtacgaacaggtcctacgtacccgggtttccccgagtttccgggacggaacgggaccgtaagggtcgaacgtaacttaaccgaaacgtactcggtaggactcgacacctacg

SEQ ID NO: 254362 - DNA, 735 bp, Homo sapiens
  misc_feature: GYAE6OF02F31VM.21.39.D06.1.454.CMB.1.raw
  modified_base (254)..(254): a, c, t, g, unknown or other
  misc_feature (254)..(254): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttggtcgggcgagtcgagggtattagcagctggtanccgtggtatcgagcaagaaaccgagggaaacacccctaaatccgtagactctatcgctgcatccgtaagtttaggaaaggttcgggtaccagttacgtaaggttcgacggtcggacgtagggtgacgttcggtagggactaggtactttaccgacttcctaaccaccgaattaccgacgtaccgtacgacccgtgaccgtacgtacccgttaaggtaaacgttcgtttttacgaaccgtttaaacttttaacgtttaacgtttaccgtaacctaaaccggtacggttacccgttaacccggtttacccccggggtttttaccccccgggtaacggtttacccggggtaacccggggtaaccggggtaaccgggttaaacggggtaccgggtaaaggttaaacccggtaaacccgtaaaacgggttaacccggttagggttaccgggtacccgttaaccgggtaccctacccggtttaaccg

SEQ ID NO: 254363 - DNA, 627 bp, Homo sapiens
  misc_feature: GYAE6OF02IBANS.21.39.D06.1.454.CMB.1.raw
  modified_base (107)..(107): a, c, t, g, unknown or other
  misc_feature (107)..(107): n is a, c, g, or t
  modified_base (201)..(201): a, c, t, g, unknown or other
  misc_feature (201)..(201): n is a, c, g, or t
  modified_base (252)..(252): a, c, t, g, unknown or other
  misc_feature (252)..(252): n is a, c, g, or t
tcagtcgtcgctcgcacgaccggtgctcgatttagtgacatctcgcagttctttgggggcaggagtcagacccagtcaggacacagcatggacatgagggtccccgntcagctcctggggctcctgctgctctggttcccaggctccagatgcgacatccagatgacccagtctccatcctcgtgtctgcgtctgtagganacagacgtcaccatcacgttggtcggcgagtcaggtatagcagctggttanccttaggtatcgagacaacggaaaaccgaaggggtaaaccacccccttaaaactccgtagaattcctaagtcgtactgactattacccgtaaggttttacgggaaaacggtcgggtccctaagtacgtaaacggttcacggtacggagtaagttgggaacttcggtacggggaactaggtactttacacgtctacgacactagacgcacgctgaccagctagaagtctttagacttaattatattcggacaacgtacgtacttacccgtaccgggttttccccgagtttaccggacgggacggtaacggtaacgggttaggaccgtaaacgtaaccgaaacgtacgtaggttgaccggtccgacctacgttaacg

SEQ ID NO: 254364 - DNA, 800 bp, Homo sapiens
  misc_feature: GYAE6OF02FF3KV.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgcctgctctggttcccaggctccagatgcgacatccagatcgacccagtcctccatccctccgtgtctgcgtctaggtaggacgtacagacgttccaccatcacgttggcgggcgagtcgagggtatagcagcgttggtacgccgttggtactcgacgcaacgaaaccgaagggaaaccgtcccctaaaactcctagactctatcgctgaccattccgtaggttacggaaacggttccgggtacctagtacgtaacggttccgaggtccggagaggttcggtacgttaccgggtacgggaactacggttaacttttacccgaccttaccttacccgaaccctaacgttacccgaacgtacccgtaaccgtcccgttacggaaccgtacggtaccgttaacgggttaaaacgtttcgtttttaaccggaaacctttaaaacgtttttaacgttaacctttacggtaaacccaaaccggttaacggttaccccttaaccccgggttaaccccgggtttttacccccgggtaacggttttacccgggggaccggggaaacccggggttaaccgggttaaacggggtaccggtaaaccgttaaccgttaaacccggaaaacccggtttacggttacgggtacccggttaccgtaccgggtacccctaacccggtttacg

SEQ ID NO: 254365 - DNA, 795 bp, Homo sapiens
  misc_feature: GYAE6OF02IIX32.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagacgtccacctatcctacgttggtccggggcgaggtcgtaaggggttattacggcaggtcgttaggttacgccgttggtaactcgagtccgaaaggaaaaccgaagggaaaccgtcccccttaaaacgtcccgttagactccttaagtcgtacgtacgcgtaacctacccgttaaggttttaacgggaaaacggttccggggtacccctaagttaccggtaaaacggtttccggaagggtccggacgtaagggttcggtaaacggttccggtacgggggaaacgttacggtttactttacccgtactttaccgtacccgtacccgtaacgttaccgaacggacgtaccgtcccgttcgaccgtacgtacccgtaaggttaacggtttacttttacggaacctttaaacttttaacgtttacgttacgttaaccgaagttacccgggtaccttacccggttaaacccgggtttacccccggttacggttacccgggacggggtaaccggggtaaccggtaacggggtacgtaacggtaacgtaaaccgtaaacggtacgttacggtacggtcgtaccggtccgtacgtacg

SEQ ID NO: 254366 - DNA, 785 bp, Homo sapiens
  misc_feature: GYAE6OF02HWFQJ.21.39.D06.1.454.CMB.1.raw
tcagtcgtcgctcgcacgaccggtgctcgatttagtgacatctcgcagttctttgggggcaggagtcaggcccagtcaggacacagcatggacatgagggtccccgctcagctcctggggctcctgctgctctggttcccaggctccagatcgcgacatccagatcgacccagtctccactcccccgtgtctgcgtctgtaggagacagacgtccacatctacttcggtcgggcgagtcgagggttattagcagcgttaggttacgccgttagtactacgagtacaacggaaaaccgaacgggaaaccgtaccccctaaaacttccgtagtactccttaagtcgacgtcgacctaacgttaccgtaaggtttacgggaaacggttccgggggtacccagttacgtaaacgggttcgacggtacggtacgtaggtcggtacgttcggtacgggaactacggttacttttaccgaaccttcccgtactaacccgtaacgtaccgtaacgccgtaacgcctacggacgtaacgtccgtaagtaaacgtttacgtttacgtaaccttaaactttacgtttaacgttacgtaaccgaaacgtacggtaccgtttacccggttaacccgggttttaccccggttacggttttaccggggaccggggttaaccggggaaccggttaacggggtaacgggttaaaccggtaacgttaaaccggtaaaaccggttaaccgttcggggttaacggacccggtttaccggaaccgttaccccgttagtttacccgg

SEQ ID NO: 254367 - DNA, 552 bp, Homo sapiens
  misc_feature: GYAE6OF02HJH50.21.39.D06.1.454.CMB.1.raw
  modified_base (253)..(253): a, c, t, g, unknown or other
  misc_feature (253)..(253): n is a, c, g, or t
  modified_base (354)..(354): a, c, t, g, unknown or other
  misc_feature (354)..(354): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (393)..(393): a, c, t, g, unknown or other
  misc_feature (393)..(393): n is a, c, g, or t
tcagtcgtcgctcgcacgaccggtgctcgatttagtgacatctcgcagttctttgggggcaggagtcaggcccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacgttgtcgggcgagtcagggtatagcagctggttancctggtatcagcagaaaccagggaacacccctaaactcctagatctatgctgcatccgtaggtttaggaaaggttcgggtacccatcgaaggttcagcggnagtggatcgnggganagtatttcgacttctcacctatcngcacgcctgcagcctagtactatttgaccttaatttattagttgacgtaacgacgtccttaccggtaccgtttccccgggtatttccggggacggtacgggtaccgtaggggtacggatacgtaccgaacggtacgtgggtcgcgtacgcctacgtacg

SEQ ID NO: 254368 - DNA, 640 bp, Homo sapiens
  misc_feature: GYAE6OF02G8DQH.21.39.D06.1.454.CMB.1.raw
  modified_base (107)..(107): a, c, t, g, unknown or other
  misc_feature (107)..(107): n is a, c, g, or t
  modified_base (241)..(241): a, c, t, g, unknown or other
  misc_feature (241)..(241): n is a, c, g, or t
tcagtcgtcgctcgcacgaccggtgctcgatttagtgacatctcgcagttctttgggggcaggagtcagacccagtcaggacacagcatggacatgagggtccccgntcagctcctggggctcctgctgctctggttcccaggctccagatgcgacatccagatgacccagtctccatccctcgtgtctgcgtctgtaggagacagacgtcaaccatcacttggcgggcgagtcgagggtnttagcagcttggttagcctggtatcagacaagaaacccgagggaaacgcccctaaactcctagtatactatgctgactacttccgtaggtttaggaaacggttcgggtaccctaagtacgtaaggtttcgacggcggtacgaggtggagtcggtaggacgtagtactttacgacctcgtaccgaacctacgtacgagtccgtacgacctcgaccgtcgtacgtaagagttaacttttcgaacttaacgtttattagtttacgaactaacgacgttaccttaccggtacccggtttaccccgggtacgtttccggggacggtaacggggtaccgtaaagggtgggtaacgaacgtacgaaaccgtacgttacgggtacggacgtacgaccgaccgtaacg

SEQ ID NO: 254369 - DNA, 697 bp, Homo sapiens
  misc_feature: GYAE6OF02HO3DI.21.39.D06.1.454.CMB.1.raw
  modified_base (107)..(107): a, c, t, g, unknown or other
  misc_feature (107)..(107): n is a, c, g, or t
tcagtcgtcgctcgcacgaccggtgctcgatttagtgacatctcgcagttctttgggggcaggagtcagacccagtcaggacacagcatggacatgagggtccccgntcagctcctggggctcctgctgctctggttcccaggctccagatgcgacatccagatgacccagtctccatcctccgtgtctgcgtctgtaggagacagagtcacatcacttggtcgggcagtcagggtattagcagctggttagccgtggtatcagacaagaaaaccgagggaaacgccccctaaaacgtcctagtactctatcgctcgcacgttccgtaaggttaggtaaacggtcgggtaccctaagtcgaaacggtttcacggcggactaggtaggtaagtcggtacggggactaagtacttttaccacgttaccttaccgaacccaacgttccgaagaccctaaggtccccgtaggaccgtacgtacccgtaaggaaccgtttaattttacggaacttaaacgttttaacttaacgtttagtaacccgtaaacgtacggttacccgtacccgttaacccgggttttacccccgggacgttttaccgggaccgggtaacggggtaacccgtaagggtacggacgtaacggttaacccgaaacggttaccggttacggtcggtaccgttacgaccgtaaccgttacg

SEQ ID NO: 254370 - DNA, 593 bp, Homo sapiens
  misc_feature: GYAE6OF02F04NH.21.39.D06.1.454.CMB.1.raw
  modified_base (283)..(283): a, c, t, g, unknown or other
  misc_feature (283)..(283): n is a, c, g, or t
tcagtcgtcgctcgcacgaccggtgctcgatttagtgacatctcgcagttctttggggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcaggtattagcagctggttagcctggtatcagcaagaaaccaagggaaacncccctaaacgtcctagatctatcgctgacatcctagtttaggaaagtcgggtcccagtacaaggttcagcggacagtgactcgagggacagtatttcactctcactatcagcagctgcacgctagaagtattttcgaccgttaattacttagttgtacctaacgacgttaccttacccggttaacccggttttcccccgtaagtttcccgggacgggtaaccgggtaaccgtaaacgggtacgggtaaaccgtaacgtaccgtaaaaccggtacgttcggtaacgggtccgtagtacccgacgttaaccg

SEQ ID NO: 254371 - DNA, 603 bp, Homo sapiens
  misc_feature: GYAE6OF02FUFOE.21.39.D06.1.454.CMB.1.raw
  modified_base (201)..(201): a, c, t, g, unknown or other
  misc_feature (201)..(201): n is a, c, g, or t
  modified_base (407)..(407): a, c, t, g, unknown or other
  misc_feature (407)..(407): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctcgtgtctgcgtctgtagganacagagtcaccatcacttggtcgggcagtcagggtattagcagctggttagcctggtatcagcagaaaccgagggaacacccctaaactcctgatctatgctgcatcctagtttaggaagttcgggtcctagtcgaaggttcaggcggctaggtgactcggtggaactagtatttaccgactctacaacattaccagtcacgtccngaccgacgtccgtaagtaagttagttttcgaacttaacttttagttacttacgtaaccaacgtacggtacccgtaccgttaccccgggtttaccccgtacggtttccggacgggtaacggtacggtaacgggtagtaaccggtaacttaaccggtaaacgtacggttcggtacggtacgtacgtacctacgttacg

SEQ ID NO: 254372 - DNA, 571 bp, Homo sapiens
  misc_feature: GYAE6OF02G36SS.21.39.D06.1.454.CMB.1.raw
  modified_base (341)..(341): a, c, t, g, unknown or other
  misc_feature (341)..(341): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgcgggcagtcagggtattagcagctggttagcctggtatcagcaagaaaccagggaaacgcccctaaactcctgatctatgctgcatccagttggaagtcgggtccagtcaagttcagcgnagtgatcgtaggacagatttcactctcaccatcacgcacgcctgacacgccgtagaacgtagttttcgacttaactttagttattacgtactaacgtcggtaccttaccggtacccggtttacccccggtagttttccgggacgggtaacggggtaccgtaagggtacgggaacgtaacgttaaccgaaacggtacgttcggtacgggtacctacggacctaccgttacg

SEQ ID NO: 254373 - DNA, 990 bp, Homo sapiens
  misc_feature: GYAE6OF02JQRTM.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccactcctccgtgtcctggccgttctaggtaggactacaggtcgtaccaacccgatacctacgtttcggtaccggggcgtacggtcgtaagggggttattacggcgtaaggtcgttacgggttacgtccgttgggtacttcgagacaaggaaaccgaacggggaaacgtaccccttaaacgtcctaggtaactccgtaagttcgtaccgtaggtacctaacgttacccggttaaggtttaacggggtaaacggttccgggggttaacccctaacggtttaccggtaaaccgggtttaccaacggggtccgggtaaccgttaaaggggtcggtaaccgtttacggggtaagggtaaccgttaacggtttacgttttacccggttaccctaccggttaaacccgaaccgttaccgttaaccggtaaccggtacccggttaaccggtacccgttacggggtacccttaacgggtacccggtttaaaaccggttaaggtttaaccgttttttacccgggtaaaaccctttttaaacgtttttaaaccggtttttaacccggtttaacggtttaacccgttaaaaacccgggttacgggtttaaccccttttaaccccggggtttaccccccggggtttttaaccccccggttttaacggggtttaccccgggttacgggggtaacccggtaacggggtttaaaccgggggtaccgggttaacggtaaacccggttaaacccgggtaaaaccggtttaaccgggttacggggtttaacccggaaccgggtttcccggtaaaccgtacccggttaaacccgg

SEQ ID NO: 254374 - DNA, 747 bp, Homo sapiens
  misc_feature: GYAE6OF02HZ98X.21.39.D06.1.454.CMB.1.raw
  modified_base (206)..(206): a, c, t, g, unknown or other
  misc_feature (206)..(206): n is a, c, g, or t
  modified_base (231)..(231): a, c, t, g, unknown or other
  misc_feature (231)..(231): n is a, c, g, or t
tcagtcgtcgctcgcacgaccggtgctcgatttagtgacatctcgcagttctttgggggcaggagtcagacccagtcaggacacagcatggacatgagggtccccgctcagctccgtggggctcctgctgctctggttcccaggctccagatgcgacatccagatgacccagtcctccactcctccgtgtctgcgtctggtagganacagagtcaccatcacgttgcgggngagtcgagggttatagcagtcgtggttacgcgttaggtatcgagacgaaacgaaaccgaagggaaacctaccccgtaaacgtcctagtactactactcgtctacgactacgtaccgtagttttacgggaaaggttccgggtaccctaagttaccgtaaaggttcgacggacggtacgtacggtacggtacgtacggtacgggactacggttacttaccgtaccgttacctacctaaccgtacgtaccgtacgaccgtacgtcccgtacggaccgtaacggtacccgttaaggttaaacgttttacgtttaaccggtaactttaaactttaagtttaacgtttacggtaacctaaacggtaccgtaccgtttacccggttaaccccgggttttccccgggtacgtttacccggggacgggtaaccgggtaaccggtaacggggttaacggaacggtaaccgttaaccgtaaacggttacggttacgggtaccggtactacggtacctaccgttaacg

SEQ ID NO: 254375 - DNA, 684 bp, Homo sapiens
  misc_feature: GYAE6OF02HE500.21.39.D06.1.454.CMB.1.raw
  modified_base (107)..(107): a, c, t, g, unknown or other
  misc_feature (107)..(107): n is a, c, g, or t
  modified_base (192)..(192): a, c, t, g, unknown or other
  misc_feature (192)..(192): n is a, c, g, or t
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
tcagtcgtcgctcgcacgaccggtgctcgatttagtgacatctcgcagttctttgggggcaggagtcagacccagtcaggacacagcatggacatgagggtccccgntcagctcctgggctcctgctgctctggtcccaggctccagatgcgacatccagatgacccagtctccatcctccgtgtctgcgtntggtagganacagagtccacatcacgttggcgggnagtcgaaggtattagcagcgtaggttagcctggtatacgagacgaaggaaaaccgagggaaacgaccccgtaaaacctcctagtaactactatgtactagactacgtccgtaaggtttaggtaaaggtcgggtacccaagtacgtaaggttacgagcggtacgaggtacggtatcggacgggaactaggttatttaccgacttccgtactaaccgtactacgtacgtaccaacggcccgttacgacgtaccgtcgtaagtaaagttacgttttacgacttaaactttacgttaacgtttacgtaactaacgtacggtaccttacccgttaacccgggttttaccccccgtaacggtttaccgggtacgggaaccggggttaaccgaacggggttaacgaaggtaacgttaacgaaaccgtaaacggttcggtaggtaccgtcgtaccgtaccgtacg

SEQ ID NO: 254376 - DNA, 541 bp, Homo sapiens
  misc_feature: GYAE6OF02HD1T3.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggttagcctggtatcagcagaaaccagggaagcccctaaatcctgatctatgctgcatccagttggaaagtgggtccatcaaggttcagcggcagtggatctgggacagtatttcactctcaccatcagcagcctgcagtcctagaagtattttgactaattagttattgtacaacgtagcttacgtaccgggtttcccccgtattttccgggcgggaagggtacccggtaagggttgggaacggtaacgtaccgaaaaccggtacgtacggtggacctacggaccaccgtacg

SEQ ID NO: 254377 - DNA, 853 bp, Homo sapiens
  misc_feature: GYAE6OF02HMKJ9.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagacgtcaccatcacttggtcgggcgagtcgagggttattagcgagtcgttaggttacgccgttaggtatcagactaacgaaaccgaagggaaaccgacccctaaactcctagtactactagtgctacgactactaccgtaggtttagggaaggtcgggtaccctaagtaccgtaaacgggtttccgaggaccggtacgtaacgggtacgggtaacgttaccgggtacggggaaacttaagggttaacctttttaccgtaacccgttacccttaacccgtaaaccccgtaagttacccggtaaagtacccgtaacgggtacccgttacggtaacccgtaaccggttacccgtaaggttaaacgttaaacgttttttacggaacccttttaaaacgttttaaacgttttaacgttttaccggtaaaccgtaaaccggttacgggttaccccgtttaacccgggtttaaacccccgggttttaccccccgggttaacgggttttccccgggggaacgggggtaacccgggggttaaaccggtaacgggggttacggtaaaccgggtaaaccgttaacccgggtaaaaccgttaccgggtttacgggttaaccgggtacccgtttaaccggaccccgttaaccgttacccgg

SEQ ID NO: 254378 - DNA, 832 bp, Homo sapiens
  misc_feature: GYAE6OF02FF6SY.21.39.D06.1.454.CMB.1.raw
  modified_base (108)..(108): a, c, t, g, unknown or other
  misc_feature (108)..(108): n is a, c, g, or t
tcagtcgtcgctcgcacgaccggtgctcgatttagtgacatctcgcagttctttgggggcaggagtcagacccagtcaggacacagcatggacatgacgggtccccgntcagcctccgtggggcctcctgctgctctggttcccaggctccagatgcgacatccagactcgacccagtcctccatccctcgtgtctgcgtctaggtaggacgacagacgtccaacctatccgtacgtttgggccgggacgtacgtcgtagggttaacttacgcaggtccgttaggttaccgtcccgttaggttactacgaacggaccgaaacggtaaaacccggaacgggggtaaaacctaccccccgtaaaaaccgttccgtagtaactacgttaagtcgcgttacgacctacgttaccgttaaggtttaacgggaaaggttcccgggtacctacgtacgtaaacggttccgaacggtccggtactagggtcgtaacggttacggtacggggtaacctaaggttaccttttacctaccgtaccttaaccaaccgtacgtaccaccggaccgtaccgtacccgtacgaccgtaacggtaccgttaagttaacgttacgtttaccgtaacctttaaccgttttagtaaccgtttacgtaaaccgtaaccgttaccggttacccgttacccggtttaacccccgggtttacccgggttaacccggtttccgggggaaccggtaaccgggtaaccggttaaaggggaccggtaaacgtaaccgttaaaccggaaaccggttaccggttacggtaccggtacgtaccgacccgttaaccgttacgg

SEQ ID NO: 254379 - DNA, 790 bp, Homo sapiens
  misc_feature: GYAE6OF02JML9I.21.39.D06.1.454.CMB.1.raw
  modified_base (202)..(202): a, c, t, g, unknown or other
  misc_feature (202)..(202): n is a, c, g, or t
  modified_base (331)..(331): a, c, t, g, unknown or other
  misc_feature (331)..(331): n is a, c, g, or t
  modified_base (770)..(770): a, c, t, g, unknown or other
  misc_feature (770)..(770): n is a, c, g, or t
tcagtcgtcgctcgcacgaccggtgctcgatttagtgacatctcgcagttctttgggggcaggagtcagacccagtcaggacacagcatggacatgaggggtccccgctcagctcctggggctcctgctgctctggtcccaggctcagatgcgacataccagactcgaccctagtcctccactccgtccgtgtctgtccgtntggtagagtacagatccacatctagtcggtcggacgtagtcggaaggttatacgctaggtcgtaggttacgacgtgtactgacgacgaacgtaaaccgaagggaacctaccccgtaaacgttccgtaanacgttacaacgtcgtccgtagtcctaactccggttaaagggttacggtaacggtccggtaaccctacggttaccggtaaggttaccgaccgggtacggttccggaaggttcggaacttcgggtaaggtactacgttcgttaccaccgttacacccgtaactactacggtacgaccgttccggaccgttacgaccgtacggttaaccgaacgtttacgtttaaagtttaccgtaacccgtttaaagttttaccttacggtttaacccgaacgttaaccggtaccggtttaccccgggttacccgggttttaaacccccggtttcccgggttaacgggttacccggggtaccggggttaggtaaaccccggggtggggttaaaccgttaccggtaaaccggttaaacgttaaccggtacggttacgggacggttaaccggngtaacccgtacgttaaccgg

SEQ ID NO: 254380 - DNA, 649 bp, Homo sapiens
  misc_feature: GYAE6OF02GLEZB.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctgggctcctgctgctctggttcccaggctccagatgcgacatccagatgacccagtctccatcctcgtgtctgcgtctgtaggagacagactccaccatcacgttggcgggcgagtcgagggtatagcagctggttacgcctggtactcacggacaacggaaaccgagggaaactcccctaaatcctagactcgtatgctgctactactaggtttaggaaggtcgggtaccagttacgaacggttcacggcggacgtaggtggtactcggagggactaagtcttacctactctaccacctatccgtaagcgtacgtacccgtacgccgacgtccgttagtaaacggttctttacgaaccttaaacttttagttaactttacggtaacctaaacggtcgtaccctttacccggtacccggttttacccccgggtagttacccggggacggtaacgggtaaccgtaagggtacggtaacgtaccgttaaacggaaaccttcggttcggtacgtaccggtacgtaccgtaccttacg

SEQ ID NO: 254381 - DNA, 664 bp, Homo sapiens
  misc_feature: GYAE6OF02GEYKI.21.39.D06.1.454.CMB.1.raw
  modified_base (202)..(202): a, c, t, g, unknown or other
  misc_feature (202)..(202): n is a, c, g, or t
  modified_base (460)..(460): a, c, t, g, unknown or other
  misc_feature (460)..(460): n is a, c, g, or t
  modified_base (509)..(509): a, c, t, g, unknown or other
  misc_feature (509)..(509): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatcgacccagtctccatcctcgtgtctgcgtctgtagganacagagtcaaccatcacgttggtcgggacgagtcgaaggtattagcagcgtaggttacgcctaggtactacgagaccgaacggaaaacccgaaggggaaaaccgaccccgtaaaacgtccctagactactaatcggactacgactactaccgtaggttacgggtaaacggttcgggtaccctagtacgtaacggttcgaacggcggtacgtaggtaggacgttacggtagggactagtactttcactctaccactacncgacgcacggcctcgacacgtctagtaagtactttcgaacttaagtttnttacgttacgtaacgtaacgtacggtaccgttacccgttacccgggttaccccgttacgttacccgggacgggtaccgggtaacgtaacgggtacggaacgtaaaccgtaaccgtaaacggtacgttcgggtaggtccgacgtaccgacgttacg

SEQ ID NO: 254382 - DNA, 681 bp, Homo sapiens
  misc_feature: GYAE6OF02JQLO9.21.39.D06.1.454.CMB.1.raw
  modified_base (199)..(199): a, c, t, g, unknown or other
  misc_feature (199)..(199): n is a, c, g, or t
  modified_base (254)..(254): a, c, t, g, unknown or other
  misc_feature (254)..(254): n is a, c, g, or t
  modified_base (462)..(462): a, c, t, g, unknown or other
  misc_feature (462)..(462): n is a, c, g, or t
  modified_base (649)..(649): a, c, t, g, unknown or other
  misc_feature (649)..(649): n is a, c, g, or t
tcagtcgtcgctcgcacgaccggtgctcgatttagtgacatctcgcagttctttggggcaggagtcagacccagtcaggacacagcatggacatgagggtccccgctcagctcctggggctcctgctgctctggttcccaggctccagatgcgacatccagatgacccagtctcatcctccgtgtctgctctgtaggancagacgtcaccattcactttggtcgggcgaatcgaggtacttagcagctggttanccgttaggtactcaaggctaacgaaaccgtaggggaaaccacccccgttaaaactccctagtatccgtaatcggactacgctacctaccgttagttttagggaaacggttcgggttacccagttacgaaagggtttccagggtacggtcgaacggtgtaacgttcgacgggtaataggttacttactaacgtcctaccgtaaaccctntaccgagcacgtcccgtagcacgtccttaggaacgttagttttcgaacgttacttatttacgttacgtaactaccgaacggttcctaaccgttacccggggtttaccccgttacggttcgggtaccgggtaccgggaaaccgttcggggtaaccggtagtaaaccggtaccttaaaacccgggtacngggttcccggagttacccgtaccaccgtaccg

SEQ ID NO: 254383 - DNA, 854 bp, Homo sapiens
  misc_feature: GYAE6OF02IOL5O.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctgggctctgctgctctggtcccaggctccagatgcgacactccagatgacccagtctaccatcctccgtgtcctgcgtctgtaggagaccagacgtcaaccatcacgttcgtccgggcgtaacgtcgagggtattagcagtcgttaggttaacgccgttaggtattcgagccgaaggaaaacccgaacgggggaaaccgaccccccgtttaaaaacgtccccgtaggtaacttccttaagtcggaccttacggaccttaacgttacccgtaaggttttaagggaaacggttccggggttaacccaacgttaacgtaaacggtttaccgacgggaccggggtacgtaacgggttacgggtacgttaaccggttagggggaaaccctttaaggttaaccgtttttaccgacccgttttaaccgtacccctaacccgtaaacttacccggtaaacgtacccgtaacggttacccttcgggaccgttaacggtacccgttaaggttaacgttacgttttacgaaccgtttaaacgttttaacgtttaacgtttccgttaaccgaaaccgtttaacgtcccgtttaccggttacccccggggttttaccccggttaaccgggttttcccgggacgggggtaaccggttaacccgggtaacgggtaacggtaaacggttaaccggtaaccgttaaaaacccggtacgttacgggtacgtaccgttacggaccgtacccgttaacg

SEQ ID NO: 254384 - DNA, 780 bp, Homo sapiens
  misc_feature: GYAE6OF02JXNGF.21.39.D06.1.454.CMB.1.raw
tcagtcgtcgctcgcacgaccggtgctcgatttagtgacatctcgcagttctttggggcaggagtcaggcccagtcaggacacagcatggacatgagggtccccgctcagctcctgggctcctgctgctctggttcccaggctccagactgcgacatccagatgacccagtctccatcctcgtgtcctgcgtctgtagagacagagtcaccatcactttggcgggacgagtcagggtattagcagctggtagccttggtatccgagtcgagaaaccgagggaaacgtaccccgtaaatcctaggacttactagtcgactgacctaagtccccgtaaggttttggaaaacggtcggggttaccccaaagttcgtaaacggtttaccgaggccggtacgtaaggttacggggtaaacttcggttacgggggtaactacgggttaaactttttccgaacgtttcccgtacctaaaccgtacgttaacgacggtacgaaccgggtcccttaggtccgtaaacggtccccgtttaaggaaaaacggtttcgtttttacggaacctttaaaacccgtttttgtttaaaccgtttacgggtaccctaaaacggtcggttaaccctttacccggggttaaaccccgttttcccccggggttaacgtttacccgggtccgggaaacggggttacccgtaaaggggtttacccggaaggtaaccgttaccgtaaaaccggtaaccgttcgggtaaccgggttactaccgggaaccgttaacccgtaacgg

SEQ ID NO: 254385 - DNA, 910 bp, Homo sapiens
  misc_feature: GYAE6OF02G2H2F.21.39.D06.1.454.CMB.1.raw
tcagtcgtcgctcgcacgaccggtgctcgatttagtgacatctcgcgagttctttgggggcaggagtcaggcccagtcaggacacagcatggacatgagggtcccgctcagctccgtggggctcctgctgctctggttcccaggctccagatgcgacatccagatcgacccagtcctccatcctccgtgtctgcgtctggtaggagactagactcaccgatctacgttggcgggacgtacgttcgaagggttacttaggacgacggtcgtggttacgtcgtacggtatcgtagcgtaacgaaaccgacgggaaacgtacccctaaacgtcctacggtactaccgtaacgtcgtacgtcgacgtactaccgttacggttacgggtaaacggtgggtacccccctagttaccgtacggttccggacggtaccggtacgtaggtacggtacgtacggttaacgggtacgtacggtacgttttaccgtaacccgttaccgtaaccgtaacccgtaaccgtaccgtaacgggtaccctaacggttaccccggaccggtaaccgttaacggtacccggttaacggttaaaccgggtttacgttttaacccgggttacctttaaacgttttaaaccgttttaacggtttaaccgtaaccgttaaaccggttaccgggttaacccgtttaccggggtttaccccggttttaccccgggttaccgggttttacccggggtaccggggggttaaaccggggttaaacccgggtaaaccggggggtttaacccggggtttaaacccgggtaaacccggtttaaacccgggtttaaaaacccgggttaacccggttaacggggttttacccgggaaacccgggttaaccgggtaaccccgttaacccggttttaaccccggg

SEQ ID NO: 254386 - DNA, 718 bp, Homo sapiens
  misc_feature: GYAE6OF02IOBA0.21.39.D06.1.454.CMB.1.raw
  modified_base (107)..(107): a, c, t, g, unknown or other
  misc_feature (107)..(107): n is a, c, g, or t
tcagtcgtcgctcgcacgaccggtgctcgatttagtgacatctcgcagttctttgggggcaggagtcaggcccagtcaggacacagcatggacatgagggtccccgntcagctccgtggggctcctgctgctctggttcccaggctccagatcgcgacatccagatcgacccagtcctccactcctcgtgtctgcgtctggtaggagacagacgtcacctatcctacgttggtcgggcgtagttcggaagggttaattaggacgtaggtcgttagggttacgccgttaggtactaccgagacgaaacggaaaccgtaggggaaaacctaccccgttaaaacgtccgtagtaacttacgtagtacgtcgtacgaccgttaactaccgttaagggttttacgggaaacgggttcccgggtaacccctaagttaccggtaaacgggtttccgacgggtaccggtacgtaaggtcggtaacgtaccgggtagggaactaggtttacctttacaccgttactacctaacctcgtacgtacgacgtacgtactcgaaccgtacgtaccgttaagtaattacgtttacaacctttactttaacgttagtaccgtacaacggtacgttcgtacccggttacccgttcccgtagttcgggaccgtaaggacgaagggtacgacgtacgtaacgaacgtcgtacggtcgtacgtacaccgtacttacg

SEQ ID NO: 254387 - DNA, 734 bp, Homo sapiens
  misc_feature: GYAE6OF02FINMV.21.39.D06.1.454.CMB.1.raw
  modified_base (274)..(274): a, c, t, g, unknown or other
  misc_feature (274)..(274): n is a, c, g, or t
tcagtcgtcgctcgcacgaccggtgctcgatttagtgacatctcgcagttctttgggggcaggagtcaggcccagtcaggacacagcatggacatgagggtccccgctcagctcctggggctcctgctgctctggttcccaggctccagatgcgacatccagatgacccagtctccatcctccgtgtctgcgtctgtaggagacagagtccaccatcacttggtcgggcgagtcgaggggtattagcagctggttagcctggtatcgagcgaanaaaccgagggaaacgcccctaaaactcctagactctatcgactgcatccgtaagtttacggaaacggtcgggtaccctagtaccgaaggtttaccaggtccggactaggtaggacttcgaggggtacctaggtactttacgtaccgttacctacccgtaaccctacttaccgtaacgaccgtaaccgcccgttagacccgtacgtaccccgttaggttaaaccgttacgtttttacggaccttaaactttttaagtttaaccgttttacgtaaccgtaaacggtacggttacccgttaccgtttaaaccccgggttttcccccgggtaacgtttttacccggggacggggtaacgggtaacccggtaaacggggttcgggtaaaccggtaacgttaaacccgaaaacgggttaacccttaacgggttccggggtacctacggtaccctaacccgttaacg

SEQ ID NO: 254388 - DNA, 725 bp, Homo sapiens
  misc_feature: GYAE6OF02GHIOY.21.39.D06.1.454.CMB.1.raw
tcagtcgtcgctcgcacgaccggtgctcgatttagtgacatctcgcagttctttgggggcaggagtcagacccagtcaggacacagcatggacatgagggtcccgctcagctcctgggctcctgctgctctggttcccaggctccagatgcgacatccagactcgacccagtcctaccattcccgtccgttgtccgtagcgttacgtggtaaggacgactaggtacgtaccaaccgtatcctacggttggtcgggacgagtcggtaggtactgcagtcgtaggttacgccgttggtactcgacgacgaaacgaaaccggaacgggtaaccctaaccccttaaacgtccgtataacttacgtactcgcctagacctacgttacggttaaggttagggtaacggtccggtacctagtacgtacggtcgacggtcgacgtacgttggacgtcgggaagtacttattaccgttactaaccgtcaaccgactacgtacgacgacgtcgttacccgagaccggttaacgtccgtaagtttaacttacgtttactaaccttaagtttacttaacgtacggtaactaccggtaccgttacctttaccccggttacccgggtttaacctacggggttacgggtaccggtaaccggtaacgggtaaggtaacgtaacccaaggttaacccggaaggtttcgtcggtaacccgttcaaccgttaccgactttacgg

SEQ ID NO: 254389 - DNA, 736 bp, Homo sapiens
  misc_feature: GYAE6OF02IDQDD.21.39.D06.1.454.CMB.1.raw
  modified_base (229)..(229): a, c, t, g, unknown or other
  misc_feature (229)..(229): n is a, c, g, or t
  modified_base (309)..(309): a, c, t, g, unknown or other
  misc_feature (309)..(309): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtgtgtaggagacagacgtcaccatcacgttggcgggngagtcgaggtattagcagctggttagcctgtatcgagcaacgaaacgagggaaaccgacccctaaactccgtagactatntgactgctagtccgtaggtttacggaaacggttcgggtaccctagtacgtaacggttcgacggtccggagtacggtaggtacgtcggtaggtaacgagttacgttttaccaccttaccgtacctacgactacacgcgaaccgtccgtacgaccgttacggtacccttaaggtaacgttttacgtttacgtacctttaaattttactttaacgttacgttaaaccgtaaaccgtaaggttaccccgttaccgggtttaaccccccgggttttacccccggttacggttttaccgggaccggggttaaaccggggtaaccggtaaacggggttaacggtaaaccgggttaaccgttaaaccgtaaaaaccgggttacggttacggggttaccgtacccgggtttaacgaccccgtttaaccgttaaccg

SEQ ID NO: 254390 - DNA, 701 bp, Homo sapiens
  misc_feature: GYAE6OF02G6ODT.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatcgacccagtctccatcctccgtgtctgcgtctgtaggagacagagtcaccatcacttgcgggcgagtcaggtattagcagcgtggttacgccgttggtatcgagcgaagaaaccgaagggaaacgacccctaaactcctgactctatcgactgcacgtctaggtttagggaaacggttcgggtaccctaagtacgtaacggttacgacggtacggacgtaggtaggtacgttacggttacgggaacgtaagttaactttaccaccgttccgtacccgaacctacgtaccgacgtacgtaccggtcctacggactaaccggcgttacggtaaacgtttacgttttacgaaccttaattttaacgtttaacgtttacgtaactaaacggtacggttacccgttacccggttaaccccggttttccccgggttaacggtttcccgggacgggtaaccggtaaccgggtaagggttaccggtaaacgacgtaacccgtaacggtacgttcggtacggtaccgtacgtaccgtaccgttacg

SEQ ID NO: 254391 - DNA, 754 bp, Homo sapiens
  misc_feature: GYAE6OF02FGU3U.21.39.D06.1.454.CMB.1.raw
tcagtcgtcgctcgcacgaccggtgctcgatttagtgacatctcgcagttctttggggggcaggagtcagacccagtcaggacacagcatggacatgagggtccccgctcagctcctggggctcctgctgctctggttcccaggctccagatgcgacatccagatgacccagtctccatcctccgtgtctgcgtctggtaggagacagagtccaccatcacgttgcgggcagtcgaggttatagcagctggttacgccgtaggtatcagacagaaaccgagggaaacacccctaaactcctgactactatgctgcctacgtccgtaaggtttagggtaaacggttcggggtacccagtacgtaaggttccgaggtcggacgtaggtcggtatcggtagggaactagtactttccgtactacctaccacctacgtaccgagaccgtaacgtcccgcgtaccacgtacccgttaaggtaaacgtttacgttttacggaacctttaaacgttttaactttaacgtttacgtaccgtaaacgttaaccgggttccttaaaccccggtttaaccccgggttttaccccccgggttaaccgggtttttaccccggggtacgggggtaacccggggttaacccgggttaaacgggggttacgggtaaaaccgggttaaccgttaaccggtaaaaaccgggttaaccggtttacgggttaccggggttaccggttaccgggacccgtaacccggtttaaccg

SEQ ID NO: 254392 - DNA, 796 bp, Homo sapiens
  misc_feature: GYAE6OF02HKCRG.21.39.D06.1.454.CMB.1.raw
  modified_base (151)..(151): a, c, t, g, unknown or other
  misc_feature (151)..(151): n is a, c, g, or t
  modified_base (164)..(164): a, c, t, g, unknown or other
  misc_feature (164)..(164): n is a, c, g, or t
  modified_base (190)..(190): a, c, t, g, unknown or other
  misc_feature (190)..(190): n is a, c, g, or t
tcagtcgtcgctcgcacgaccggtgctcgatttagtgacatctcgcagttctttgggggcaggagtcagacccagtcaggacacagcatggacatgacgggtccccgctcagctcctggggctcctgctgctctggttcccaggctccagntgcgacatccagntacgacccagtcctccactcctcgtntcgtgtctcgtagtaggagacgagacgtcaccattccacgtttggaccgggacgtagtacggtaagggttacttaggctaggtcgttggttacgccgttaggtactacgacgtacgaaacgaaaccggaacgggtaaaccgtaccccttaaaacgtcctagtaaccttactacgtcgtcgttacgaccgttaacgttacccgttaagggttaaacgggtaacggggttacccgggttacctaaacggttaccgttaaacggggttaccgtaaccggggtcggtacggttacggggtacggtaacgttcggggtaaaccgggtaacgtttacgtttaacctttacccgttaccgttaaccctacccgtaaaccgtacgttaaccgtaacggaccgtaaccgttcccgggttacaaccggttcccgtaacgttaaacggttaaacggttttacgttaccgtaactttaacgtttacgtttacgttacgtaaccgtacgtccggtaccttccgggttaccccggttaccgttacggtacgggacgggtacgggaccgaagggtcgaacggtaactaacggacgtacggtgcggtactcgacctcggtac

SEQ ID NO: 254393 - DNA, 740 bp, Homo sapiens
  misc_feature: GYAE6OF02H20RI.21.39.D06.1.454.CMB.1.raw
tcagtcgtcgctcgcacgaccggtgctcgatttagtgacatctcgcagttctttggggggcaggagtcagacccagtcaggacacagcatggacatgagggtccccgctcagctcctggggctcctgctgctctggttcccagggctccagatgcgacatccagatgacccagtctccatcctccgtgtctgcgtctagtaggagacagacgtacaccatcgacgttggtcgggacgagtcgagggtacttagacgagcgtggttacgccgtggttatcagacgaacgaaacgaacgggaaacgacccctaaactacctagtactactatgctgactagtacgtaggttaaggaacggttcggggtaccctagtacgtaaacgttcgaggtcggacgtaggtaggtactcggtagggacgtacggttaactttaccgtacccgtcttacccgaaccctagtaccgaggtaccgaacggtcccgtacgacgaaccggtacccgttaaggtaaacgtttacgttttacgtaacgtttaaaccttttaagtttaaccgttacgttaacccgaaaccggttaaccggttacccgttacccggtttaaccccggggttttccccgggttaccggttttaccggggaccgggtaaccgggtaaaccgggaagggttaacgggtaacgtaactaaaccggtaaaaccgacggtttacggtacggtacggtaccgtccgtaccttacg

SEQ ID NO: 254394 - DNA, 594 bp, Homo sapiens
  misc_feature: GYAE6OF02G83E2.21.39.D06.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatccctccgtgtctgcgtctgtagganacagagtcaccatcacttggtcgggcaggtcgaggtattagcagctggttatccgtggtatcagcaagaaaccgagggaaacacccctaaactcctagactctatgctgactatccgtagtttaggaaacggttcgggtacccagtacgtaaggttccaggcggactaggtgtactcggtagggactagttactttcctactctaccacctatacagcgacgcctgcctacgccttagaacgttattttacgacttaactttattacgttacgtacaacgtacgccgttaccgttacccggtttccccggtacgttccggaccgggtacggaaccgtaagggtacggtagtaacgtacgaacgtacgttggtacgtcgtcgactacgtacg

SEQ ID NO: 254395 - DNA, 792 bp, Homo sapiens
  misc_feature: GYAE6OF02JGKRS.21.39.D06.1.454.CMB.1.raw
tcagtcgtcgctcgcacgaccggtgctcgatttagtgacatctcgcagttctttgggggcaggagtcagacccagtcaggacacagcatggacatgaggggtccccgctcagctcctgggctcctgctgctctggttccaggcctccagatgcgacatccagatcgacccagtcctccactccctccgtgtctgccgtctaggtaggagacagtagtcaccagtccacgttggtcgggcgtaggtcgaggggtattagcgagtcgttggttacgccgttggtaatccgaacgtacgaaacggaaaaccggaacgggtaaacccgtaccccccgttaaaacttcccgtagtaacgttaccttagtcgtccgtacgtacctacgttacccggttaaggtttacggggtaaacggttccggggtaccctaagtacggtaacggttacgacggtcggacgtagggttacggagttaccggtacgggaacgttacgttaccgtttccaaaccggtttccctacccgaaacctagttaccgaacggtaccaaccggtccgtaccggtactaaccggtaccgttaaggtaacgtttacgttttaccgaaacgttttaacttttaagtttccgtttaacgaacccgtaacgtaccgggttacccgtttacccggttacccccgggtttaaccccgggttacgttccggggtaccgggtaacggtaacccggtaggggaccgtaacgtaaccgtaacctaaccgggttatacggtccggagtcccggtacctacgttaccg

SEQ ID NO: 254396 - DNA, 796 bp, Homo sapiens
  misc_feature: GYAE6OF02H3YQY.21.39.D06.1.454.CMB.1.raw
tcagtcgtcgctcgcacgaccggtgctcgatttagtgacatctcgcagttctttgggggcaggagtcagacccagtcaggacacagcatggacatgacgggtccccgctcagctccgtgggctcctgctgctcgtcggttcccaggcctcagatgacacatccagatcgacccagtcctccactcctcgtgtctgcgtctggtaaggacactagacgtaccactatccacgttggccgggatacgtcgtagggttacttagcgacgtcgtggttacgccgttaggtactaccgacggtacgaaacggtaaaacccggaacggggtaaacctaacccccgttaaaacgttccgtaggtaacttaccgttaagttccggtaccgttacggaaccttaccgttaccccggttaagggtttaaacgggaaaccggggtttcccgggtaaaccctacggttaacggtaaacggttccggtaacggcggtaacgtacggtacggtacgtacgggtacggtaactacggttactttccgacttccgtaaccgtaacctacgtacgacgtacgacgtaccgtacgtaccgtacgtaccgttaagtaacgtttacgtttacgaacctttaaatttcgttaagttaccgaacgtaaaccgtccgttacccgttacccggttacccgggtttccccgtacgggtttacccgggaacgggaacgggtaccggttaagggtaccgtaacggttaaccgtaaccggaacgttaccggtacggtccgtacggtaccgacctacccgtttag

SEQ ID NO: 254397 - DNA, 625 bp, Homo sapiens
  misc_feature: GYAE6OF02FMXCP.21.39.D06.1.454.CMB.1.raw
  modified_base (283)..(283): a, c, t, g, unknown or other
  misc_feature (283)..(283): n is a, c, g, or t
tcagtcgtcgctcgcacgaccggtgctcgatttagtgacatctcgcagttctttggggcaggagtcaggccccagtcaggacacagcatggacatgagggtccccgctcagctcctggggctcctgctgctctggttcccaggctccagatgcgacatccagactgacccagtctccatcctccgtgtctgctctgtaggagacagagtcaccatcacttgtcgggcgagtcagggttatagcagctggttagcctggtatcagcaagaaaccgagggaaacnccccctaaaactccgtagatactatcgctgcctaacgttccgtaggttaggtaagttcgggtacccagttacgaagggttccagggcggtactagtaggtattcggagggtaacagttaactttccgacgttctcctaaccgtctacgaacgcgaccgtcccaggtccacgtccgttacggtaagttctttacggacctttaaacgtttaattacttgtaaccgacgtacgtaccttccgttaaacccggtttcccgacgtttcggaccgggtacggaccgtaagggtgaacggtacgtacgtaacgttaccgtcggtacggtaccgtcgtacctagtaacg

SEQ ID NO: 254398 - DNA, 754 bp, Homo sapiens
  misc_feature: GYAE6OF02GQI27.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctccgtggggctcctgctgctctcggttcccaggctccagatgcgacatccagatcgaccctagtcctccatcccgtccgtgtctgcgtcgtggtaggagacagactccaccatcgacgttggcgggcgacgtcgagggtatagcagtcgtaggttacgcgtgtactcgagacgaaacgaaaccggaaggaaacccgtacccccttaaaacgtccgtagtaacttacgtactacggtactcgtacctaacgttaccggtaagggtttaacgggaaacgggttccgggtaccctaagttaccggtaacggttacgacgggtacggtagtagggtacggtacgttacgggtacggggtaaccttaacggttaccttttacccgtacccttaccgtaacctaacctacgttaccggacgtaaccgtaccggtcccgtaccgtacgtaaccggtaccgttaagtaacgtttaactttaccgaacttttaaactttgttaacgttaccgtaacgtaacggtcgttacccgttaaccccggtttacccgggtttcccggtacgttccggggacggtaccggtaacgggtacggtagtaacgtaacccgagtaacccgtaggtcggacgtaccgtacgtacctacgttcg

SEQ ID NO: 254399 - DNA, 705 bp, Homo sapiens
  misc_feature: GYAE6OF02IIH5I.21.39.D06.1.454.CMB.1.raw
  modified_base (277)..(277): a, c, t, g, unknown or other
  misc_feature (277)..(277): n is a, c, g, or t
  modified_base (493)..(493): a, c, t, g, unknown or other
  misc_feature (493)..(493): n is a, c, g, or t
tcagtcgtcgctcgcacgaccggtgctcgatttagtgacatctcgcagttctttgggggcaggagtcagacccagtcaggacacagcatggacatgagggtccccgctcagctcctgggctcctgctgctctggttcccaggctccagatgcgacatccagatgacccagtcctccatcctccgtgtctgcgtctagtacggagacagacgtccacctattccaacgtttggtccggggacgtaggtcgaagggttattaggcagtcgtgggttacnccgttaggtatcgaaggcaaacggaaaccgaaggggaaacctacccccttaaaacgtccgttagacttacttaagtcggtctacgacctacttaccggttaagggtttacgggaaaacggtccgggttacccctaagtacggtaaaggttccaacgggtcggtactagggtagtactcggtacgggaactagttacttacgaccttcgtacaaccngtacacgtcgactccgtgacgtacgtcgtaagtaattacgttgacctttaaagtttattgttacgaactaccggtacgttccgttacccggttacccggtttaccccgggtagtttacgggaccgggaaggggttaaccctaaggggtaccggtagtaaaccgttaacgaaaccgggtcttacgggtccgttaacgactaccgaccgttacg

SEQ ID NO: 254400 - DNA, 740 bp, Homo sapiens
  misc_feature: GYAE6OF02JVBX0.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacagtccagatcgacccagtctccatcctcgtgtctgccgttactaggaggacgacaggtacgtccacctaagtccaccgtttggtaccggggctaaggttccgtaaggggttattaggaccgaggtccgtttggggttaactacccggttgggtaactttccgaacggacccgaaaaggaaaaccccggtaaggggaaaacccggtaccccccttaaaacggtcccgtaaaggtaccgttaccgtaagtccgtacgtcggtaacacgtttaccgtaaggtttacgggtaaacgggttcgggtacccctaagtacgtaacggttcgaacggtccggagtaacggtggtacttccggtaggggaactagttacgttttaccgacgtttacctaccgaacctatacgacggtactaggtccctagcctaaggtcctaagaacgtttgttaacgtacttaaagtttcgttaattgtaccaacgtagtctaaccggttccgttacccgtagttccggacggtaccgttaaggacggtacggtaatacgtaccgtaaaggtcgttaaggcgttaccgcgtaccaaccgttg

SEQ ID NO: 254401 - DNA, 770 bp, Homo sapiens
  misc_feature: GYAE6OF02FW1OT.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctcgtggttcccaggctccagatcgcgacatccagatcgaccctagtcctaccatcctccgtgtctgcgtctggtaggagacagagtccaccatcctacgttggtaccgggcgtagtcgagggttattagcagtcgttaggttacgccgttggtactacgacgacgaaacgaaaccgaacgggaaaccgtaccccctaaaacgttcccgtagtactaccgtaatcgacctcgactacgttaccgtaaggtttacgggaaacggttcgggtaccctaagttacgtaaacggttcgaggtccggacgtaagggtggtaacgttaccggtacggggaactacggttactttaccgaaccgttaccctacctaacccgtacttaccgacgaccgtaccgacccgtacgtaccgacgttacccgttaggtaaacgtttacgtttttaccgaacctttaaacgtttttagttaactttaggttaacccgtaaacgtacggttccgttaacccggttaccccggttttaccccgggttacgtttccggggaccgggtaaccgggtaaccggtaagggtaaggtaaccgtaacgttaaacccggtaaacggtacgtacgggttccggacgtaccgacgaacccgttacg

SEQ ID NO: 254402 - DNA, 764 bp, Homo sapiens
  misc_feature: GYAE6OF02GL3CX.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatcgacccagtctccatccgtccgtgtctgcgtctgtaggagacagacgtcaccatcacttggtcgggcgagtacgaggtatagcagtcgtggttacgcgtaggtactcgacgcgaacgaaaaccgaacgggaaaccgacccccgtaaaactcccgtagtactactaagtcgctcgactactccgtaaggttagggaaacggttccgggtaccctagtaccgtaaggttcgacgtcgggtacgtaaggttacggtacgttaccggtagggtaactaacgttacgttttacccaaccgtttacctacctaaaccgtaccgttaaccgaacgtaccgtaaccgttcccgtacgaccgtaacgtacgttaaggttaacgtttacgttttacgaacctttaacgttttaagtttagttaccgttaacgtaaaccgttacggtcccgtttaacccgggttacccccgggttttaccccggttaccgggtttaccggggtaccgggtaaccggggtaacccggtaaggggttaacggtaacgtaacccgtaaacggtaaaccggttacggtacgggttaccggtacctacggtaccccgtacttaccg

SEQ ID NO: 254403 - DNA, 749 bp, Homo sapiens
  misc_feature: GYAE6OF02IQOYE.21.39.D06.1.454.CMB.1.raw
  modified_base (263)..(263): a, c, t, g, unknown or other
  misc_feature (263)..(263): n is a, c, g, or t
  modified_base (270)..(270): a, c, t, g, unknown or other
  misc_feature (270)..(270): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggcctccagatgcgacatccagatcgacccagtcctccatcctcgtgtctggctctggtaggagacagacgtccaccatacctacgttggcgggcgagtacgaggttatagcatcgtggtanccgtgtntacgagcaaacgaaaccgagggaaacctacccccttaaaacgtcccgtaggtaacttaccgtaagtacgtacttacgacttaccgttaccgttaagggtttaacgggaaaacggggtttccggggttaaccctaacgtaaccgttaaacggggttccgacgggtaccgggacgtacgggtggttaacgttccgggtaaggggtaaccgtaacgttaccgttttacccgacctttacccttaccgtaaccctacgttaccaacgttccgaacgtcccggtacgaccgtacggaccttaggtaaacgttacgtttagaaccttaactttagtttacgtactaccgtagacgtcccgttccggttaacccggttccccgtacggttccggtaccgggtaacgggtaccggtaacgggtacgtaacggtaccgtaaccgtaaaccgtggttacggaccgtacggtacgtacccgtacgtacgg

SEQ ID NO: 254404 - DNA, 589 bp, Homo sapiens
  misc_feature: GYAE6OF02IUKU9.21.39.D06.1.454.CMB.1.raw
  modified_base (203)..(203): a, c, t, g, unknown or other
  misc_feature (203)..(203): n is a, c, g, or t
  modified_base (322)..(322): a, c, t, g, unknown or other
  misc_feature (322)..(322): n is a, c, g, or t
  modified_base (464)..(464): a, c, t, g, unknown or other
  misc_feature (464)..(464): n is a, c, g, or t
  modified_base (561)..(561): a, c, t, g, unknown or other
  misc_feature (561)..(561): n is a, c, g, or t
  modified_base (583)..(583): a, c, t, g, unknown or other
  misc_feature (583)..(583): n is a, c, g, or t
tcagtcgtcgctcgcacgaccggtgctcgatttagtgacatctcgcagttctttgggggcatgagtcagacccagtcaggacacagcatggacatgagggtccccgctcagctcctggggctcctgctgctctggttcccaggctccagatgcgacatccagatgacccagtctccatcctccgtgtctgcgtctggtagganacagagtccaaccagtcaccttgccggggcagtcagggtattagcagtgtcggtagccgtaggtatcagacaaggaaaaccaaggggaaacgtcccctaaactccctagactctagtcnctcgacatccgtaagttaggaaaggtcggggtacccaagtacgtaacggttcaacggtcggactaggtaggacgtcgtaggggaacaggtatttccaacgttctacacctagtacgagacacggcctgacctacgccgttanaacgtattttacgactaactttaagttactgtaacaacgacgtctaccgtacccgttcccggtcttcggaggtacggaacggtacgtaggtacgaanacgtaaacgcgtggcggacgtnacgtac

SEQ ID NO: 254405 - DNA, 808 bp, Homo sapiens
  misc_feature: GYAE6OF02HRUX8.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatccctcgtgtctgcgtctggtaggagacagagtccaacctatccacgttggtcgggcgtagtcgaagggttattagctagcgttggttacgccttaggtatccgagacaaacggaaaccgaagggtaaaccgtacccccttaaaactccgtagtacttactacgtgtctacgctaacgttaccgtaggtttacgggaaacggttccgggtacccaaggttaccgtaacgggtttccgaacgggtacgggtaccgtaaggggttacgggtaacgttcggtaacgggtaactaacggttacttttaccgaaccgtttaccgtaaccgtacctaacgttcgaacgtcctacggtccgtacggaccgaacggtacccgtaaggttaaaccggttactttttacggaacctttaaacgttttaagttttacgttaccggtaacctaaaccgggttaccgttaacccgttacccggtttacccccggggtttaacccccgttacgggtttacccggggacccggggtaaccggggtaacccgggtaaggggtaaccggtaaacggtaccgtaaaccgggttaaaaccgttacggttcggggtaccggtacccggttacggacccgtaccgttaccgg

SEQ ID NO: 254406 - DNA, 824 bp, Homo sapiens
  misc_feature: GYAE6OF02GPCUL.21.39.D06.1.454.CMB.1.raw
  modified_base (107)..(107): a, c, t, g, unknown or other
  misc_feature (107)..(107): n is a, c, g, or t
tcagtcgtcgctcgcacgaccggtgctcgatttagtgacatctcgcagttctttgggggcaggagtcagacccagtcaggacacagcatggacatgagggtccccgntcagcctccgtggggcctcctggctgctctggttcccaggctccagatcggcgacacgtccagtactcggacccctagtcccacctattcccgtccgtgtcctaggccgtattggtacgacgaacgacgtagtaccaaccgtactcgtaacctttggggtccggggaccgttaacgtccggtaaagggggttaactttacggaccgaggtaccgttacggggtttaaccggtccggttaggttaacgaccgtaaacggactaaaccgggaaaaccgtaacgggggaaaacctacccccgtaaaagttcccgaagtaccgttaccttagtacgtccgacgtacctaacgtacgttaaggttaacggtaacggttccgggttaacaacgtttacgaaacggttaccgaacggaccggtcgtaacgggttacgggtacgttcggaaccgggtagtaaactaccgtttacgtaaccttacgtacaacccgtataccgacgaccgtactcgaccgctacggtcctagttaacgtacgtttacaacgttaagtttaactactttaagtaacctaacggttaactaccgttacccgttaacccggttacccggttaccgttcgggtaccgttaaccgggacgttaaacgggcggttaacggaaccgttaaacgtaaccggtaacggttaacggtaccggtacgttaccggacgttacggtaccc

SEQ ID NO: 254407 - DNA, 721 bp, Homo sapiens
  misc_feature: GYAE6OF02JP1ZW.21.39.D06.1.454.CMB.1.raw
  modified_base (125)..(125): a, c, t, g, unknown or other
  misc_feature (125)..(125): n is a, c, g, or t
  modified_base (497)..(497): a, c, t, g, unknown or other
  misc_feature (497)..(497): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctccngctgctctggttcccaggctccagatgcgacatccagactcgacccagtctccatcctccgtgtctgtcgtctgtaggagacagagtccaccatcacgttgtcggacgagtcgaggttatgcgacgtcgtggttacgccgttaggtactcgaggacgtaacggaaaccgacgggtaaccacccttaaccgtccgtagactacgtagtcgtactcgtactaacgtccgttaaggttacggtaacggtcggtaccacgttacgtaaacggttcgacggtacgcgtacggtaacggtctaggtaacggcgttaagttccgttaccgtacctttaccgacctaaccgtagtaccgaacgtccgaccgtccggaacnccgtacgtaccgttagtaacgtttagttacgaacctttacgttaatttctacggtacctaaggtaccgttacgtaccgtttaaaccgttcccggtaccggttacgttacccggggaggtaacccgggtaacgttaacgggtacggtaaacccgttaacgttaccggttaacccggtaacggtttccgggtacggttttaccccgaacgggttacttaaccccgg

SEQ ID NO: 254408 - DNA, 632 bp, Homo sapiens
  misc_feature: GYAE6OF02HU5RI.21.39.D06.1.454.CMB.1.raw
  modified_base (487)..(487): a, c, t, g, unknown or other
  misc_feature (487)..(487): n is a, c, g, or t
  modified_base (513)..(513): a, c, t, g, unknown or other
  misc_feature (513)..(513): n is a, c, g, or t
  modified_base (526)..(526): a, c, t, g, unknown or other
  misc_feature (526)..(526): n is a, c, g, or t
tcagtcgtcgctcgcacgaccggtgctcgatttagtgacatctcgcagttctttggggggcaggagtcagacccagtcaggacacagcatggacatgacgggtccccgctcagctccgtggggctcctgctgctctggtcccaggctccagatgcgacactccagatcgacccagtcctaccactcctccgtgtctgcgtctggtaaggacacaggactcaaccatcacgttcggtcgggcgtacgtacgtagggtatacgcgagtcgttggttaacgcgtaggtatcgacgtacgaaacggtaaaaccggaacgggtaaaaccgtacccccttaaaacgtccgtagtaacttccgtaagtccgtacgtacgaacctacgttaccgttaagggttaacggaaacggttccggtacctaagtaccgtaaggtcgacggcgagtacggtcgaactcggtagactacgtacttcactcctactacacgtnacggctacgctagcagtcagtaattntacactattctancgactagcgtccttaccggtaccggttccgtagttcggacggtaacggtcgtaaggacgtagaacctaacggaacgtacgtcggacgtaccgactaccgagttacg

SEQ ID NO: 254409 - DNA, 717 bp, Homo sapiens
  misc_feature: GYAE6OF02HHUEY.21.39.D06.1.454.CMB.1.raw
  modified_base (148)..(148): a, c, t, g, unknown or other
  misc_feature (148)..(148): n is a, c, g, or t
  modified_base (206)..(206): a, c, t, g, unknown or other
  misc_feature (206)..(206): n is a, c, g, or t
  modified_base (540)..(540): a, c, t, g, unknown or other
  misc_feature (540)..(540): n is a, c, g, or t
tcagtcgtcgctcgcacgaccggtgctcgatttagtgacatctcgcagttctttggggggcaggagtcagacccagtcaggacacagcatggacatgagggtccccgctcagctccgtggggctcctgctgctctgtccaggctcagntgcgacatccagatcgacccagtctccacttcccgtcgtgtctgcgttctggtagganacagacgtcaccattcacttggtcgggcagtcgagggtattacgcagtcgttggtacgcgttaggtatcgagtacaacggaaaccgaaggggaacctaccccttaaactccgtagacttactagcgtctcgactagtccgtaaggttagggaacggtcgggtaccagttacggtaacggttcgagggacgtacggtagtaacgggtacttacgggtagggtaacctaggtttactttaccgacttccgtactaaccgacgttacgaccgtactaccggtcctacggaccgtacggtaccgttagtaacgtttcttttacgacctttaaagtttntttaaccgtacgttaaccaacggttaccgttacccgttaccgggtttaaccccggggtttccccgtaagggtttccggggaccggttaacgggtaacccggttaaggggacgttaaacggaacgtaaccggtaaaccggtcggttcggtacgtaccgacggttacctacgtttacgg

SEQ ID NO: 254410 - DNA, 734 bp, Homo sapiens
  misc_feature: GYAE6OF02IQR6K.21.39.D06.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagtgacatctcgcagttctttggggggcaggagtcagacccagtcaggacacagcatggacatgagggtccccgctcagctcctggggctcctgctgctctcggttcccaggctccagatgacgacatccagatcgacccagtcctcactcctccgtgtctgcgtcgtggtagganacgagtagtaccactatcctacgttcggtcgggacaggtacgagggttatacgactaggtcgttagggttacgtcgttaggtactacgagacgaaacggaaaaccgaacggggaaaacctacccccgttaaaacgtcctaagtaccttactagtacgctagtacctacgtacgttaaggttacggaacggggttccgggtacctacgtacgtaacggttcgacggtcggagtaggtacgacgttgggagggtaactaacgtttactttaccacgttaccctaccgtaacctacgtacgaccggtacacggtcgtacgacgtacggttacgtaggtaacgttttacgtttacgaacctttaagttattacgttacgaactacgtacgttacccgttacccggttaccccgggttcccggtaccgtttaccggggaacgggtaccggtaaaccggaggggtacgtaaccggtaacgtaaccggtaaaccgttacggtacgggtcgaaccgtacgacccgtacgtacg

SEQ ID NO: 254411 - DNA, 606 bp, Homo sapiens
  misc_feature: GYAE6OF02IZOAR.21.39.D06.1.454.CMB.1.raw
  modified_base (375)..(375): a, c, t, g, unknown or other
  misc_feature (375)..(375): n is a, c, g, or t
tcagtcgtcgctcgcacgaccggtgctcgatttagtgacatctcgcagttctttgggggcaggagtcagacccagtcaggacacagcatggacatgagggtccccgctcagctcctgggctcctgctgctctggttcccaggctccagatgcgacatccagatgacccagtctccatcctccgtgtctgcgtctgtaggagacagagtcaccatcacttgcgggcgagtcagggtatagcagcgtggttagcctggtatcagcaagaaaaccgaagggaaacgcccctaaaacgtcctagactctatgcttcgcaagttccagtttgggaaacggtggggtcccaatacgaaggttcaggcggcaagtggatcgngggacagtactttcgactcacacctatacagtcacgcctagcgagcctaagagtacgttttcgactaacttattagtttcgtacaacgtacgtccttaaccgttaccgggtttacccccggtacgttttcccgggacggggtaacgggtaaccgtaaaggggtacggtaacggtaacgtaaccgtaaaccgggaacgttcggttacgggcttacggaccgtacctaaccgg

SEQ ID NO: 254412 - DNA, 738 bp, Homo sapiens
  misc_feature: GYAE6OF02H8H43.21.39.D06.1.454.CMB.1.raw
  modified_base (373)..(373): a, c, t, g, unknown or other
  misc_feature (373)..(373): n is a, c, g, or t
tcagtcgtcgctcgcacgaccggtgctcgatttagtgacatctcgcagttctttgggggcaggagtcaggcccagtcaggacacagcatggacatggagggtccccgctcagctccgtggggctcctgctgctcgtggttcccaggctccagatgcgacatccagtactcgacccagtcctcctactccgtccgttgtctcgtcgtctaggtaggagacagacgtcaccataccgacgttcggtacgggctaggtacgtaacgggttattacgacgtacggtacgttggttacgccgtaggttactacgacgacaaacggaaaccgacgggtaaacctaccctaaactccgtagtactcgtagtacgtgtacnctaacgttacggtagggtttaacggaacggtacggtaccctaaagtaccggtaaggttcgacggacgcgtaggtacgtcgtacggtaggactacgttacttcgtaccttccaacgtaccagtacgtcgtaccgaccgtgacgaccgttacgacgttaagtacgttacgttacgaactttaacttatttaacgtacgtaaccgtacgtaccggttaccgttcccggttaaacccggtttccccggggtaagtttccggggaacccgggtaacgggttacggtaaacggggtaccgtaacggttaaaccggtaaaccctaacgggtaacttcggaccggtttaacggctaacccgttagtaaccccg

SEQ ID NO: 254413 - DNA, 1102 bp, Homo sapiens
  misc_feature: GYAE6OF02FLOGB.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctccgtgggctcctgctgctctggttcccaggctccagatgcacatccagatcgacccagtctccattcctccgtgtctgccgttatgtaggacgacaggacgtaccaccaatcctacgtttcgggtaccggggccgtaagtccggtaaggggttaattacggacctaaggtccgttagggtttacggaccgttagggttactccgaacggtaccgaaacggtaaaaacccggaacggggggtaaaaacccgtacccccctttaaaaaccgtcccgttacgggtaactttccgttaacggttccggtaccgtttacggaccttaaccgtttacccggttaaggggttttaaacggggtaaacgggggtttcccgggtaccccttaaaggttaacccggttaaggggtttaccgacgggtaccggtaccgggtacgggtttacgggtaaccggttaaccgggtagggggtaaccttaacggtttaccgtttttacccggtaaccgtttcccgtaaaccccgaccggttaaaccgttacccgtaaacgggtaccctttaaacccggcccggtaccggtaacccggttaaccggtacccggttaaagggttaaacccggttttaacgtttttaaacccgggtaacccgttttaaaaacggttttttaacggtttttaacccggtttaacgtttacccggtaaaaacccgtttcccgggggtttaaaccccgttttacccggggttttaaccccccccggggtttttttaacccccccggggggttaacgggtttttacccccggggggggtaacccggggtaaacccgggggttaaaaccccgggggtttaaacgggggttaaaccggggttaaaccggttaaaacccggttttaaaaccccgggaaaaccgggtttaaccgggtttacccgggggtaaccgggttaaacccggttcccgggttaaacccccgttacccgggttttaacccggg

SEQ ID NO: 254414 - DNA, 726 bp, Homo sapiens
  misc_feature: GYAE6OF02H2Z7Z.21.39.D06.1.454.CMB.1.raw
  modified_base (107)..(107): a, c, t, g, unknown or other
  misc_feature (107)..(107): n is a, c, g, or t
  modified_base (116)..(116): a, c, t, g, unknown or other
  misc_feature (116)..(116): n is a, c, g, or t
tcagtcgtcgctcgcacgaccggtgctcgatttagtgacatctcgcagttctttgggggcaggagtcagacccagtcaggacacagcatggacatgagggtccccgntcagctccngggctcctgctgctctggttcccaggtcctccagatcgcgactactccagactcgaccctagttcctacctacgttcccttccgtgttccgtagccggttctaggtagggacaacgacggtctaccaccattaccgaccgtttggccgggcgtaagttcgtaagggttacttagcgtacgtccgttaggttacgccgttaggtactcgactaccgaaacggaaaacgaacgggtaaacccgtaccccgtaaaacgtccgtagtacttacgtactcgacgtagcttaacgtaccgtaggtttacggaacggttcggtacctagtacgtagtcgaggtcggtacgtaggtgtaacgtcgggtaaggtacctaagtttaccttaccgtacccttacgacctaacctacgtacgaacgaccgtaccgccgtaacgcttacggtacctaggtagtttaactacgtaaccttaatttacgtactacgtacaacgtcgtacctacccggttaccggttcccggtagttaccggacgggaacggtaccgtaaggacgtaacgtaacgttaaccggaaacgtacggttcggtaccggacgtaccgacgttacccgtacg

SEQ ID NO: 254415 - DNA, 630 bp, Homo sapiens
  misc_feature: GYAE6OF02I6UK6.21.39.D06.1.454.CMB.1.raw
  modified_base (107)..(107): a, c, t, g, unknown or other
  misc_feature (107)..(107): n is a, c, g, or t
  modified_base (206)..(206): a, c, t, g, unknown or other
  misc_feature (206)..(206): n is a, c, g, or t
tcagtcgtcgctcgcacgaccggtgctcgatttagtgacatctcgcagttctttgggggcaggagtcaggcccagtcaggacacagcatggacatgagggtccccgntcagctcctgggctcctgctgctctggttcccaggcctccagatgcgacatccagatcgaccctagtctccactccgtccgtgtctgcgtctgtagganacagagtcaccatctacgttcggtcgggcgagtcgtaggtattagacagtcgttaggttacgccgtaggtatcgagacgaacggaaaccgaagggtaaaccgacccctaaacgtcctagtactactagtgcctgctacgtcgtagtttaggaacgtcgggtacctatacgtaaggtcgacggcgacgtagtacggtactcggtaggtactacgttacgtttacgacctactccaaccgtacgtaccacgactccgtcgtcgaccgacgtctaggtaacgttattacgtaacttacgtttattacgttcgtaactaacgaccgttaccttcccgggttacccggtttaccccggtacgttccgggacgggtacgaacggtaggtacggagtacacggaactacgaggtcgcgtacgactactacg

SEQ ID NO: 254416 - DNA, 734 bp, Homo sapiens
  misc_feature: GYAE6OF02GASZ8.21.39.D06.1.454.CMB.1.raw
  modified_base (107)..(107): a, c, t, g, unknown or other
  misc_feature (107)..(107): n is a, c, g, or t
tcagtcgtcgctcgcacgaccggtgctcgatttagtgacatctcgcagttctttgggggcaggagtcagacccagtcaggacacagcatggacatgagggtccccgntcagctcctggggctcctgctgctctggttcccaggctccagatgcgacatccagatgacccagtctccatcctcgtgtctgtcgtctgtaggagacagagtcacatctacttggtacgggctagtacgagggttattagcagtcgtaggttacgccttaggtacttacgaagacgtaaaggaaaccgaaggggaaaacgtacccccgtaaaactacccgtagtaactacgttaagtcgtactagactaagttcccgtaagtttagggaaacggttaccgggtacctaagtacggtaacggttacgaacgtacggacgtaggtagtacgtacggttagggtacctaagtacgtttacgaaccttacgtaaccgtaacctacgtaccacgacgtaccgtaccgtacggcctaacgaccgttacgaaaggttactttacgaaccttaaacgtttactttaacgttacgtaaccgtaacgtacggttacccttaacccggttacccggttaccgttacccggttaccggaaccgggtaaccgggaaccggttaaggaaccggttaacgtaacggaaaaccgttaaccgtaacggttacggtacgtacgtaacggtaccctacggttaccg

SEQ ID NO: 254417 - DNA, 795 bp, Homo sapiens
  misc_feature: GYAE6OF02IZJJO.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatcgacccagtcctccatcctccgtgtctgcgtctagtaggagacagagtccacctatcctacgttggtcgggacgtagtcgagggttattagcagtcgtggttagccgtggtatcgagacaacggaaaccgagggaaacctcccctaaagtccagactctagtcgctagtactacttaccgtaggttacggaacggtcgggtaccctagtaccgtaaggttcgaacggtccggtacgtagggtaggtacgttccgggtacgggtaactacgttaaccttttacacccgtttacgtaacccgtaaccgtacgtaccggtacgacccgtacggtccccctaggtacccgtaaccggtaccgttaacgggttaacgtttaccgttttacgaaccctttaaacgttttaacggtttacgttaccggttaaccgtaaaccggttaccgggttaccctttaaccccggggttaccccggttttaaccccccggttacggggtttccggggtaacccggggtaaccgggtaaccggtaaacggggttaacggttaaacccggtaacgtttaaccgggtaaaacccggttaccgggtttcgggtaaccggtcctaccggttaaccccgtaccgtttaacg

SEQ ID NO: 254418 - DNA, 742 bp, Homo sapiens
  misc_feature: GYAE6OF02HPWUB.21.39.D06.1.454.CMB.1.raw
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
  modified_base (257)..(257): a, c, t, g, unknown or other
  misc_feature (257)..(257): n is a, c, g, or t
  modified_base (290)..(290): a, c, t, g, unknown or other
  misc_feature (290)..(290): n is a, c, g, or t
tcagtcgtcgctcgcacgaccggtgctcgatttagtgacatctcgcagttctttgggggcaggagtcaggcccagtcaggacacagcatggacatgaggtccccgctcagctcctggggctcctgctgctctggttcccaggctccagatgcgacatccagatgacccagtcctccatcctccgtgtcngcgtctggtagganacagagtcacatcacgttggtcggganagtcgaggttattagcagcttggtacncgtgtactgagtacaacgaaaccgaagggaacncccctaaaacgtcctagactctatgtcctagactatccgtaagtttagggaaacggtccgggtacccaggttaccgtaaggtttacgacggtcggtacgagggtacgggacttcgggtaggtaactacgttacgtttaccgtaccttacccgttaccgaaccgtagtaccacgtaccgtaccgtacgttaccggtaccgaacggtccgttaagttaacgttacgtttaccgtacgttaaacctttagtttaaccttacggttaaccgaaaccggttacggtaacctttaccccgggttacccgggtttaaccccccgggttacggtttaccgggggaacccgggtaccgggttaaaacccggaaggggtttacggaaacgggttaaccgtacccggtaaaaccggttaccggttaacggggttccgttacgacgggtacctacccggttaac

SEQ ID NO: 254419 - DNA, 802 bp, Homo sapiens
  misc_feature: GYAE6OF02HD1KY.21.39.D06.1.454.CMB.1.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctcggttcccaggctccgagatgcgacatccagactcgacccagtctccatccgtcgtgtctgcgtctgtaaggagacaagacgtaccaccactcgtacttcggtacgggacgagtacgaagggttagttaacgacgtaggcgttacggttacgaccgttggttaacaccgtaaggacgaaaacggtaaaaaccggaacggggaaaacccaaccccccgttaaaaacgttccccgtaaggttaattaccgttaacgtacgtccttacgacgttaacttaccggttaacgggtttacgggaaacggttcgggttaacccctaaggtttacccgtaaaggtttccgaacgggtcggtaacggtaacggttacgggaccgtttaaccgggaagggaaccgttaagttaaccggtttaccttaaccgtaccgttaacccaaacctacgttaccgacgaccgtacgtacccgtacgacggttaaccgtaacgtaacgttaacgttacgttttaacgacccgttttaaatttacgttaacgtttaaccgacgtaaacggtccgtacgttacccgttacccggttacccgtacgttcggacgtaacgggtacgtaacggagtaacgtaacgtaacgtaaacggtacgttagggaccgttacgacgtacctaacgttcg

SEQ ID NO: 254420 - DNA, 647 bp, Homo sapiens
  misc_feature: GYAE6OF02ILJQO.21.39.D06.1.454.CMB.1.raw
tcagtcgtcgctcgcacgaccggtgctcgatttagtgacatctcgcagttctttgggggcaggagtcagacccagtcgggacacagcatggacatgagggtccccgctcagctcctggggctcctgctgctctggttcccaggctccagatcgcgacatccagatgacccagtcctccatcctccgtgtctgcgtctggtagagacagagtccaccatcacgttcggcgggacgacgtcgaaggtaattacgcgagtcgtagttaacgccgtaggtactcaagacaagaaacccgaagggaaaccgtacccctaaaacctccgtagtactaccgtagtcgctacgcctataccgtaaggttaggaacgtcggggtaccagtacgtaacgtcgagcggagtaggtggaactcgtaggaacctagtacttcactccgtacaacctagtacacgtacgaacgtcctacgcgtacgtacgttaacgtaacgttacgtttactaaccgttaaactttacgttaagtttaccgtactaaacgacggttccgtaaccgttccggttccccgtaggttaccggacgggtacgggaacgtaagggtacgaggactaacgaaacgtagtcgtacggtcgtacgacctacgacttacg

SEQ ID NO: 254421 - DNA, 739 bp, Homo sapiens
  misc_feature: GYAE6OF02JBD6P.21.39.D06.1.454.CMB.1.raw
  modified_base (697)..(697): a, c, t, g, unknown or other
  misc_feature (697)..(697): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggtcccaggctccagatgcgacatccagatcgacccagtcctccacttcctccgttgtctcgcgttctaggtaggagacaggacgtaccaaccatctacggttcggccgggacgaagttccggaaggggttattacggacctaggttacgttagggttaacgccgttaggtaactcgaacgacgaaacggaaaccggaacgggaaacctacccctaaacgtccgtacgtacctacgtacgtcggtaccgtcgtactaacgttaccggttagggtttaacggtaaaccggttccgggtaccctaaggttaaccgtaacggttcgacggcggtacggtacggtagtacttacgggtaggtaaccgtacgtttacgtttacccgacgttacctaccgtaaacgtcgacgtaccgtaccgagtcccgtaacgtccggacggtaccgttaaaggtatttaccgttttacgaaccctttaagtttaccgtttagtaaccgtagtaaccggtcgtaccggtacccgtttcccggttaaccggttcgtacgggtacgtacggaacgttaggntaacgacgaacgttacgcggttagcgaggtccacgtctacgg

SEQ ID NO: 254422 - DNA, 837 bp, Homo sapiens
  misc_feature: GYAE6OF02JJNPT.21.39.D06.1.454.CMB.1.raw
  modified_base (207)..(207): a, c, t, g, unknown or other
  misc_feature (207)..(207): n is a, c, g, or t
  modified_base (209)..(209): a, c, t, g, unknown or other
  misc_feature (209)..(209): n is a, c, g, or t
tcagtcgtcgctcgcacgaccggtgctcgatttagtgacatctcgcagttctttggggggcaggagtcagacccagtcaggacacagcatggacatgacgggtccccgctcagctccgtgggctcctgctgctctggtccaggctcagatgcgacataccagatcgacccagtcctccattccctcgtgtctgcgtcgtaggtagananagtactacacctatctacgttcgggtcgggacgtaggtacgtagggttagttcgactagtcgttagggttacgcgtaggtactacaggtacgaaacgaaaccggaacgggaaaccgtcccctaaactcgtagacttacgtagtgcgtacgactacgttaccgttaaggttaacgggtaacggttcgggtaaccctaagttacggtaacggttacgacggtcggtagtagggtagtacgttcgggaacggtactaacggttacttaccgtaaccttcctaaacctaacccgtacttaccggaacgacccgtaccggttaccgtaccgtaacgttaaccgggttaccttaaagggttaaaccgtttaggtttaaccgtaaccttttaaacgtttaaacggtttcgttaaaccgttaaacggtaaccggtaacccggttcccgtttaacccccgggtttaccccgggtttaaccccggttacgggggtttcccggggaaaccgggggttaaaccgggtaacccgggttaaaggggggtaccgtaaacggttaaaccggtaacccgggttaaaacgttcggtaccggggttaaccggttaccgtaccggttaccccgaacgttttacccggg

SEQ ID NO: 254423 - DNA, 726 bp, Homo sapiens
  misc_feature: GYAE6OF02FUCBO.21.39.D06.1.454.CMB.1.raw
  modified_base (496)..(496): a, c, t, g, unknown or other
  misc_feature (496)..(496): n is a, c, g, or t
  modified_base (543)..(543): a, c, t, g, unknown or other
  misc_feature (543)..(543): n is a, c, g, or t
  modified_base (558)..(558): a, c, t, g, unknown or other
  misc_feature (558)..(558): n is a, c, g, or t
tcagtcgtcgctcgcacgaccggtgctcgatttagtgacatctcgcagtttctttgggggcaggagtcagacccagtcaggacacagcatggacatgagggtccccgctcagctcctggggctcctgctcgctcgtggttccaggacgtccacgaagtagcgacataccgacgacgtagacccgtactcgtacctcgtcctccggtcgtcgtcgtcgtcgtagtaggacgagaacgacgacaccactactacgttacggtcgggtcgacgtcggtaggttagttaacggcacgtgttcggtacggttacctacggtagtcgtacgaactaacggaaaacggaaccgggaaaccgtaaccctaaccgtactcgtaacggtactatcgtcgtgtaccgtacgttaccgttaacgggttaagggttaaacggtccgggtaccgttaacgtacgtaacggttacggacgtacgggtacgtaaaggtcggtagttaccggnggtaaaccgtaggttaactttactaccgtcctaacctacgtactacncggactaacgtccgngtacgtccgtacgtacgtaactcggtttactacttaacttattacgttacgtacgtacgtacgttccgtccgttcccggtccggttaccggtacggtacggaccggtacggtaacgggacgtacggtaccgtaacgacgttacggacgttcgaacgtcgactgtaccg

SEQ ID NO: 254424 - DNA, 648 bp, Homo sapiens
  misc_feature: GYAE6OF02FSG51.21.39.D06.1.454.CMB.1.raw
  modified_base (434)..(434): a, c, t, g, unknown or other
  misc_feature (434)..(434): n is a, c, g, or t
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaaccatcacttggtcgggcgagtcgagggtattacgcagcgttggttacgccttggtactcgagacaacggaaaaccgaaggggaaaccgtacccccttaaactccgtgtactcttatgctgctactaccgtagtttagggaacgtcgggtacccagtacgtaggttcgaggcggcgtaggtaggatcggtaggactagtatttcactcgtaccacctagtacngtacgacgtcctgccgagtacctaggtaagtctttactacttaacgtttattagtactaccgtaaacgtacggtccgttaccgttacccgggtttaacccggtaccgtttccgggacgggtaccggtaaccgggttaaggtacgggtaacgtaccggttaaccgaaacggttaacggttcggtaaccggttcgaccggtaccgaaccgtttacg

SEQ ID NO: 254425 - DNA, 720 bp, Homo sapiens
  misc_feature: GYAE6OF02JY91G.21.39.D06.1.454.CMB.1.raw
  modified_base (104)..(104): a, c, t, g, unknown or other
  misc_feature (104)..(104): n is a, c, g, or t
  modified_base (152)..(152): a, c, t, g, unknown or other
  misc_feature (152)..(152): n is a, c, g, or t
  modified_base (200)..(200): a, c, t, g, unknown or other
  misc_feature (200)..(200): n is a, c, g, or t
  modified_base (256)..(256): a, c, t, g, unknown or other
  misc_feature (256)..(256): n is a, c, g, or t
  modified_base (285)..(285): a, c, t, g, unknown or other
  misc_feature (285)..(285): n is a, c, g, or t
  modified_base (315)..(315): a, c, t, g, unknown or other
  misc_feature (315)..(315): n is a, c, g, or t
tcagtcgtcgctcgcacgaccggtgctcgatttagtgacatctcgcagttctttggggcaggagtcagacccagtcaggacacagcatggacatgaggtcccgntcagctcctgggctcctgctgctctggttcccaggctccagctgcganatccgagatcgacccagtctcatcctccgtgtctgcgtctggtagganacagacgtccacgatcacttggtacggctagtcgaggtattagcagtctggttacnccgtgtatcagacaagaaccgagggaacncccctaaagtcctagactctagtgctgacncgtcgagttaggaacgtcggacctagtcgtaacggtcacggccgtaagtcggtacgtacgttccgagggaactaggttacgtttcgaacttaccgtacaaaccgtacgtaccgaaacgtcccgtaagcccgttacgggactacggtaccgttaaggtaagtttacgtttccgaaacgttttaaacgtttaacgtttagttaaccggtaacgaaccgggtacggttaaacccgtttacccgggttaaaccccggggtttttacccccgggtaacggttttacccggggacgggtttaaacccgggttacccgaaagggggttttacccgaagggttaaccctaaacgggtaacccgttaaggttccggtaaaccggtccgtaacgttaccccgtacgtttaaccgg

SEQ ID NO: 254426 - DNA, 881 bp, Homo sapiens
  misc_feature: GYAE6OF02GEJ07.21.39.D06.1.454.CMB.1.raw
  modified_base (154)..(154): a, c, t, g, unknown or other
  misc_feature (154)..(154): n is a, c, g, or t
tcagtcgtcgctcgcacgaccggtgctcgatttagtgacatctcgcagttctttgggggcaggagtcagacccagtcaggacacagcatggacatgacgggtccccgctcagctccgtgggctcctgctgctctcgtccagctcagatgcgacntccagatcgacctagtcctacctagtcctcggttcgtcgtgtcgttcgtagggtaaggtacgaacgagtacgtaccaacgtactacgtacgttggaccgggacgtaggtaccggtaaggttattacggacctaggttcggttacggttaccggtaccgtttagggtacctacggaacggtaccggtaaaaccggaaaacccggtaaccgggggtaaaccccgtaacccccttaaaaccggttttcccgaaggtttaaccggttaccgttaacgttaccgggccgtttaaccgacgttaaccgtttaccgggtttaaacgggtttaccgggggttaaaaccgggggttcccgggttaactaaacgggtttacgggttaaaccggttccgggtaaacgggtccgggtaaccggttaagggttccggggtaaaggttacgggtacgtaaacccgtagtttaacccgttaccgaacgttttacccaacgtaccggtaacctcgaaccgttacgtaccgtacctacggtaccgtaccgtaacgttacgggttaactttacggttactttaaaccgttaacgttttaaattcgtaacggtaaccgttacgcgttacccgtacccgggttttacccgttaaccccgggttcgtaaccgggtacgggtaacggtacggtacggacggtaactaaccggttacgtaacgtcggcgttacggctacgtactacgtcg

SEQ ID NO: 254427 - DNA, 703 bp, Homo sapiens
  misc_feature: GYAE6OF02IBO7T.21.39.D06.1.454.CMB.1.raw
  modified_base (167)..(167): a, c, t, g, unknown or other
  misc_feature (167)..(167): n is a, c, g, or t
  modified_base (173)..(173): a, c, t, g, unknown or other
  misc_feature (173)..(173): n is a, c, g, or t
  modified_base (178)..(178): a, c, t, g, unknown or other
  misc_feature (178)..(178): n is a, c, g, or t
  modified_base (529)..(529): a, c, t, g, unknown or other
  misc_feature (529)..(529): n is a, c, g, or t
tcagtcgtcgctcgcacgaccggtgctcgatttagtgacatctcgcagttctttgggggcaggagtcagacccagtcaggacacagcatggacatgagggtccccgctcagctcgtgggctcctgctgctctggttcccaggtcctccagatgcgactatccgagtngacccngtccnccactccgtaccgtgtctcgtcgtctggtaacgagacgagtacgtcaccatccgtacgttgggcggtacgtagtcggtaaggtcttaagcgtaacgtgtacggttagaccgttgtacgtacgtagacgaaacggaaacgaacgggtaaaacgtacccctaaaaacgttcctaaggataccgtaacgtgtaccgtgacttaacgttccgtaaggttacgggtaacggtaccggtaccctaagtaccgttaaggttacctaggacgggtacgtaaggttacgaacggtttacggccgggtaagtaacggttacttacgtaccgtacctacctacggaactcgagacgttaacnccgtagtcgacgtcgtaaacgtattcgttactacgactttagtacgttactcgtaacggcgtaccgtacggttccccggtaccgtacgttccgggacggttaccgaaggtacggtcgggtaacgtcgtaaccgaaccgttgtcggtaccggttacgtcgtaccggacttaaccg

SEQ ID NO: 254428 - DNA, 294 bp, Homo sapiens
  misc_feature: GYAE6OF01AYWXN.29.1.A01.1.454.CMB.1.raw
  modified_base (291)..(294): a, c, t, g, unknown or other
  misc_feature (291)..(294): n is a, c, g, or t
tcagatagagtactcacgaccggtgctcgatttagacgtctcatcagggatcccagaccgattctctggctccagctcaggaaacacagcttccttgaccatcactggggctcaggcggaagatgaggctgactattactgtaactcccgggacaccagtggtaacagtcggggagtgttcggcggagggaccaagctgaccgtcctaggtcagcccaaggctgccccctcggtcactctgttcccgccctcctcagtactctatctgagcgggctggcaaggcgcatagnnnn

SEQ ID NO: 254429 - DNA, 294 bp, Homo sapiens
  misc_feature: GYAE6OF02H1XTN.29.1.A01.1.454.CMB.1.raw
  modified_base (290)..(294): a, c, t, g, unknown or other
  misc_feature (290)..(294): n is a, c, g, or t
tcagatagagtactcacgaccggtgctcgatttagacgtctcatcagggatcccagaccgattctctggctccagctcaggaaacacagcttccttgaccatcactggggctcaggcggaagatgaggctgactattactgtaactcccgggacaccagtggtaacagtcggggagtgttcggcggagggaccaagctgaccgtcctaggtcagcccaaggctgccccctggtcactctcgttcccaccctctcagtactctatctgagcgggctggcaaggcgcatagnnnnn

SEQ ID NO: 254430 - DNA, 531 bp, Homo sapiens
  misc_feature: GYAE6OF01C7GYR.8.49.E05.1.454.CMB.1.raw
  modified_base (274)..(274): a, c, t, g, unknown or other
  misc_feature (274)..(274): n is a, c, g, or t
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctcctgtctgcatctgtaggagacagagtcaccatcacttgccggcaagtcagagcattggcactacttaattggtatcagcagaaaccagggaaacncccccaaactcctagatcaattatgacatcctagtttgacaaagtcgggtacccatacaagattcgagtggcggtgatcgtaggacagtactttcactctacacctatacaactagtctgacagtagttagaggtattatgactaacttattactgtacagtactagtacgttaccgacggtaccccgtctcgtaccgttcgggacggggtaacctaaggtcggacgtaccgaaacgacgtgacgactcgcacgtac

SEQ ID NO: 254431 - DNA, 492 bp, Homo sapiens
  misc_feature: GYAE6OF01DTWOJ.8.49.E05.1.454.CMB.1.raw
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctcctgtctgcatctgtaggagacagagtcaccatcacttgccgggcaagtcagagcattggcacctacttaaattggtatcagcagaaaccagggaaagcccccaaaatcctgatcaattatgcatccagtttgcaaagtggggtccatcaagattcagtggcgtgatctggacagatttcactctcaccatcaacagtctgcagattgaggattatgactaacttattactgtacagcagacgttccaggaccccgctcacgtttcgggacgggggtaccaaaggtcggacgtacaagaactgagctgcactac

SEQ ID NO: 254432 - DNA, 540 bp, Homo sapiens
  misc_feature: GYAE6OF01AH2B6.8.49.E05.1.454.CMB.1.raw
  modified_base (223)..(223): a, c, t, g, unknown or other
  misc_feature (223)..(223): n is a, c, g, or t
  modified_base (389)..(389): a, c, t, g, unknown or other
  misc_feature (389)..(389): n is a, c, g, or t
  modified_base (410)..(410): a, c, t, g, unknown or other
  misc_feature (410)..(410): n is a, c, g, or t
  modified_base (451)..(451): a, c, t, g, unknown or other
  misc_feature (451)..(451): n is a, c, g, or t
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccggnaagtcagagcattggcacctacttaaattggtatcagcagaaaccagggaaacgcccccaaaactccctagatcaaattatgcatccagtttgacaaagtggggtacccatcaaagattcgagttggcggtggatcgtgggaacagatttcactctcacatcaacngtctgcagattgagtattagngactaacttattactgtcagtcagacgttccagaccccgtntccgtacgtttccggggaccgggggtaaccaaagggtggtaaccgtacgaaaaacggtaccgttggtacgggtcctcggaccacctacg

SEQ ID NO: 254433 - DNA, 558 bp, Homo sapiens
  misc_feature: GYAE6OF01BWSNC.8.49.E05.1.454.CMB.1.raw
  modified_base (224)..(224): a, c, t, g, unknown or other
  misc_feature (224)..(224): n is a, c, g, or t
  modified_base (470)..(470): a, c, t, g, unknown or other
  misc_feature (470)..(470): n is a, c, g, or t
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggnaagtcagagcattggcacctacttaaattggtatcagcaagaaaccagggaaacgcccccaaaactccctagatcaaatttatgcatccagtttgactaaaggtcggggtacccatcaagtattcagtggcggtggatcgtgggactagtatttcactctacacctatacaacagtctgcagtattgaaggtattatgactaactttattactgtacagtactagtacgttccgacggaccccgtntaccgtacggtttaccggggacgggggtaacctaaagggtcggtaaccgtacgaaaacgtacgttggtacggactcgcctaccgtacg

SEQ ID NO: 254434 - DNA, 581 bp, Homo sapiens
  misc_feature: GYAE6OF01EV0MY.8.49.E05.1.454.CMB.1.raw
  modified_base (227)..(227): a, c, t, g, unknown or other
  misc_feature (227)..(227): n is a, c, g, or t
  modified_base (281)..(281): a, c, t, g, unknown or other
  misc_feature (281)..(281): n is a, c, g, or t
  modified_base (303)..(303): a, c, t, g, unknown or other
  misc_feature (303)..(303): n is a, c, g, or t
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctcccgccctccctgtctgcatctgtaggagacagagtcaccatcacttggccgggnaagtcagagcattggcacctacttaaattggtatcagcagaaaccagggaaacncccccaactcctgatcaattangcatcctagtttgactaaaggtggggtacccatacaagtacttacgagtgggcggtaggactcgttagggactagtactttacacttcctacacctataccaactagtctgacagtattagagtattatgtactaatttattactgtacagtcaaggtacgttacccgacggtacccccgtgttacccgtacggtttccggggacggggggtaaccctaaagggtaccggtaaccgtaccgaaaccgtacgtcggtacggtacgtcgtccaccgtacg

SEQ ID NO: 254435 - DNA, 565 bp, Homo sapiens
  misc_feature: GYAE6OF01DDB2H.8.49.E05.1.454.CMB.1.raw
  modified_base (299)..(299): a, c, t, g, unknown or other
  misc_feature (299)..(299): n is a, c, g, or t
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctattaaattggtatcagcagaaaccagggaaacgcccccaaatcctgatcaattangcatcctagtttgactaaaggtcggggtcccatcaaagtattcaggtggcggtggatcgtgggactaggtactttcacttctcctaccatacaactagtcgtagccagtacttggaggtatttagtgacttaacgtttattactgtacagtcagtacgttacccgacggtaccccgtcttacgaccgtttcgggggaccgggggtaaccaaagggttcggaccgtaaccgaaacgtacgtcggtacggtcctggccctaccgtacg

SEQ ID NO: 254436 - DNA, 554 bp, Homo sapiens
  misc_feature: GYAE6OF01APOHB.8.49.E05.1.454.CMB.1.raw
  modified_base (225)..(225): a, c, t, g, unknown or other
  misc_feature (225)..(225): n is a, c, g, or t
  modified_base (403)..(403): a, c, t, g, unknown or other
  misc_feature (403)..(403): n is a, c, g, or t
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctccgccctccctgtctgcatctgtaggagacagagtcaccatcacttgccgggnaagtcagagcattggcacctaacttaaatggtatcagcaagaaaccagggaaacacccccaaactcctagatacaattatgctatcctagtttgactaaaggtcgggtacccagtacaagtatcgaggtcggcggtaggatcgtaggacagtacttcactctacacatacaactgtcngacagtattagagtatatgactaattatactgtacagtcgacgtacgtccacggtacccctctacgtaccggtttacggggaccggggtaacctaagggtaccggtaacgtaccgaaacggtacgtcggtacgtacgtcgacgtacctacg

SEQ ID NO: 254437 - DNA, 540 bp, Homo sapiens
  misc_feature: GYAE6OF01EPXST.8.49.E05.1.454.CMB.1.raw
  modified_base (276)..(276): a, c, t, g, unknown or other
  misc_feature (276)..(276): n is a, c, g, or t
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcactacttaaattggtatcagcagaaaccagggaaancccccaaatccctgatcaattatgcaatccagttttgactaaagtggggtacccatcaagattcagtggcggtggatcgtgggacaggtatttcactctcaaccatcaactagtctgcagattgaggtattatcgactaactttattaacttgtactagtacaggtaacttcccgacggacccccgtcgttacctaccggtttacggggaccgggggtaacctaagggtcggacgtacgaaacgactggtggactcgcacctag

SEQ ID NO: 254438 - DNA, 788 bp, Homo sapiens
  misc_feature: GYAE6OF01CC0FD.8.49.E05.1.454.CMB.1.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatcgacccagtcctcccgccctcctgtctgcatctgtagganacagagtcacatccacttcggccggganaagtcagacgctattcggacttaactttttaaagtggtactacaaacgagacgacccgaaaggaaaaccgaccccctaaactccgtagtaacttttagtggtacgtactaccttaccgttacgtttaccggaacggtaaacgggttccggggtaaccctagttaaccggtaacggttaccgtaggggtacgtacgtaggtacgggtaacttcggggtacggggactaaggttacctttaccccgaacccctacgaacctaactcacgggtactacgttactaccggaaccgtaaacgtacgtaacgggttacctttaacgtaaccgttaacctttacctacgtacgtaccgaaggttaccgtacgttaaccgttacggtaccgggtaaccgggtccccgggttaacctaccgggtttaccggaaccggggtaacgggaaaccgggtaacggtacgggttaaacgggaccgttaacgggttaaacccgggaaaaccggttaccggttagggttacccgggaccttaaccggtaaccccttaccggtacgttttacccggg

SEQ ID NO: 254439 - DNA, 733 bp, Homo sapiens
  misc_feature: GYAE6OF01CTV1G.8.49.E05.1.454.CMB.1.raw
  modified_base (209)..(209): a, c, t, g, unknown or other
  misc_feature (209)..(209): n is a, c, g, or t
  modified_base (240)..(240): a, c, t, g, unknown or other
  misc_feature (240)..(240): n is a, c, g, or t
tcagctcgcgtgtccacgaccggtgctcgatttagagcgactagcaacacacaaagggggagtcagtctcagtcaggacacagcatggacatggacgggtcccccgctcagcctccgtggggctcctgctactctggctccggaggtggcagatgtgacatccagatcgacccagtcctcccgcccttccctgtctgcatctgtagganacagacgtccaccatcacgttcggccggganaagtcagagactagttcggacctaccttaacttaaagtttggtaactcgaagaccaaacggaaaaccgaacggggaaaacccgaccccccctaaaactccctagaactacctaaatttaactcgacctacttaccctaggtttacgaaccgtaaagggttccggggtaccctaagtacaaagtacttacgaaggtgggcgggttaggacgttcggtagggactaggtactttccgaccttcctacctaacctacgtacctaaacgtacggtactacgacgtagtagttaggaggtatttagtacgtacttaaactttagttacgtagtaccgtagtcgtaaggtaccgttacccgaccggtaccccgtacttacccggtaccgggtttccgggggaacccggggggtaaccgtaaagggtaccggtaaaccggttaaccgtaaaaccggtacggttacggtacggtacccgtaacgcccgtaaccgttaaccg

SEQ ID NO: 254440 - DNA, 824 bp, Homo sapiens
  misc_feature: GYAE6OF01CTIH4.8.49.E05.1.454.CMB.1.raw
tcagctcgcgtgtccacgaccggtgctcgatttagagcgactagcaacacacaaagggggagtcagtctcagtcaggacacagcatggacatgagggtccccgctcagctcctggggctcctgctactctggctccggaggtggcagatgtgacatccagatcgacccagtcctccgccctcctgtctgcatctgtaggagacagagtcaccatacacttcggccgggacaagtcgaagacgactagtttcggacctaacctttaaacgtttaaagtttcggttacttaccgacgaccgaacggaaaaccgaacggggaaaaccgaccccccaaaacttcccgtagtaactactaaatttacgtacgtacctaactaccgtaacggttttacggaacgtaaaacgggttccgggggtaccctaagtaaccgtaaacggttactttacggaaacgggttcggggtacgggttacgggtactttaccgggttagggtaaccgtacggttacgttttacctaccgttaccttacccgtaaccctaacttaccgtaaacgttaacgttaccgtaggtacctaacggttaagtttaggaacgggttatttacggtacgtaacttaaaccttttatttaaccgtagttaccgtaacgtacgtaacggttccgttaacccggtaccgggtacccccgtcgttacccggttacccgggttaccgggggtaacccggggtaaccgtaaacgggtaccgggtaaaccggttaacccggtaaaacggttaccggtacgggttacggtaccgtaacggtccctaaccggttaaccg

SEQ ID NO: 254441 - DNA, 739 bp, Homo sapiens
  misc_feature: GYAE6OF01DHCN7.8.49.E05.1.454.CMB.1.raw
  modified_base (200)..(200): a, c, t, g, unknown or other
  misc_feature (200)..(200): n is a, c, g, or t
  modified_base (224)..(224): a, c, t, g, unknown or other
  misc_feature (224)..(224): n is a, c, g, or t
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctccgccctccctgtctgcatctgtagganacagatcacatcacttggccgggnaagtcagagcattggcacctacttaaattgtatcagcagaaaccgaggaaacgacccccaaatcctagactacaattatgactactaccgtagtttacgacgtaaaggtcggggtaccctaagtccgaaaaggtactttcgtaagggtcgggtaccgggttagggacgttcgggtaggggaaactaagggtttacttttaccaacctttccctacctaaacccctaagttaacccaaacgtacgttaccttacgacggtaagtatttacgggaaggtaactttaagtacgtaaccgttaaactttttaacgttaaccgttcgttaaccgacgtacgtacggttaacccgtttaccggaacccgggtacccccgtacttacccgttacccggggtttaccggggggaaccgggggggtaaacccgtaaagggttccggggtaaacccgttaaacccgtaaaaccgggtaaccgtttaggggtaaccgggtacctacgggaccctaaccgttacccg

SEQ ID NO: 254442 - DNA, 544 bp, Homo sapiens
  misc_feature: GYAE6OF01ATKBQ.8.49.E05.1.454.CMB.1.raw
  modified_base (277)..(277): a, c, t, g, unknown or other
  misc_feature (277)..(277): n is a, c, g, or t
  modified_base (406)..(406): a, c, t, g, unknown or other
  misc_feature (406)..(406): n is a, c, g, or t
  modified_base (426)..(426): a, c, t, g, unknown or other
  misc_feature (426)..(426): n is a, c, g, or t
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctattaaattggtatcagcagaaaccagggaaacnccccaaactccagatcaattatgactatcctagtttcgactaaacggttcggggtacccatacaaagtattacaggtggcggtggactcgtagggactagtatttcactctacacctatcaaacagtcngcagtattggaagtatttanagtactaactttattaactgtacagtactagtacgtcccgacggacccctctacgtaccgttccgggaccggggtacaaggtcggacgtacaaacgacgtggtacgcgtcgcgctacg

SEQ ID NO: 254443 - DNA, 643 bp, Homo sapiens
  misc_feature: GYAE6OF01CDPC2.8.49.E05.1.454.CMB.1.raw
  modified_base (278)..(278): a, c, t, g, unknown or other
  misc_feature (278)..(278): n is a, c, g, or t
  modified_base (302)..(302): a, c, t, g, unknown or other
  misc_feature (302)..(302): n is a, c, g, or t
  modified_base (630)..(630): a, c, t, g, unknown or other
  misc_feature (630)..(630): n is a, c, g, or t
tcagctcgcgtgtccacgaccggtgctcgatttagagcgactagcaacacacaaagggggagtcagtctcagtcaggacacagcatggacatgacgggtccccgctcagctcctggggctcctgctactctggctccgaggtggcagatgtgacatccagatgacccagtctcccgccctcctgtctgcatctgtaggagacagagtcaccatcacttgccggacaagtcagagcattcggcactacttaatgtatcagacagaaaccacgggaaacnccccaaatccagactacaatttangactataccagtttacgactaaagggtccggtacctaagtacgtaagtactttacgaggttcggcggtaggtactcggtagggactaagtatttaccacttccgtacacctataacctaacgtaacggttctagactaaggttagttaggaagttattagtacgactttaaaccgtttattacgtcggttacgaacgtacgtaacgttaccgttaacccggaccggaccccccgttagttcccgttaaaccggtttccggggggaaccggggtaaacctaaagggtacggaaccgttaaccgtaaaacgtacgtggtacgtacgtacnccgttaccgtacg

SEQ ID NO: 254444 - DNA, 597 bp, Homo sapiens
  misc_feature: GYAE6OF01C1EFE.8.49.E05.1.454.CMB.1.raw
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggctacctacttaattggtatcagacagaaaccaggaaacgccccaaactcctgatacaattatgacatccagtttagactaaaggtcggggtacccaatacaaagtactttcgaaggtcgggcggtaggtacgtcgtagggtactagtactttcgacttacctaccaaccatacctaaactacgtactgactagtagttgagtatttaatgtactaactttattactgtacagtcgtacgtacgttacccgacggtaccccgtcttaccgtaccggttaccggggacgggggtaacctaaagggtcggtaaccgtaaccgaaaccggtacgttcggtacggacgtcgccgtaccgtacg

SEQ ID NO: 254445 - DNA, 597 bp, Homo sapiens
  misc_feature: GYAE6OF01D33VM.8.49.E05.1.454.CMB.1.raw
  modified_base (227)..(227): a, c, t, g, unknown or other
  misc_feature (227)..(227): n is a, c, g, or t
  modified_base (444)..(444): a, c, t, g, unknown or other
  misc_feature (444)..(444): n is a, c, g, or t
tcagctcgcgtgtccacgaccggtgctcgatttagagcgactagcaacacacaaagggggagtcagtctcagtcaggacacagcatggacatgagggtccccgctcagctcctgggctcctgctactctggctccgaggtggcagatgtgacatccagatgacccagtcctcccgccctccctgtctgcatctgtaggagacagacgtcaccatccacttgccgggnaagtcagagctattgactacctacttaaattggatcagcaacgaaaccgagggaaacgcccccaaacgtcctagatactaattatacgacactacctagtttacgactaaacggtcgggtacccatacaaagtattcgaggtggcggtgactcgtggactagtatttcgacttctcaaccatacaactgtctagactaaggtacttggagtatttancgtacctaacttttataacgttgtacgtaacgtcgtaagttaccgttaccgaaccggtccccgtactacgtacgggttaccggggacggggtaaacgtaagtacgggtaaacgaacgaaacgtaaccgtggtacggactaggccaccgtaacg

SEQ ID NO: 254446 - DNA, 711 bp, Homo sapiens
  misc_feature: GYAE6OF01D052S.8.49.E05.1.454.CMB.1.raw
  modified_base (232)..(232): a, c, t, g, unknown or other
  misc_feature (232)..(232): n is a, c, g, or t
  modified_base (324)..(324): a, c, t, g, unknown or other
  misc_feature (324)..(324): n is a, c, g, or t
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctccgccctcctgtctgcatcgtgtaggagacagagtcaccatcactggccggacagtcagngctattcgactaccttaacttaaagttgtactcgagacgaaacgaaaccgaagggaaaccgacccccaaacttccgtagactacgtaattanacgactacttaccgtagtttacgaacgtaaggtcgggtacccagttacgaagtacttacggaggtcgggtacggtggtacgttcgggaggtactacgttactttaccacgtcctaccgaacctacgtaacctaaactacgttacagacgtaagtacgtttaggaacgtttattacgttacgaactttaaaccttacgttacgtacgttacgaacgttacgtacgttaacgttccccggaccggtaccccgtacgttaccgttaaccgggttaccgggggtaccgggggtaaaccgtaacgggttaacgggaacccgttaaacgggtaaacccggttacgggtaacgggtccggttacgtacccggtaacccgtacgtttaacccggg

SEQ ID NO: 254447 - DNA, 651 bp, Homo sapiens
  misc_feature: GYAE6OF01B5HJ3.8.49.E05.1.454.CMB.1.raw
tcagctcgcgtgtccacgaccggtgctcgatttagagcgactagcaacacacaaagggggagtcagtctcagtcaggacacagcatggacatgagggtccccgctcagctcctgggctcctgctactctggctccgaggtggcagatgtgacatccagatgacccagtctccgccctccctgtctgcatctgtaggagacagagtcaccatcacgttgccgggcaagtcagacgctagttcggcaccttaacttaaattggtatcagacaagaaaccgaggaaacgacccctaaacgtcctagactactaattactgactacgttcctagtttcgaacgtaagggtccgggtaccctaagtacgaagtacttcgaggttcggtacggtaggtacgttcgtaaggactagtactttacaaccttcctacgaacctataaccaacgtacgtcgtagacgtaagtagttaaggacgttatttaacgtcgaactttaacgtttataacgtcgtacgaagtacctaggtaccttaccggaccgtccccgtacttaccgttaccgggttccggggaaccgggggtaacctaaagggtcccggtaaacgttaaccgtaaaacggtacgtcggtacggactacggtacccgacttacgg

SEQ ID NO: 254448 - DNA, 596 bp, Homo sapiens
  misc_feature: GYAE6OF01BZ5JL.8.49.E05.1.454.CMB.1.raw
  modified_base (225)..(225): a, c, t, g, unknown or other
  misc_feature (225)..(225): n is a, c, g, or t
  modified_base (234)..(235): a, c, t, g, unknown or other
  misc_feature (234)..(235): n is a, c, g, or t
  modified_base (458)..(458): a, c, t, g, unknown or other
  misc_feature (458)..(458): n is a, c, g, or t
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctagtaggagacagagtcaccatcacttggccggnaagtcagannattgcacctacttaaattgtatcagcaagaaaccaggaacgcccccaaactcctagactacaattatcgactatcctagtttcgacgtaaaggtccggggtacccatacgaagtattcgagtggcggtgatcgtagggactagtactttcacttcctaccacctatacctaaacctggtctagacgtaagtattaggagtaatttagtacgtactaacgtttnttaaccgtcgttacagtagaacgtacgttcccgacggacccccgtgtacctaccgggttacggggacccggggtaacgtaacgggtacggacccgttaacgaaacggtaacgtcggtaacggcgtcgccgaccgtacg

SEQ ID NO: 254449 - DNA, 882 bp, Homo sapiens
  misc_feature: GYAE6OF01A6GTZ.8.49.E05.1.454.CMB.1.raw
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctccgccctccctgtctgctatcgtgtaggagacagagtccaccatccacgttgccgggacaagtcagagctagttcggcctacctaactttaaagttggtatcagaccaacggaaaccacggggaaaccgacccccaaaacttccctagaacttactaattacgtacgactacgttaccgttaagtttcggaaccgtaaacgggttccgggggtacccctagtaaccgtaaaagtacgtttaccgtaacggggttcggggtaccggggttagggtaaccgttcggtagggggaaacctaggtttaacttttacccgtaaccgtttcctaaccccgtaacctaacgttaacccgtaaaacccgtacggttaccgtaacgggtacctaagggtttaacgttagggaaaggttttaacgtttaacgttaacggtaacccgtttaaactttttaacggtttaccgttaaggttacccgtaacgttaacccgtaacgggtttaacccggttaccccggtaaccccgggcccccgttaaccggtttaccccggtttaaacccgggggtttacccgggggggaaacccgggggttaaaacccggtaaaacgggggttaccggggtaaacccggttaaacccggtaaaaccggggttaacccggttacgggtacccggggttaaccctaccgggtaaccccttaaccccggttaaccgg

SEQ ID NO: 254450 - DNA, 766 bp, Homo sapiens
  misc_feature: GYAE6OF01D6DKG.8.49.E05.1.454.CMB.1.raw
tcagctcgcgtgtccacgaccggtgctcgatttagagcgactagcaacacacgaaagggggagtcagtctcagtcaggacacagcatggacatggacgggtccccgctcagcctccgtggggctcctgctactctggctccggaggtggcagatggtgacatccagatcgacccagtcctcccgcccttccctgtctgcatctggtaggagacagactcacctatccgtacgttcggcccgggacaagtcgaagacgctagtttcggacctaaccttaacgttttaaaagtttcggtaatacgacgaccgaaacggaaaaccgaacggggaaacccgaaccccccaacgtaccgtagaacttaactaatttacgtcgacctacgttaccgttaagtttacggacgtaaacgggttaccggggtaccctagtaaccgaaaggttacttacggagggttcgggtacgggtagggtacgttacggtacgggtaactaacgttactttaccgtaccttaccgttaacccgaacctaacgtacccgtaaactacgttaccgtacgtacgtaagttagttaacggtaggttaattacgtcgttaaccttaacgtttaacgttaccgtagttaccgacgtacgtaaccggttaccgtacccggaccggtaccccgtcgtacccggttaccgggttccgggggaacccggggtaactaacgggtacggtaaccgtaacgaacggtacgtcggtcgaccgtcgtacctccgtacg

SEQ ID NO: 254451 - DNA, 664 bp, Homo sapiens
  misc_feature: GYAE6OF01C0CE0.8.49.E05.1.454.CMB.1.raw
  modified_base (203)..(203): a, c, t, g, unknown or other
  misc_feature (203)..(203): n is a, c, g, or t
  modified_base (341)..(341): a, c, t, g, unknown or other
  misc_feature (341)..(341): n is a, c, g, or t
tcagctcgcgtgtccacgaccggtgctcgatttagagcgactagcaacacacaaagggggagtcagtctcagtcaggacacagcatggacatgagggtcccgctcagctcctggggctcctgctactctggctccgaggtggcagatgtgacatccagatcgacccagtcctccgcccttcctgtctgctatctaggtagganacagagtcaccatcacttcggccggacaagtcagagtctagttcggacctaaccttaacttaaagtttggtactactaagactaacggaaaccgaacggggaaaccgaccccctaaactccgtagactactaattacngtactactacgtagttacgacgtaacggtccgggtacctacgtacaagtacgttacgtacggtcgggtcggtacggtacgttcggtacggtaactagttactttctaccgtcctacctaccgtactactaacgtacgtacgtacgacgtagtagttaggaacgttattacgtacgtaactttacgtttaatacgttacgtacgtacgtagacgttacgtaccgacccgtcccgtcgttaccggtacccgggttcgggaccgggtaacgtacggtacggtaaccgtaacggaacgtacggtcggtacgtacgcgacgtactacg

SEQ ID NO: 254452 - DNA, 810 bp, Homo sapiens
  misc_feature: GYAE6OF01D0PSR.8.49.E05.1.454.CMB.1.raw
tcagctcgcgtgtccacgaccggtgctcgatttagagcgactagcaacacacgaaagggggagtcagtctcagtcaggacacagcatggacatggacgggtccccgctcagctccgtgggctcctgctactcgtgctccgaggtgcagtatgtgacactccagatacgaccctacgtcctccccgcccttccgtgtcctgactatcgtaggtaggacgacgagacgtcaacctactaccgacgttcggaccgggactaacgtacgaggacgtacgtaggttaccgaccttaaacctttaacgtttaaaagttcggtaacacgtaacggaaccgaaaaccggaaaaccggaaaccgggaaaaccccgtaacccccgtaaacgttaccgtaacgtaaccgttaacttaaacttacgtccgtaacgtaccgttaccgttaacggttaacggaaccggttaacgggtccggtaaccctaagtaacgtaagttacgtaggtacggtacggggtcggttagtacgttacgggtacggtacttaggtttaccttactaccgttacctacgtaaccctaagtaacctacgttacgtacgtacgaacgttacgtaagtaggtaacgttacgttaacgtaccttaagtttaactttacgtaaggttctaacgtcggtactaaccgggttaccgtaacccggcccgtaccgttccggtaccgttaccggggtaaccggggaacgggtacccgtaaggtaccgggtaaccaacgggttaacgtacccggtagggtactaccgtacgaccgttacgttacccg

SEQ ID NO: 254453 - DNA, 845 bp, Homo sapiens
  misc_feature: GYAE6OF01E1HX2.8.49.E05.1.454.CMB.1.raw
tcagctcgcgtgtccacgaccggtgctcgatttagagcgactagcaacacacaaagggggagtcagtctcagtcaggacacagcatggacatgacgggtccccgctcagctccgtggggctcctgctactctggctccgaggtgcagatgtgacatccagatcgacccagtcctccgccctcctgtcctgcatcgtgtaggagacgagtagtccaaccactcctacgttccggaccggacgtaaagtccaaggacgtcctagttcggacctaaccgttaaactttaaagttcggttaactcgagaaccgaacgggaaaaacccgtaacggggaaaacccctaaccccccgaaaacgttcccgtacggtactaacgtaaagttacgtacgacctaccttaccggtagtttaacgaaccggtaaaggtccgggtaacctaacgtacgtaacgtagttcgggtaggtccgggtacggtaggtacgtacggtaggtacctagttacgtttacctacgttacctacgtaacctacgtaacaaacgttacttcgtacgaactttaacggaggtttaagacggttaattacggttaactaacccgttaaactttttacgtaaccggttagttaacctacggggtaaactaccggtttaacccggttaacccgtacccggggtaacccccttacggttacccgggtttaccccgggggttaaaccgggggggtaccggggtaaaaacccggtaacggggttaacggttaaccccggtaaaccggtaaaaacccggttacgggttaacggttacccgggttagttaccccgaaccggtttaccgttaaacccgg

SEQ ID NO: 254454 - DNA, 688 bp, Homo sapiens
  misc_feature: GYAE6OF01EH6WA.8.49.E05.1.454.CMB.1.raw
tcagctcgcgtgtccacgaccggtgctcgatttagagcgactagcaacacacaaagggggagtcagtctcagtcaggacacagcatggacatgaggtccccgctcagctcctggggctcctgctactctggctccgaggtggcagatgtgacatccagatcgacccagtcctcccgccctcctgtctgcatctgtaggagacagacgtcacatcacttggccggcaagtcagagctagttggacctaaccttaacttaaagttggtaatacagacaacggaaacccgaagggaaaccgaccccctaaactccgtagtactacctaaattacgtcgactacgttacctacggttttagaaccggttaaacgggttccggggtaacccctagttaaccgtaaacgttacgttacggtaagggttcgggtaacgggttacggtacgtacgggttacgggtaactaaggtttactttaccgtaccttcctaacccaacctacgttaacaacgtacgtacgtagaacgtagtagtaggtaacgtattacgtacgtaacttacgttacttacgtacgtactacgtacgtagttaccgtaccgaccggtaccctgtacccggttacggttacggggacccgggtaagtacggtacgggacctaacgaacgtacgtcggtcagtccacggcttacg

SEQ ID NO: 254455 - DNA, 693 bp, Homo sapiens
  misc_feature: GYAE6OF01BHOT6.8.49.E05.1.454.CMB.1.raw
  modified_base (106)..(106): a, c, t, g, unknown or other
  misc_feature (106)..(106): n is a, c, g, or t
  modified_base (217)..(217): a, c, t, g, unknown or other
  misc_feature (217)..(217): n is a, c, g, or t
  modified_base (246)..(246): a, c, t, g, unknown or other
  misc_feature (246)..(246): n is a, c, g, or t
tcagctcgcgtgtccacgaccggtgctcgatttagagcgactagcaacacacgaaagggggatcagtctcagtcaggacacagcatggacatggacgggtccccgntcagctccgtggggcctcctgctactcgtggcctccggaggtggcagactgtgacatccagtatcgacccagttcctcccgcccttcctgtctgacattcgtgtaggacanagctcacctatctacgttcggaccggtanaagtcaggtagctagtcgaccttaaccttaacttaagttcgtatacgacgacgaaacgaaaccgaacgggaaaccaccccgaaactccgtagtactactaactagtcgctaactcgtagttacgtacggtaacggtccggtacccaatacgtaacgtagttacgtaggtcggtggttacgacgttacggtaggaaccgttagttaccgttactacctaccgtcctaaccgtactaaccgtacgtacgttacgtatacggtagtaacgttggtaaacgtttaagttccgtaacttaaccgtttaatttaacgttacggtaactacgagtaaccgtacgtaaccgttaccggacccgttccgtacgttaccggtaccggttaccggggaacggttaccgtacggacgtaaaccggtacaaaccggtgtacgcgagccgtaacgtctacg

SEQ ID NO: 254456 - DNA, 800 bp, Homo sapiens
  misc_feature: GYAE6OF01E0HEJ.8.49.E05.1.454.CMB.1.raw
  modified_base (104)..(104): a, c, t, g, unknown or other
  misc_feature (104)..(104): n is a, c, g, or t
  modified_base (597)..(597): a, c, t, g, unknown or other
  misc_feature (597)..(597): n is a, c, g, or t
  modified_base (688)..(688): a, c, t, g, unknown or other
  misc_feature (688)..(688): n is a, c, g, or t
tcagctcgcgtgtccacgaccggtgctcgatttagagcgactagcaacacacaaagggggagtcagtctcagtcaggacacagcatggacatgagggtccccgntcagctccgtggggctcctgctactctggctccgaggtgacagatgtagacatccagatcgacccagtcctcccgccctcctgtctcgactactcgtcgggtagggagaacgacggacgttaccaaccctacgttacctaaccggtttcggacccggggactaaacggttccgaagtaacggtactaggtttacggaacctaaccgttaactttaaaacggtttagggttactacgtaacgaccgtaaacggaaaacccgtaaaggggaaaccccgtaaccccccgtaaacgttaccgtaacggtaactaaacgtaaacgttacgtaccgtaacttaccgttaccgttaacggtttaacgaacggttaaacggtccggggttaacccaagtaactaaagttacgttagacggtcgggtacggtaggtacgttcgggtaaggtaacgtaaggttacttactacgttacctaccgtacctataacccacgttaancgtagacgaagttacgtagtaagttataatcgtaacttaagttacttaagtacgtacgcgaacgtacttaccggaaccgtaccggtacccncggttaaccggttaccggtacgggggtaaacccggggtacggaaacgggttacgtaacggtaaacccggaaagttacgtacgggtacaacggtacggtaacctgttaaaccg

SEQ ID NO: 254457 - DNA, 620 bp, Homo sapiens
  misc_feature: GYAE6OF02GMZD5.8.49.E05.1.454.CMB.1.raw
  modified_base (201)..(201): a, c, t, g, unknown or other
  misc_feature (201)..(201): n is a, c, g, or t
  modified_base (327)..(327): a, c, t, g, unknown or other
  misc_feature (327)..(327): n is a, c, g, or t
  modified_base (400)..(400): a, c, t, g, unknown or other
  misc_feature (400)..(400): n is a, c, g, or t
  modified_base (435)..(435): a, c, t, g, unknown or other
  misc_feature (435)..(435): n is a, c, g, or t
  modified_base (448)..(448): a, c, t, g, unknown or other
  misc_feature (448)..(448): n is a, c, g, or t
  modified_base (475)..(475): a, c, t, g, unknown or other
  misc_feature (475)..(475): n is a, c, g, or t
  modified_base (496)..(496): a, c, t, g, unknown or other
  misc_feature (496)..(496): n is a, c, g, or t
  modified_base (529)..(529): a, c, t, g, unknown or other
  misc_feature (529)..(529): n is a, c, g, or t
tcagctcgcgtgtccacgaccggtgctcgatttagagcgactagcaacacacaaaggggagtacagtctcagtcaggacacagcatggacatgagggtccccgctcagctcctggggctcctgctactctggctccgaggtggcagatgtgacatccagatgacccagtctccgccctccctgtctgcatcctgtacgganacagagtcaccatcacttgccggggactaaacggtcaggagtaccagttcggacacccttaacttaaaatttgggtaatcaacgcaaggaaaacccaggggaaaacgccccccaaaatccccgtanaacgtaccaatttatcgacagtccacgttttgactaaagtcggggttacccatcaaacggattcagttacggnggtagatctagggacagtatttcaactctcaaccnttacaacacgttntacgcgtaacgtattagagtatttaangactaaacctttaagtttacngtttccaagtcaagtcgttaccacggacccgtntacccttacggttagggtaccgggggaaccaagttaccgggacgttaaccgtaaggtaacctaggttccggaatttcggaaccgcctaacg

SEQ ID NO: 254458 - DNA, 523 bp, Homo sapiens
  misc_feature: GYAE6OF02FMD3P.8.49.E05.1.454.CMB.1.raw
  modified_base (302)..(302): a, c, t, g, unknown or other
  misc_feature (302)..(302): n is a, c, g, or t
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaacgcccccaaactcctagatcaattangcatccagtttgactaaagtcggggtcccatcaagattcagtggcggtgatcgtgggacagatttcactctcactatcaacagtctgcagattggagtattatgtactaactttatactgtacagcagtacgttccgacggacccgtctccgtacgttcgggacggggacctaaaggtcggaccgtacgaaacgtacgtcggtacggactcgaccgactac

SEQ ID NO: 254459 - DNA, 520 bp, Homo sapiens
  misc_feature: GYAE6OF02GAPEB.8.49.E05.1.454.CMB.1.raw
  modified_base (382)..(382): a, c, t, g, unknown or other
  misc_feature (382)..(382): n is a, c, g, or t
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaacgcccccaaactcctgactcaattatgacatccagtttgacaaagtgggtcccatcaagattcagtggcggtgatcgtgggacagtatttcactctcacatcaacngtctgcagtattgagattatgactaacttatactgtcagctagtacgttccacggacccgctacgtacgttcgggacgggggtaacaaggtcggaaccgtacgaaaccggtacgtcggtacgcgtacggaccactacg

SEQ ID NO: 254460 - DNA, 572 bp, Homo sapiens
  misc_feature: GYAE6OF02F2XW6.8.49.E05.1.454.CMB.1.raw
  modified_base (381)..(381): a, c, t, g, unknown or other
  misc_feature (381)..(381): n is a, c, g, or t
tcagctcgcgtgtccacgaccggtgctcgatttagagcgactagcaacacaacaaaggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggtcaagtcagagcattggcacctacttaaattggtatcagcagaaaccagggaaacgcccccgaaatcctagactacaattatgcataccagtttagcaaagtgggtacccatacaagatcagtggcggtagactctgggacagtattcactctacacntacacagtctgcagattgagattagcgactaacttagttacctgttaccagtcgagtacgttaccgaacggaccccgtagtaccctaccgtttccggggaccggggggtaaccaaacggtttcggggaacccttaaccgaaaaccgggtacgttacgggttacggtccttacgggtaccctacccggtaac

SEQ ID NO: 254461 - DNA, 552 bp, Homo sapiens
  misc_feature: GYAE6OF02HHK8S.8.49.E05.1.454.CMB.1.raw
  modified_base (305)..(305): a, c, t, g, unknown or other
  misc_feature (305)..(305): n is a, c, g, or t
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaaacgccccccaaaactccctgatcaattangcatccagtttgcaaagtggggtacccatcaagtattcagtggcggtggatctgggacagtatttcactctcacctatcaacagtctgcagattgagtattatgactaatttattactgtacagctaagacgttaccacggtaccccgcttaccgtaccgtttcgggaccgggggtaacctaaacgggttcgggaacgttaccgaaacggtaacgttcggtacggtacctacggtaccaccgtaacg

SEQ ID NO: 254462 - DNA, 594 bp, Homo sapiens
  misc_feature: GYAE6OF02IOZ2Z.8.49.E05.1.454.CMB.1.raw
  modified_base (209)..(209): a, c, t, g, unknown or other
  misc_feature (209)..(209): n is a, c, g, or t
  modified_base (223)..(223): a, c, t, g, unknown or other
  misc_feature (223)..(223): n is a, c, g, or t
  modified_base (273)..(273): a, c, t, g, unknown or other
  misc_feature (273)..(273): n is a, c, g, or t
  modified_base (296)..(296): a, c, t, g, unknown or other
  misc_feature (296)..(296): n is a, c, g, or t
  modified_base (308)..(308): a, c, t, g, unknown or other
  misc_feature (308)..(308): n is a, c, g, or t
tcagctcgcgtgtccacgaccggtgctcgatttagagcgactagcaacacacaaaggggagtcagtctcagtcaggacacagcatggacatgaggtccccgctcagctcctggggctcctgctactctggctccgaggtggcagatgtgacatccagatgacccagtcctccgccctcctgtctgcatctgtaggagacagagtcaccntcacttgcccgggnaagtcagagcatggcactacttaattgatcagcaagtaaaccgaggaacnccccctaaatcctagatcaattnagcatccagttnactaaggtcggtccagtacaagtcttacagtcggcggtagtagtctagggacctagtactttcaacgtctactacgctacaacgtatcgttagacagtattaggtaggtaacttttaggacgttactaaaaccttttattacctaggttaccaagtccgtaagttaacgttcccgaaacggtacccctgttaccgtacggtttccgggggaccggggtaaactaacgggtcggtaaaccttcggaaaaccggtacgtcggtacgtcctacggacccgtaccctacg

SEQ ID NO: 254463 - DNA, 722 bp, Homo sapiens
  misc_feature: GYAE6OF02J2HMM.8.49.E05.1.454.CMB.1.raw
  modified_base (155)..(155): a, c, t, g, unknown or other
  misc_feature (155)..(155): n is a, c, g, or t
  modified_base (492)..(492): a, c, t, g, unknown or other
  misc_feature (492)..(492): n is a, c, g, or t
  modified_base (524)..(524): a, c, t, g, unknown or other
  misc_feature (524)..(524): n is a, c, g, or t
  modified_base (705)..(705): a, c, t, g, unknown or other
  misc_feature (705)..(705): n is a, c, g, or t
  modified_base (715)..(715): a, c, t, g, unknown or other
  misc_feature (715)..(715): n is a, c, g, or t
tcagctcgcgtgtccacgaccggtgctcgatttagagcgactagcaacacacaaggggagtcagtctcagtcaggacacagcatggacatgacgggtccccgctcacgctccgtggggcctcctgctactcgtggctccggaggtggcagattgngacatccagatcgaccctgtcctcccgtccctctgtctcgctagtcgtaggtacggacgacacggtacctaccacctacgtccgtacgttccggaccggactacgcacggtacgacttacgtcggtacccttaaccgttaagttaaacgtcggtaactaccggaacgaccgtaaaccggaaaccgtacccggtaaaccccaccccttaaatccgtaatacttaaccgttaattcggacctacgtacgttagtacggttacgaacgacggttccgaactttgtaaccgagtacgtccggaggtcggtggtactgtacggtcgtacgtacttacccgtntaccgtacacctaacgttacacgtagttacgngttacgacgtaagtgttaacgggttactagtttacccaagtttctaaccgttacgtacgtaccgtacgtaacgtccggtacctaccgggtacccgacccggtcttacggtacccgggttacgggagggtaacccggtaactacggtacggtaccaacggtaacgtcggttccaggtacccncgtacccgtnttaccgg

SEQ ID NO: 254464 - DNA, 645 bp, Homo sapiens
  misc_feature: GYAE6OF02HQJSV.8.49.E05.1.454.CMB.1.raw
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtagagacagagtcaccatcacttgccggcaagtcagagcattggacacctacttaaatgtatcagcagaaaccaagggaacgacccccaaactcctagactactaattatcgactactcctagtttagactaaaagggttcggggtaccctagtacgaaagtattacgaggtgggcggttaggtacgttcgtagggtactaggtatttaccgacttcctacgaaccactacaactagtcttgactagtattaggacgtagttacagtacttaaaccttttattaccgttagtacgtagaccgtagttaacccgttccggaacccggaccccgttaccgttaccgttacccggggtttcggggacccggggggtaaacctaaacgggtaccggtaaccgttaaccggaaccgtaacggttcggttaccggtcctacgggtaccaccgttaacg

SEQ ID NO: 254465 - DNA, 568 bp, Homo sapiens
  misc_feature: GYAE6OF02HEFEK.8.49.E05.1.454.CMB.1.raw
  modified_base (280)..(280): a, c, t, g, unknown or other
  misc_feature (280)..(280): n is a, c, g, or t
  modified_base (307)..(307): a, c, t, g, unknown or other
  misc_feature (307)..(307): n is a, c, g, or t
  modified_base (351)..(351): a, c, t, g, unknown or other
  misc_feature (351)..(351): n is a, c, g, or t
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagatccaccatccacttgccgggcaagtcagagcagttggcacctacttaaattggtatcagcagaaaccagggaaacncccccaaactcctgactacaatttacngcactcctaagtttcgacgtaaaggtcgggtacccagtacaagntttacgaggtggcggtgatcgtaggactagtatttcactctacacatcaacagtcagcagtattggagtattatcgtactaactttattactacgtcaagtactagtacgttccaacggccccgtagtccgttaccggttcggggaccgggggtaacctaacggtacggtaaccgtaacgaacgtaacgtcggtacggtcgtaacgtccgtactacg

SEQ ID NO: 254466 - DNA, 606 bp, Homo sapiens
  misc_feature: GYAE6OF02G8JNP.8.49.E05.1.454.CMB.1.raw
  modified_base (224)..(224): a, c, t, g, unknown or other
  misc_feature (224)..(224): n is a, c, g, or t
  modified_base (303)..(303): a, c, t, g, unknown or other
  misc_feature (303)..(303): n is a, c, g, or t
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgganaagtcagagcattggcacctattaattggtatcagcagaaaccgagggaaacgcccccaaactcctagatacaattagngacatcctagtttgacgtaaaggtcgggtacccatacgaagtattcgaggtggtacgggtaggacttcgtagggactagtatttccacttcctacactaactacaactgtctagactagtagttgaaggttattagtcgtactaactttattaccgtagtacgtagtacgtaggtaaccgttcccggaaccggtcccccgtattacccgtaccgggtttaccggggaaccgggggtaacctaacgggtcgggtaaccgtacggaaaccgtacggttcggtacggaccgtcgaccgtacgtacg

SEQ ID NO: 254467 - DNA, 600 bp, Homo sapiens
  misc_feature: GYAE6OF02JVW9O.8.49.E05.1.454.CMB.1.raw
  modified_base (199)..(199): a, c, t, g, unknown or other
  misc_feature (199)..(199): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
  modified_base (355)..(355): a, c, t, g, unknown or other
  misc_feature (355)..(355): n is a, c, g, or t
  modified_base (404)..(404): a, c, t, g, unknown or other
  misc_feature (404)..(404): n is a, c, g, or t
  modified_base (447)..(447): a, c, t, g, unknown or other
  misc_feature (447)..(447): n is a, c, g, or t
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctccgccctcctgtctgcatctgtagganacagactcaccatcacgttgccgggcaagtcagacgcattggaccacttaacttaaattgtatcagcaagaaaccgaggaaacgcccccaaatccanactctaaatntcgacactcagttgactaaggtcggtaccatcgaagtctacgagtcggngtgtacgtcgtaggactagtacttcacttctacaactatacacgtactnacggatagtacttagaagttattatctaacctaattatacgtntacggtacacgtaaccgttagttaccccggaaacgttccctacgttaccgtcgggttaccgggggaccgggtaaacccggtaaggttacccgggttaaccgaaccggtaaacggtaccggttaggtaccgtcggttaccggaccttaacgtcg

SEQ ID NO: 254468 - DNA, 766 bp, Homo sapiens
  misc_feature: GYAE6OF02JDIEL.8.49.E05.1.454.CMB.1.raw
  modified_base (200)..(200): a, c, t, g, unknown or other
  misc_feature (200)..(200): n is a, c, g, or t
  modified_base (745)..(745): a, c, t, g, unknown or other
  misc_feature (745)..(745): n is a, c, g, or t
tcagctcgcgtgtccacgaccggtgctcgatttagagcgactagcaacacacaaaggggagtcagtctcagtcaggacacagcatggacatgagggtccccgctcagctcctggggctcctgctactctggctccgaggtggcagatgtgacatccagatgacccagtcctccgccctccctgtctgcatcgtgtagganacagagtccaccatccacgttggcccgggataaggtcaagagctattggcacctaacttaaagtggtatcagctaacgaaccagggaaaccacccccaaactccagtataccaattatcgacattacccgtagttttagaccgtaaaaggttcggggtaccctaaagtccgtaaacgtactttacgacggttacggggaccggtaggtaacgtccggttacggggaacctaaggttaaccgttttaccgaaccctttcgtacccaacccgtaacttaccgaaaccgtaggttaccgtcgtaaccgtaagttacggtttaacggtagggttaactttacgtacgggttaccctttaaaacggttaacgtttaaccgtttcggtaccgtaacggtttcgaacggtttaccgttaacccggaaccgggtaaccccccgttagttacccgttaccgggttttcccggggaaccgggggttaacccgtaaacggttacgggtaaccccgttaacggaaaacccggttacgttaccgggtacggttacccncggtaaccgtacccgttaacg

SEQ ID NO: 254469 - DNA, 703 bp, Homo sapiens
  misc_feature: GYAE6OF02GFI5L.8.49.E05.1.454.CMB.1.raw
  modified_base (203)..(203): a, c, t, g, unknown or other
  misc_feature (203)..(203): n is a, c, g, or t
  modified_base (234)..(234): a, c, t, g, unknown or other
  misc_feature (234)..(234): n is a, c, g, or t
tcagctcgcgtgtccacgaccggtgctcgatttagagcgactagcaacacacaaagggggagtcagtctcagtcaggacacagcatggacatgagggtccccgctcagctccgtggggctcctgctactctggctccgaggtggcaggatgtgacatccagatcgacccagtcctcccgccctcctgtctgcatctgtagganacagagtccaccatccacgttggcccggganaagtcaggagctagttcggacctaaccttaacttaaagtttggtaatacgagaccgaacggaaaacccgaacggggaaaaccgaccccccctaaaaacgttcccgtaaggtaacttaacgtaaacttttaactacgtacctaacgttacccgttaagttttacggaacgtaaaacgggttccggggtaacccctaatacgtaaagtaacgtttacgaaggtcgggtacggtaggtacgttcggtacgggactacggtactttcgacttcctacaccgataccaagtcgttactacgactaagttagtacggtagtaattacgtactaacttaacgttaatacctagtacgtaagcgtaacgtacgttaccgaccggtccctcgttaccgtacgggttaccgggaacggggtaactaagggtacggaacgtaacgaacggtacgtcggtacggctacgtactaccgtacg

SEQ ID NO: 254470 - DNA, 942 bp, Homo sapiens
  misc_feature: GYAE6OF02HEWAV.8.49.E05.1.454.CMB.1.raw
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatcgacccagtcctccgccctcctgtctgcatctggtaggagacagagtccaccatccacgttcggccgggactaagtcaggagctagttcggacctaaccttaacgttttaaagttggttaactaccgtaacggaccgaaaccggaaaacccgaacggggaaaacccgtaccccccctaaaaccttcccgtagaactacctaaatttacgtcgacctacgttacccgttaggttttaccgaaccggttaaacggggttccggggttaacccctaagttaaccgtaaaggttactttaccgtaacggggttcgggggtaccgggttaggtacgttaccgggtacggggtaaccgttaacggtttaacgttttacccgtaccgttttaccccgtaaccgtaaaccccttaaacgttaacccgtaaaccgttaacggtttacccgttaacgggtaaccttacgggttaaggtttaacgggtaacgggttttaaactttaacggttaaccgttaaaccgtttaaaccgtttttaacgtttaaccggtttaccggttaaccgtaaccggtacggttaaccgggtttaacccgggtttacccccggaacccgggttaaccccgttaccgttacccggttacccggggttttaacccgggggggaacccggggggtttaaaacccgtaaccggggtttacccgggtaaaccggtaaccggttaaacccggttacgggttaccgggtaccgggttacccggttaaccggtacccttaacccggttaccgg

SEQ ID NO: 254471 - DNA, 809 bp, Homo sapiens
  misc_feature: GYAE6OF02FYSF2.8.49.E05.1.454.CMB.1.raw
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctcctgtctgctatctgtaggagacagagtcaccatcacttgccgggcaagtcagagcattggcactacttaaattggtatcagcaagaaaccgagggtaaacgacccccaaactcctagactactaatttatcgactaattcccaggttttacgacgtaaaagggttccggggtaccctaagtaccgaaagtacttacggtaggtacggggtccgggttaggaacggttcgttacggggaaacgttacggttaacgttttcgtaaccctttaccgttaaccaacccgtaaacttaacctaaaccgttaccggtttaccgtaacggtaccgtaaggtaagttttaacgggaacggtttattaaccgttacggtaacctttaaaccgttttgtttaaccgtaggttactaacggtaccgttaacgggttaaccgttaccccgaaaccggggttacccctaccggttacccggttttaacccgggggtttaccccggggggaacccgggggggttaaaacccgtaaacgggggtttaacccgggtaaacccggtttaaacccgaaaaccggggtttaaccggttccgggttaaacccgggttaccggtacccggtaacctacccggtttaaccgg

SEQ ID NO: 254472 - DNA, 734 bp, Homo sapiens
  misc_feature: GYAE6OF02GJD83.8.49.E05.1.454.CMB.1.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
tcagctcgcgtgtccacgaccggtgctcgatttagagcgactagcaacacacaaagggggagtcagtctcagtcaggacacagcatggacatgagggtccccgctcagctccgtggggctcctgctactctggctccgaggtggcagatgtgacatccagatgacccagtcctccgccctcctgtctgcatctgtagganacagagtcactatcacttcggaccgggnaacgtcaggacgctagttcggacctaaccttaactttaaaagttggtactacgagacaacggaaaaccgaacgggaaaacccgaccccctaaactccgtagtactaactaattatcgtaccacgttaccctaggtttacgacgtaaagggttccggggtacccaatacgaagtacttacgtaggtcgggcggtagacgtcggtacgggactagttacttacgaccttacgtaccacctatacctaaacgtcgtcgtcgactaagttacgttacggaggttaatttaccgtacgtacttaacgtttacttaacgtacgtcgtaacgtacgtacggttaaccgttacccggaacggttaacccccgtcgttaacccggttaccggggttaccgggggtaacccgggggtaacccgttaaaacgggtcccggggtaaaccgttaaccgtaaaacccgggtaacgtttccgggttacggtacccgtttaccggacccgtaacggttaccg

SEQ ID NO: 254473 - DNA, 775 bp, Homo sapiens
  misc_feature: GYAE6OF02GTBC8.8.49.E05.1.454.CMB.1.raw
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctcctgtctgcatctagtaggagacagagtacaccatcacgttgccgggcaagtcagagcagttcggactacctaactttaaagttggtaactacgagacaacgaaaaccgacgggaaaaccgaccccctaaactccgtacgactaccgtaaattactacgtactacttaccgtagttttacgaacgtaaacggttaccgggggtaccctaagtaccgtaaagtacgttaccgtaaggtcgggtacggtaggaacgttcgtagggtacgaaggtttacttaccgtacctactaccacctaagtaccaacgttacgtccgttacggacctaagttaacgttaggaacggttaagtttaccttaacggtaaccttaaaccgtttaacgtttaacgttacgttaacgtaccgttaacgtaaccggtttacgttacccggtaaacccgggtccccgtaaccgttaccgtttaaccgggtttacccgggggtaacccgggggggtaacccttaaaaggggtacccggttaaccgggtaaaacccgtaacgggttaacccggttacggtacggtaccggtaccggtaccctaacccggttaaccg

SEQ ID NO: 254474 - DNA, 702 bp, Homo sapiens
  misc_feature: GYAE6OF02IUEZ3.8.49.E05.1.454.CMB.1.raw
  modified_base (171)..(171): a, c, t, g, unknown or other
  misc_feature (171)..(171): n is a, c, g, or t
  modified_base (197)..(197): a, c, t, g, unknown or other
  misc_feature (197)..(197): n is a, c, g, or t
  modified_base (200)..(200): a, c, t, g, unknown or other
  misc_feature (200)..(200): n is a, c, g, or t
  modified_base (224)..(224): a, c, t, g, unknown or other
  misc_feature (224)..(224): n is a, c, g, or t
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcnccgcctcctgtctgcatctgtagganacngagtcacatcacttggcccggganaagtcaaggacgctagttggcctaccttaacttaaagttggtaactcagcaacgaaaccgaagggaaaccgacccccaaactcctagacttacgaaatttactcgacctacgttccgtagtttacgaccgtaaaacgggttccggggtaccctaagtaccgtaaagtacttacgagggttcgggtacgggttaggtaacgtcggtcgggaactacggttaactttccaacttcctaccgtaaccgtataaccgaacgtacgtacgtacgacgtaacgtaagttacggtaaggttaattacgtacgtacttaaacgttacgttactacgtacgtaacgtacgtaacgttaccgttacccggaaccggtaccctacgttaccgttaccgggttaccgggggtaaccgggaaccgttaaacgggtcgggtaaccgtaacgaaaccgtacggttcggtacgcggttaaccgacctacgtccg

SEQ ID NO: 254475 - DNA, 732 bp, Homo sapiens
  misc_feature: GYAE6OF02JC15C.8.49.E05.1.454.CMB.1.raw
  modified_base (517)..(517): a, c, t, g, unknown or other
  misc_feature (517)..(517): n is a, c, g, or t
  modified_base (631)..(631): a, c, t, g, unknown or other
  misc_feature (631)..(631): n is a, c, g, or t
tcagctcgcgtgtccacgaccggtgctcgatttagagcgactagcaacacacaaaggggggagtcagtctcagtcaggacacagcatggacatgagggtccccgctcagctccgtggggcctcctgctactcgtggctccggaggtggcagatgtagacatccagatcgacccagtcctcccgcccctcctgtcctgcctatcgtaggtaggagacagacgtccacctatccacgttcggcccgggactaaggtcaaggacgactagttcggacctaaccttaacgtttaaagttcggtatacgacgacgaacgaaaccggaagggaacccgacccccaactcctagactactaattcgtgacctataccgtagttacgaacgtaaacgggtcgggtacctagtacgtaaagtcgttacggtagggtacgggtacggtaggttacgtacggttacgggaaaccgttgttaacgtttacccgaccttacctaccgtaaacccgtaatcccgttaaacnggttacccgtagtaaccgtaggttaagttacggtaagtacgtttaacacgtaacttaacgtttacttacgtactacgtaacgagtacggtacctcccggtaccgaaccccgttnttaccggtacggttccgggaacgggtacgggtaaccggtacgggtaacccgtaccgaaccggttaaggaccgttggtaccggtacgtacgtacccctacgg

SEQ ID NO: 254476 - DNA, 737 bp, Homo sapiens
  misc_feature: GYAE6OF02HKCLF.8.49.E05.1.454.CMB.1.raw
  modified_base (217)..(217): a, c, t, g, unknown or other
  misc_feature (217)..(217): n is a, c, g, or t
  modified_base (259)..(259): a, c, t, g, unknown or other
  misc_feature (259)..(259): n is a, c, g, or t
  modified_base (347)..(347): a, c, t, g, unknown or other
  misc_feature (347)..(347): n is a, c, g, or t
tcagctcgcgtgtccacgaccggtgctcgatttagagcgactagcaacacacaaagggggagtcagtctcagtcaggacacagcatggacatgacgggtcccgctcagctccgtgggctcctgctactctggcctccgaggtcggacagactgtgacacgtccagatcgacccaggtcctcccgacccttcctgtcctagcctatcctaggtagganacgtaggacttacacctaattcgtacgttcggacccgggtanaacgtcaggtacgctaagttcggacctacttaacgttaacttggtactgacgtacgaagaaaccgaacggaaccctaacccctaaacnccgtaacacttaaccgtacttagctacgtactacgttagttacgacgtacggttcggaacctagacgtaatcgttcgtacggtacggtcgggtacgtaacgttcggtacgggtaacttacgggttacctttaccgaccgttttaaccgtactaacccgtagttaaccccaaagtccgtacgttacggtaccgagttaaccgttggtaacgtagttcgtaaacttacgttaacgtttaacttacggttaccggtaaacgccgttaaggtcccgtaaacgccgtaccccgtaatccccgttcggggtaacggggtccggaaaaccgttacggaccgggtaaccctacgtaaccggttcgtaagtccgggtaactaccgtccgaaccgttcgg

SEQ ID NO: 254477 - DNA, 819 bp, Homo sapiens
  misc_feature: GYAE6OF02IK7XZ.8.49.E05.1.454.CMB.1.raw
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatcgacccagtcctccgccctcctgtctgcatctgtacgganacagngtcaccgatcacgttgccgggtacaagtcagacgcaagttggaccaccttacttaaacttggtactcagtacagaaaaccgaacgggaaaccgtacccccaaaactccgtacgacgtactaaacttactacggacctataccgtagtttacgacgtaaaacggttcgggggtacccaacgttacgtaaaggtacttacgtaacggtcgggttacggttacggtaacggttacgttaacggggaaccgtaaggtttaaccgttttaccgtaaaccgttcccgttaaccggtaaccttaacgtaaccgtaaacgttaccgtttaccggtacgtaccgtaacgggttaactttacgggtaaggttaacgtttacgtaacggttaacgttaaaccgttttaacgttttaaccgttacggttaacctaacggtaacctacgggtaacgttttaccccgaaaccgggttaccccgttaccgttaccgttaccgggtttaccggggtaacccgggggtaaaccctaaacggggttcccggttaaaccgtaaaccggttaaaccggttaacggttccgggttaccggacccgtttaacggtacccgtaaccgtttaaccgg

SEQ ID NO: 254478 - DNA, 829 bp, Homo sapiens
  misc_feature: GYAE6OF02FRXLR.8.49.E05.1.454.CMB.1.raw
  modified_base (138)..(138): a, c, t, g, unknown or other
  misc_feature (138)..(138): n is a, c, g, or t
  modified_base (168)..(168): a, c, t, g, unknown or other
  misc_feature (168)..(168): n is a, c, g, or t
  modified_base (533)..(533): a, c, t, g, unknown or other
  misc_feature (533)..(533): n is a, c, g, or t
  modified_base (804)..(804): a, c, t, g, unknown or other
  misc_feature (804)..(804): n is a, c, g, or t
tcagctcgcgtgtccacgaccggtgctcgatttagagcgactagcaacacacaaaggggagtcagtctcagtcaggacacagcatggacatgagggtccccgctcagctcctggggctcctgctactctggctccggngtggcagatgtgacactccagagtcgaccngtacctcccgcccttcctcgtactcgcacttcgtcgtaggacacgagtacgtacccaaccactacgtacgttccgggaccgggtacgaacgtcgaaaggcgaccttagtccggacctaaaccgtttaacttaaagtttcggtacttacgaacgtacaaaacggaaaccgtaacgggaaacctaccccctaaacgttcctacgaacttactaacgttagtaccgactaacgttacggttacgttacggtaaccggtaaagggtcccggggtttaacctaacgtaacggttaaagtaacggtttacccggttaagggttacgggttaccggggttaaggtaccggtttacgggaaacccgggggttntttaaaacccggtttaacgggttttacccctaaccgttacgtaaccctacccgttaacccgtaaaccgtacccgtaaccggttccgtaagtaaccggttaaacgttaggtaacgtacggtttaattaaagggtaccttaaccgggttaacttttaccgttaaggtaccgtacgtagtaaccctaggttaccgtaaccccgtccgtacccgttcgtacccgtcggttaccggggaacggtaacggtacgttaacggaaaccgtacggaacgngtccggtagtcgtcgacgtctaccg

SEQ ID NO: 254479 - DNA, 767 bp, Homo sapiens
  misc_feature: GYAE6OF02GANJ6.8.49.E05.1.454.CMB.1.raw
  modified_base (643)..(643): a, c, t, g, unknown or other
  misc_feature (643)..(643): n is a, c, g, or t
tcagctcgcgtgtccacgaccggtgctcgatttagagcgactagcaacacacaaagggggagtcagtctcagtcaggacacagcatggacatgagggtccccgctcagctcctggggctccgtgctactctggctaccgaggtggcagatgtgacatccagatgacccagtctccgccctcctgtctgcatctgtaggagacgagagtccaccagtctaacgttcggaccgggtacaaggtacctagtacgctaagtttccggactaaccccttaaacgttaaaggtttcggtaacttaccgtaagaccgaaacggtaaaaacccgaaggggtaaaaccccgtaccccctaaaaaccgttccgtaacgtaactaaccgtaaaagttttaagaccgtaaccttaacgttaaccccgtaaggttttaccggaaaccgttaaaaacggggtttcccggggtaaccctaaacgttaccgaaaacggttaacttacggtaaacgggtaggggtaaccgtaggggtaaactcggtaacgggtaactacgtacggtttactaccgtactaccaactactaacgtaacacgtactaggacaggtagttagtaggttaacttagacgtactaacttaagttagtactacganacgtagtacgtacccgaacggtacccgtaccgtacggtacgggtacgggacgggggtaacctaacggttacggtaacgtaaccgaaacggttactagggtactcgtacgtaccgaccgttaacg

SEQ ID NO: 254480 - DNA, 732 bp, Homo sapiens
  misc_feature: GYAE6OF02G36N4.8.49.E05.1.454.CMB.1.raw
  modified_base (104)..(104): a, c, t, g, unknown or other
  misc_feature (104)..(104): n is a, c, g, or t
  modified_base (713)..(713): a, c, t, g, unknown or other
  misc_feature (713)..(713): n is a, c, g, or t
tcagctcgcgtgtccacgaccggtgctcgatttagagcgactagcaacacacaaagggggagtcagtctcagtcaggacacagcatggacatgagggtccccgntcagctcctggggctcctgctactctggctccggaggtggcagatgtgacatccagatacgacccagtcctccgccctcctgtctgcatctgtaggagacagtagtccaacatccacgttcggccgggacaaggtcagagctagttcggcctaaccgttaactttaaacgtttcgggttaatccgtacgacgtaacggaaaacccgaacggggtaaaacccgaaccccccgtaaacgtacccgttaggtaacttaaccgtaaattttaccgtacggtacctaacgttaccgttagtttacggtaaccgtaaacgggttccggggtacccacgttaaccgtaacgtacttacggtagggtcggtacgggtagtaacgtcggtacggaacgtagtttacttcgtacctacgtaccacctacgtactaacgtacgtcgtagaccgtaagtaggttaggagttaattatacgtacttaactttaacgtcgttacgcgtaacgtacgtaagtcccgttaaccggacccgtacccgtacgttaccgtaccgggttcggggaacccggggtaacgaaacgggtacggtaaccgtaccggttaacgacgttccgganacggtcgtaccaccgttcg

SEQ ID NO: 254481 - DNA, 729 bp, Homo sapiens
  misc_feature: GYAE6OF02GC7BD.8.49.E05.1.454.CMB.1.raw
tcagctcgcgtgtccacgaccggtgctcgatttagagcgactagcaacacacaaaggggggagtcagtctcagtcaggacacagcatggacatgagggtccccgctcagctcctgggggctcctgctactctggctccgaggtggcagatgtgacatccagatgacccagtcctccgccctcctgtctgcatctgtaggagacaagacgtccaccatcaacgttggaccgggtacaacggtcaggagcgtagttcggactaaccttaacttaaagtttaggtactacgagtacgaacggaaaccgtaaaggggaaaaccgacccccgtaaaactccgtaaggacgtactaaactttacgtacgactacgttacctaggttttacgaacggtaaacgggttccgggggtaacctaacgtactaaacgtaactttacggtaacggttgggtacgggttaggtacgttcggtacgggacgtacgtaactttccgacttcctacgacctaactactaacgtacgtacgtgaacgtagtaacgttaggagttattatctaacgttaacgtttacgttacgttgtactagtaccgtaggtaccgttaaccggacccggtaccgtaccttaccgttacgggttacccggggtacggggtaaccggtaacgggtccgggtaaacgttacgaaaccggtacgttacggtacggttcgtacggtacctacgttaaccgg

SEQ ID NO: 254482 - DNA, 844 bp, Homo sapiens
  misc_feature: GYAE6OF02FUMYA.8.49.E05.1.454.CMB.1.raw
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtgcagatgtgacatccagatgacccagtcctcccgccctcctgtctcgcagtctggtaggagaccgaggtctaccacctatacctacgttcggcccgggactaaaggtccaagtacggactagttaccggcctaaacccttaatttaaagtttggtaacttacgacggacaacggtaaaaccggaacggggaaaacccgaccccccctaaacgttacccgtaggtaaccttaacgtaaattttactcggactaacttacccggttagttttacgaaacggtaacggtccggggttaccaaagttccgtaaagtcgttacggtaaggtcgggtccgtaggtacgttcgtagggtaactaggttacctttaccaccgttacctaccgactaacgttacaacttcggtactagtaccgaagttacggttagaccgtttaagttacccggtattaaacccttttaacgtttaacgtttactacggttaccgtacgttaaccgggttacgttaacccgggttaacccgtaacccccgtacccgggtttacgttaaccccggttttacggggggtttacccgggggaaacccgggttaaaccggggttaaacgggttaccggtttaaaacccgggaaacccgtaaacggtttacccggtcggggtttaaccgtacccgggtaacccgttaaccggtaccgttttaaccgg

SEQ ID NO: 254483 - DNA, 160 bp, Homo sapiens
  misc_feature: GYAE6OF01EA8P7.30.45.E01.1.454.CMB.1.raw
  modified_base (154)..(160): a, c, t, g, unknown or other
  misc_feature (154)..(160): n is a, c, g, or t
tcagcacgctacgtcacgaccggtgctcgatttagtgagtcagtaagggaaagggaccaaggttggaaatcaaacgaactgtggctgcaccatctgtcttcatcttcccgccatctgaacgtagcgtgctgagcgggctggcaaggcgcatagnnnnnnn

SEQ ID NO: 254484 - DNA, 148 bp, Homo sapiens
  misc_feature: GYAE6OF01A04LK.30.45.E01.1.454.CMB.1.raw
  modified_base (148)..(148): a, c, t, g, unknown or other
  misc_feature (148)..(148): n is a, c, g, or t
tcagcacgctacgtcacgaccggtgctcgatttagtgagtcagtaaggaaggaccaaggtggaatcaacgaactgtggctgcaccatctgtcttcatcttcccgccatctgatatacgatcgctgagcgggctggcaaggcgcatagn

SEQ ID NO: 254485 - DNA, 162 bp, Homo sapiens
  misc_feature: GYAE6OF01CX5RV.30.45.E01.1.454.CMB.1.raw
  modified_base (152)..(162): a, c, t, g, unknown or other
  misc_feature (152)..(162): n is a, c, g, or t
tcagcacgctacgtcacgaccggtgctcgatttagtgagtcagtaagggaagggaccaaggtggaaatcaaacgaactgtggctgcaccatctgtcttcatcttcccgccatctgatatacgatcgctgagcgggctggcaaggcgcatagnnnnnnnnnnn

SEQ ID NO: 254486 - DNA, 193 bp, Homo sapiens
  misc_feature: GYAE6OF01AZ2F6.30.45.E01.1.454.CMB.1.raw
  modified_base (144)..(193): a, c, t, g, unknown or other
  misc_feature (144)..(193): n is a, c, g, or t
tcagcacgctacgtcacgaccggtgctcgatttagtgagtcagtaaggaaggaccaaggtggaatcaacgactgtggctgcaccatctgtcttcatcttcccacctctctactgctagtctgagcggctggcaaggcgcatagnnnnnnnnnnnnnnnnnnnnnnnnnnnnnnnnnnnnnnnnnnnnnnnnnn

SEQ ID NO: 254487 - DNA, 431 bp, Homo sapiens
  misc_feature: GYAE6OF01BNU5V.30.45.E01.1.454.CMB.1.raw
  modified_base (422)..(431): a, c, t, g, unknown or other
  misc_feature (422)..(431): n is a, c, g, or t
tcagcacgctacgtcacgaccggtgctcgatttagtgagtcagtaagggaagggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttccccctggcaccctcctccaagagcacctctgggggcacagcagccctgggctgcctggtcaaggactacttccacgtagcgtgctgagcgggctggcaaggcgcatagnnnnnnnnnn

SEQ ID NO: 254488 - DNA, 431 bp, Homo sapiens
  misc_feature: GYAE6OF01AQWZ0.30.45.E01.1.454.CMB.1.raw
  modified_base (419)..(419): a, c, t, g, unknown or other
  misc_feature (419)..(419): n is a, c, g, or t
  modified_base (421)..(431): a, c, t, g, unknown or other
  misc_feature (421)..(431): n is a, c, g, or t
tcagcacgctacgtcacgaccggtgctcgatttagtgagtcagtaagggaagggctggagtggatttcatatattagtgctggtgctactaccatgaagtacgcagactctgtgagggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactactccacgtagcgtgctgagcgggctggcaaggcgcatagngnnnnnnnnnnn

SEQ ID NO: 254489 - DNA, 151 bp, Homo sapiens
  misc_feature: GYAE6OF01CWQWM.30.45.E01.1.454.CMB.1.raw
  modified_base (151)..(151): a, c, t, g, unknown or other
  misc_feature (151)..(151): n is a, c, g, or t
tcagcacgctacgtcacgaccggtgctcgatttagtgagtcagtaagggaagggaccaaggtggaatcaaacgaactgtggctgcaccatctgtcttcatcttcccaccctcctctactgctagtctgagcgggctggcaaggcgcatagn

SEQ ID NO: 254490 - DNA, 172 bp, Homo sapiens
  misc_feature: GYAE6OF01A2CTZ.30.45.E01.1.454.CMB.1.raw
  modified_base (154)..(172): a, c, t, g, unknown or other
  misc_feature (154)..(172): n is a, c, g, or t
tcagcacgctacgtcacgaccggtgctcgatttagtgagtcagtaagggaaagggaccaaggtggaaatcaaacgaactgtggctgcaccatctgtccttcatcttcccgccatctgatatacgatcgctgagcgggctggcaaggcgcatagnnnnnnnnnnnnnnnnnnn

SEQ ID NO: 254491 - DNA, 155 bp, Homo sapiens
  misc_feature: GYAE6OF01DCNH2.30.45.E01.1.454.CMB.1.raw
  modified_base (153)..(155): a, c, t, g, unknown or other
  misc_feature (153)..(155): n is a, c, g, or t
tcagcacgctacgtcacgaccggtgctcgatttagtgagtcagtaagggaaagggaccaaggtggaaatcaaacgaactgtggctgcaccatctgtcttcatcttcccgccatctgaacgtagcgtgctgagcgggctggcaaggcgcatagnnn

SEQ ID NO: 254492 - DNA, 425 bp, Homo sapiens
  misc_feature: GYAE6OF01D9H5U.30.45.E01.1.454.CMB.1.raw
  modified_base (420)..(425): a, c, t, g, unknown or other
  misc_feature (420)..(425): n is a, c, g, or t
tcagcacgctacgtcacgaccggtgctcgatttagtgagtcagtaagggaagggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctggggcacagcagccctgggctgcctggtcaaggactacttccacgtagcgtgctgagcgggctggcaaggcgcatagnnnnnn

SEQ ID NO: 254493 - DNA, 426 bp, Homo sapiens
  misc_feature: GYAE6OF01DPLAV.30.45.E01.1.454.CMB.1.raw
  modified_base (421)..(426): a, c, t, g, unknown or other
  misc_feature (421)..(426): n is a, c, g, or t
tcagcacgctacgtcacgaccggtgctcgatttagtgagtcagtaagggaaagggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctggggcacagcagccctgggctgcctggtcaaggactacttcctctctcgactctgagcgggctggcaaggcgcatagnnnnnn

SEQ ID NO: 254494 - DNA, 426 bp, Homo sapiens
  misc_feature: GYAE6OF01EAJVF.30.45.E01.1.454.CMB.1.raw
  modified_base (422)..(426): a, c, t, g, unknown or other
  misc_feature (422)..(426): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggccaccctcctccaagagcacctctgggggcacagcagccctgggctgcctggtcaaggactactccacgtagcgtgctgagcgggctggcaaggcgcatagnnnnn

SEQ ID NO: 254495 - DNA, 171 bp, Homo sapiens
  misc_feature: GYAE6OF01DT0JZ.30.45.E01.1.454.CMB.1.raw
  modified_base (153)..(171): a, c, t, g, unknown or other
  misc_feature (153)..(171): n is a, c, g, or t
tcagcacgctacgtcacgaccggtgctcgatttagtgagtcagtaagggaaagggaccaaggtggaaatcaaacgaactgtggctgcaccatctgtcttcatcttcccgccatctgatatacgatcgctgagcgggctggcaaggcgcatagnnnnnnnnnnnnnnnnnnn

SEQ ID NO: 254496 - DNA, 425 bp, Homo sapiens
  misc_feature: GYAE6OF01D3EAA.30.45.E01.1.454.CMB.1.raw
  modified_base (422)..(425): a, c, t, g, unknown or other
  misc_feature (422)..(425): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnn

SEQ ID NO: 254497 - DNA, 425 bp, Homo sapiens
  misc_feature: GYAE6OF01BDXLX.30.45.E01.1.454.CMB.1.raw
  modified_base (421)..(425): a, c, t, g, unknown or other
  misc_feature (421)..(425): n is a, c, g, or t
tcagcacgctacgtcacgaccggtgctcgatttagtgagtcagtaagggaagggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnn

SEQ ID NO: 254498 - DNA, 428 bp, Homo sapiens
  misc_feature: GYAE6OF01ARVIY.30.45.E01.1.454.CMB.1.raw
  modified_base (423)..(428): a, c, t, g, unknown or other
  misc_feature (423)..(428): n is a, c, g, or t
tcagcacgctacgtcacgaccggtgctcgatttagtgagtcagtaagggaagggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttccccctggcaccctcctccaagagcacctctgggggcacagcagccctgggctgcctggtcaaggactacttccacgtagcgtgctgagcgggctgggcaaggcgcatagnnnnnn

SEQ ID NO: 254499 - DNA, 381 bp, Homo sapiens
  misc_feature: GYAE6OF01COYI3.30.45.E01.1.454.CMB.1.raw
  modified_base (236)..(238): a, c, t, g, unknown or other
  misc_feature (236)..(238): n is a, c, g, or t
  modified_base (248)..(248): a, c, t, g, unknown or other
  misc_feature (248)..(248): n is a, c, g, or t
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (256)..(258): a, c, t, g, unknown or other
  misc_feature (256)..(258): n is a, c, g, or t
  modified_base (260)..(260): a, c, t, g, unknown or other
  misc_feature (260)..(260): n is a, c, g, or t
  modified_base (262)..(262): a, c, t, g, unknown or other
  misc_feature (262)..(262): n is a, c, g, or t
  modified_base (267)..(268): a, c, t, g, unknown or other
  misc_feature (267)..(268): n is a, c, g, or t
  modified_base (276)..(276): a, c, t, g, unknown or other
  misc_feature (276)..(276): n is a, c, g, or t
  modified_base (280)..(280): a, c, t, g, unknown or other
  misc_feature (280)..(280): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (289)..(290): a, c, t, g, unknown or other
  misc_feature (289)..(290): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (362)..(362): a, c, t, g, unknown or other
  misc_feature (362)..(362): n is a, c, g, or t
  modified_base (365)..(381): a, c, t, g, unknown or other
  misc_feature (365)..(381): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgagcgggcgtggcaagcgcactagcannnggcaggaccngngctncnnncncncagcnncgtctccncgcnccnccncanncncncgnggcacngcncgcgcgcgcgctcgcgagactactcacgagcgcgctgcgcggcgcgcgagacgcanagnnnnnnnnnnnnnnnnn

SEQ ID NO: 254500 - DNA, 174 bp, Homo sapiens
  misc_feature: GYAE6OF01EJTOX.30.45.E01.1.454.CMB.1.raw
  modified_base (152)..(174): a, c, t, g, unknown or other
  misc_feature (152)..(174): n is a, c, g, or t
tcagcacgctacgtcacgaccggtgctcgatttagtgagtcagtaagggaaagggaccaaggtggaaatcaaacgaactgtggctgcaccatctgtcttcatcttcccgcctccctactgctagtctgagcgggctggcaaggcgtcatagnnnnnnnnnnnnnnnnnnnnnnn

SEQ ID NO: 254501 - DNA, 167 bp, Homo sapiens
  misc_feature: GYAE6OF01AMG2L.30.45.E01.1.454.CMB.1.raw
  modified_base (153)..(167): a, c, t, g, unknown or other
  misc_feature (153)..(167): n is a, c, g, or t
tcagcacgctacgtcacgaccggtgctcgatttagtgagtcagtaagggaaagggaccaaggtggaaatcaaacgaactgtggctgcaccatctgtcttcatcttcccgccatctgatatacgatcgctgagcgggctggcaaggcgcatagnnnnnnnnnnnnnnn

SEQ ID NO: 254502 - DNA, 427 bp, Homo sapiens
  misc_feature: GYAE6OF01BUIM9.30.45.E01.1.454.CMB.1.raw
  modified_base (423)..(427): a, c, t, g, unknown or other
  misc_feature (423)..(427): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttccccctggcaccctcctccaagagcacctctgggggcacagcagccctgggctgcctggtcaaggactacttcctctctcgactctgagcgggctggcaaggcgcatagnnnnn

SEQ ID NO: 254503 - DNA, 156 bp, Homo sapiens
  misc_feature: GYAE6OF01C132B.30.45.E01.1.454.CMB.1.raw
  modified_base (147)..(147): a, c, t, g, unknown or other
  misc_feature (147)..(147): n is a, c, g, or t
  modified_base (153)..(156): a, c, t, g, unknown or other
  misc_feature (153)..(156): n is a, c, g, or t
tcagcacgctacgtcacgaccggtgctcgatttagtgagtcagtaagggaaagggaccaaggtggaaatcaaacgaactgtggctgcaccatctgtcttcatcttcccgccatctgatatacgatcgctgagcgggctggcaaggcncatagnnnn

SEQ ID NO: 254504 - DNA, 154 bp, Homo sapiens
  misc_feature: GYAE6OF01AXUWC.30.45.E01.1.454.CMB.1.raw
  modified_base (153)..(154): a, c, t, g, unknown or other
  misc_feature (153)..(154): n is a, c, g, or t
tcagcacgctacgtcacgaccggtgctcgatttagtgagtcagtaagggaaagggaccaaggtggaaatcaaacgaactgtggctgcaccatctgtcttcatcttcccgccatctgaacgtagcgtgctgagcgggctggcaaggcgcatagnn

SEQ ID NO: 254505 - DNA, 154 bp, Homo sapiens
  misc_feature: GYAE6OF01BYC4M.30.45.E01.1.454.CMB.1.raw
  modified_base (153)..(154): a, c, t, g, unknown or other
  misc_feature (153)..(154): n is a, c, g, or t
tcagcacgctacgtcacgaccggtgctcgatttagtgagtcagtaagggaaagggaccaaggtggaaatcaaacgaactgtggctgcaccatctgtcttcatcttcccaccctcctctactgctagtctgagcgggctggcaaggcgcatagnn

SEQ ID NO: 254506 - DNA, 153 bp, Homo sapiens
  misc_feature: GYAE6OF01DA9UM.30.45.E01.1.454.CMB.1.raw
  modified_base (153)..(153): a, c, t, g, unknown or other
  misc_feature (153)..(153): n is a, c, g, or t
tcagcacgctacgtcacgaccggtgctcgatttagtgagtcagtaagggaaagggaccaaggtggaaatcaaacgaactgtggctgcaccatctgtcttcatcttcccgccatctgatatacgatcgctgagcgggctggcaaggcgcatagn

SEQ ID NO: 254507 - DNA, 153 bp, Homo sapiens; identical to SEQ ID NO: 254506
  misc_feature: GYAE6OF01BLW67.30.45.E01.1.454.CMB.1.raw
  modified_base (153)..(153): a, c, t, g, unknown or other
  misc_feature (153)..(153): n is a, c, g, or t

SEQ ID NO: 254508 - DNA, 154 bp, Homo sapiens; identical to SEQ ID NO: 254505
  misc_feature: GYAE6OF01D4VIG.30.45.E01.1.454.CMB.1.raw
  modified_base (153)..(154): a, c, t, g, unknown or other
  misc_feature (153)..(154): n is a, c, g, or t

SEQ ID NO: 254509 - DNA, 153 bp, Homo sapiens; identical to SEQ ID NO: 254506
  misc_feature: GYAE6OF01E2305.30.45.E01.1.454.CMB.1.raw
  modified_base (153)..(153): a, c, t, g, unknown or other
  misc_feature (153)..(153): n is a, c, g, or t

SEQ ID NO: 254510 - DNA, 427 bp, Homo sapiens
  misc_feature: GYAE6OF01C6S9I.30.45.E01.1.454.CMB.1.raw
  modified_base (423)..(427): a, c, t, g, unknown or other
  misc_feature (423)..(427): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaaggcccatcggtccttccccctggcaccctcctccaagagcacctctgggggcacagcagcccctgggctgcctggtcaaggactacttccacgtagcgtgctgagcgggctggcaaggcgcatagnnnnn

SEQ ID NO: 254511 - DNA, 429 bp, Homo sapiens
  misc_feature: GYAE6OF01BY7TC.30.45.E01.1.454.CMB.1.raw
  modified_base (424)..(429): a, c, t, g, unknown or other
  misc_feature (424)..(429): n is a, c, g, or t
tcagcacgctacgtcacgaccggtgctcgatttagtgagtcagtaagggaagggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccgggagccaacgtcggaccaccctacaccaagactactggggccagggaaccctggtcgccgtctcctccagcctccaccaagggccccatcggtcttccccctggcaccctcctccaagagcacctctggggcacagcagccctgggctgcctggtcaaggactacttccacgtagcgtgctgagcgggctggcaaggcgcatagnnnnnn

SEQ ID NO: 254512 - DNA, 425 bp, Homo sapiens; identical to SEQ ID NO: 254497
  misc_feature: GYAE6OF01AU5WA.30.45.E01.1.454.CMB.1.raw
  modified_base (421)..(425): a, c, t, g, unknown or other
  misc_feature (421)..(425): n is a, c, g, or t

SEQ ID NO: 254513 - DNA, 161 bp, Homo sapiens
  misc_feature: GYAE6OF01ESP60.30.45.E01.1.454.CMB.1.raw
  modified_base (153)..(161): a, c, t, g, unknown or other
  misc_feature (153)..(161): n is a, c, g, or t
tcagcacgctacgtcacgaccggtgctcgatttagtgagtcagtaagggaaagggaccaaggtggaaatcaaacgaactgtggctgcaccatctgtcttcatcttcccgccatctgaacgtagcgtgctgagcgggctggcaaggcgcatagnnnnnnnnn

SEQ ID NO: 254514 - DNA, 159 bp, Homo sapiens
  misc_feature: GYAE6OF01EBMJU.30.45.E01.1.454.CMB.1.raw
  modified_base (153)..(159): a, c, t, g, unknown or other
  misc_feature (153)..(159): n is a, c, g, or t
tcagcacgctacgtcacgaccggtgctcgatttagtgagtcagtaagggaaagggaccaaggtggaaatcaaacgaactgtggctgcaccatctgtcttcatcttcccgccatctgatatacgatcgctgagcgggctggcaaggcgcatagnnnnnnn

SEQ ID NO: 254515 - DNA, 422 bp, Homo sapiens
  misc_feature: GYAE6OF01AYHF7.30.45.E01.1.454.CMB.1.raw
  modified_base (418)..(422): a, c, t, g, unknown or other
  misc_feature (418)..(422): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctcaccaagggcccatcggtcttccccctggcaccctcctccaagagcacctctggggcacagcagccctgggctgcctggtcaaggctactccacgtagcgtgctgagcgggctggcaaggcgcatagnnnnn

SEQ ID NO: 254516 - DNA, 424 bp, Homo sapiens
  misc_feature: GYAE6OF01BYZ9D.30.45.E01.1.454.CMB.1.raw
  modified_base (421)..(424): a, c, t, g, unknown or other
  misc_feature (421)..(424): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactactccacgtagcgtgctgagcgggctggcaaggcgcatagnnnn

SEQ ID NO: 254517 - DNA, 153 bp, Homo sapiens; identical to SEQ ID NO: 254506
  misc_feature: GYAE6OF01B3Y5L.30.45.E01.1.454.CMB.1.raw
  modified_base (153)..(153): a, c, t, g, unknown or other
  misc_feature (153)..(153): n is a, c, g, or t

SEQ ID NO: 254518 - DNA, 429 bp, Homo sapiens
  misc_feature: GYAE6OF01CZ6RH.30.45.E01.1.454.CMB.1.raw
  modified_base (424)..(429): a, c, t, g, unknown or other
  misc_feature (424)..(429): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctcaccaagggcccatcggtcttccccctggccacccctcctccaagagcacctctgggggcacagcagccctgggctgcctggtcaaggactacttccctctctcgactctgagcgggctggcaaggcgcatagnnnnnn

SEQ ID NO: 254519 - DNA, 426 bp, Homo sapiens
  misc_feature: GYAE6OF01B0CS2.30.45.E01.1.454.CMB.1.raw
  modified_base (417)..(417): a, c, t, g, unknown or other
  misc_feature (417)..(417): n is a, c, g, or t
  modified_base (423)..(426): a, c, t, g, unknown or other
  misc_feature (423)..(426): n is a, c, g, or t
tcagcacgctacgtcacgaccggtgctcgatttagtgagtcagtaagggaaagggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggccaccctcctccaagagcacctctgggggcacagcagccctgggctgcctggtcaaggactacttcctctctcgactctgagcgggctggcaaggcncatagnnnn

SEQ ID NO: 254520 - DNA, 485 bp, Homo sapiens
  misc_feature: GYAE6OF01B71EN.30.45.E01.1.454.CMB.1.raw
  modified_base (224)..(224): a, c, t, g, unknown or other
  misc_feature (224)..(224): n is a, c, g, or t
  modified_base (465)..(485): a, c, t, g, unknown or other
  misc_feature (465)..(485): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgtgggccgggnccacgtcgacccacctacaccaagactacgtcgggccgacggaccgtggtccgccgtcctcctcacgcctccaaccgacggcccacgtcggtcccttccccgtggcccaccctccctaccaagacgccacctcggtcggggaccacgacgcacgcccgtgggctcgccgtggtacgaacggtaccttacctccgacgtacgcgtgcgtggacggcgggtcgtggacgaaggcgacagtagnnnnnnnnnnnnnnnnnnnnn

SEQ ID NO: 254521 - DNA, 456 bp, Homo sapiens
  misc_feature: GYAE6OF01AU12S.30.45.E01.1.454.CMB.1.raw
  modified_base (247)..(247): a, c, t, g, unknown or other
  misc_feature (247)..(247): n is a, c, g, or t
  modified_base (432)..(456): a, c, t, g, unknown or other
  misc_feature (432)..(456): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcacctagtttccagggacgacggtccaagaaatcagttatatctacaaatgagtagcctgagagacgaggacacgggctgtgtattactgtgcgggccgggagccactcggaccaccctanaccaagactactggggccagggaaccctggtcgccgtctccgtcagcctccaccaaggggccccatacggtcttccccctggcaccctcctccaaggagcacctctggggcacagcagccctgggctgcctggtcaaggactacttccacgtagcgtgctgagcgggctgggcaaggcgcatagnnnnnnnnnnnnnnnnnnnnnnnnn

SEQ ID NO: 254522 - DNA, 425 bp, Homo sapiens; identical to SEQ ID NO: 254496
  misc_feature: GYAE6OF01DBCQV.30.45.E01.1.454.CMB.1.raw
  modified_base (422)..(425): a, c, t, g, unknown or other
  misc_feature (422)..(425): n is a, c, g, or t

SEQ ID NO: 254523 - DNA, 427 bp, Homo sapiens
  misc_feature: GYAE6OF01CQEHX.30.45.E01.1.454.CMB.1.raw
  modified_base (423)..(427): a, c, t, g, unknown or other
  misc_feature (423)..(427): n is a, c, g, or t
tcagcacgctacgtcacgaccggtgctcgatttagtgagtcagtaagggaaggggctggagtggatttcatatattagtgctggtgctactaccatgaagtacgcagactctgtgagggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttccccctggcacccctcctccaagagcacctctggggcacagcagccctgggctgcctggtcaaggactacttccacatagcgtgctgagcgggctgggcaaggcgcatagnnnnn

SEQ ID NO: 254524 - DNA, 423 bp, Homo sapiens
  misc_feature: GYAE6OF01C3U12.30.45.E01.1.454.CMB.1.raw
  modified_base (423)..(423): a, c, t, g, unknown or other
  misc_feature (423)..(423): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttccaacgtagcgtgctgagcgggctggcaaggcgcatagn

SEQ ID NO: 254525 - DNA, 427 bp, Homo sapiens
  misc_feature: GYAE6OF01DRCDV.30.45.E01.1.454.CMB.1.raw
  modified_base (421)..(427): a, c, t, g, unknown or other
  misc_feature (421)..(427): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccagggcccatcggtcttccccctggcaccctcctccaagacgcacctctggggcacagcagccctgggctgcctggtcaaggactacttccacgtagcgtgctgagcgggctggcaaggcgcatagnnnnnnn

SEQ ID NO: 254526 - DNA, 563 bp, Homo sapiens
  misc_feature: GYAE6OF01CY5DN.30.45.E01.1.454.CMB.1.raw
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (503)..(503): a, c, t, g, unknown or other
  misc_feature (503)..(503): n is a, c, g, or t
  modified_base (506)..(507): a, c, t, g, unknown or other
  misc_feature (506)..(507): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (516)..(516): a, c, t, g, unknown or other
  misc_feature (516)..(516): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (522)..(523): a, c, t, g, unknown or other
  misc_feature (522)..(523): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
  modified_base (529)..(530): a, c, t, g, unknown or other
  misc_feature (529)..(530): n is a, c, g, or t
  modified_base (532)..(535): a, c, t, g, unknown or other
  misc_feature (532)..(535): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (541)..(541): a, c, t, g, unknown or other
  misc_feature (541)..(541): n is a, c, g, or t
  modified_base (543)..(544): a, c, t, g, unknown or other
  misc_feature (543)..(544): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (554)..(554): a, c, t, g, unknown or other
  misc_feature (554)..(554): n is a, c, g, or t
  modified_base (556)..(556): a, c, t, g, unknown or other
  misc_feature (556)..(556): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
tcagcacgctacgtcacgaccggtgctcgatttagtgagtcagtaagggaaggggctggagtggatttccactagttacttagtgctggtgtctactaccatgaagtacgcagactctgtgagggccgattcaccgattttccgaggacgacgccaaggtaaatcagtatattactacaaatgagtagcctgagagacgaggacgacggctggtgtatttacgtgtgccgggccgggggagccgacgtccggacccaccctacgaccaagacgtacgtggggccaaggacccctggtcgccgtctcctcagcctccgaccaagggccccactccggtccttcccccgtggccgaccccgtccgtccgaagacgccaccctcgtggggactaacgagacaggccccgtagggacctgccttaggtccaaaggaccttaacgttccacgtagacgtgcgtgtacggccggcgtgggaccaagggacgaccgtaagtagancngtnctnngngngngcngngngnngngngnngnnnngngngngnngngngtgagngngngngng

SEQ ID NO: 254527 - DNA, 426 bp, Homo sapiens
  misc_feature: GYAE6OF01A99W3.30.45.E01.1.454.CMB.1.raw
  modified_base (423)..(426): a, c, t, g, unknown or other
  misc_feature (423)..(426): n is a, c, g, or t
tcagcacgctacgtcacgaccggtgctcgatttagtgagtcagtaagggaagggggctggagtggatttcatatattagtgctggtgctactaccatgaagtacgcagactctgtgagggccgattcaccatttccagggacgacgccaagaaatcagtatatctacaaatgagtagcctgagagacgaggacacggctgtgtattactgtgcgggccggggagccactcggaccaccctacaccaagactactgggggccagggaaccctggtcgccgtctcctcagcctccaccaagggccccatccggtcttccccctggccaccctcctccaagagcacctctgggggcacagcagccctgggctgcctggtcaaggctactcctcgtagcactctgagcgggctggcaggcgcatagnnnn

SEQ ID NO: 254528 - DNA, 425 bp, Homo sapiens
  misc_feature: GYAE6OF01B1FCX.30.45.E01.1.454.CMB.1.raw
  modified_base (421)..(425): a, c, t, g, unknown or other
  misc_feature (421)..(425): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaaggcccatcggtcttccccctggccaccctcctccaagagcacctctgggggcacagcagccctgggctgcctggtcaaggactactccacgtagcgtgctgagcgggctggcaaggcgcatagnnnnn

SEQ ID NO: 254529 - DNA, 235 bp, Homo sapiens
  misc_feature: GYAE6OF01C3NBN.30.45.E01.1.454.CMB.1.raw
  modified_base (233)..(235): a, c, t, g, unknown or other
  misc_feature (233)..(235): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgagcgggctggcaaggcgcatagnnn

SEQ ID NO: 254530 - DNA, 424 bp, Homo sapiens
  misc_feature: GYAE6OF01C65KG.30.45.E01.1.454.CMB.1.raw
  modified_base (421)..(424): a, c, t, g, unknown or other
  misc_feature (421)..(424): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttccacgtgcgtgctgagcgggctggcaaggcgcatagnnnn

SEQ ID NO: 254531 - DNA, 427 bp, Homo sapiens
  misc_feature: GYAE6OF01CIL6S.30.45.E01.1.454.CMB.1.raw
  modified_base (423)..(427): a, c, t, g, unknown or other
  misc_feature (423)..(427): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagcccctgggctgcctggtcaaggactacttccacgtagcgtgctgagcgggctggcaaggcgcatagnnnnn

SEQ ID NO: 254532 - DNA, 205 bp, Homo sapiens
  misc_feature: GYAE6OF01AFVL1.30.45.E01.1.454.CMB.1.raw
  modified_base (150)..(205): a, c, t, g, unknown or other
  misc_feature (150)..(205): n is a, c, g, or t
tcagcacgctacgtcacgaccggtgctcgatttagtgagtcagtaagggaaagggaccaaggtggaaatcaaacgactgtggctgcaccatctgtcttcatcttcccgcctcctctactgctagtctgagcggctggcaaggcgcatagnnnnnnnnnnnnnnnnnnnnnnnnnnnnnnnnnnnnnnnnnnnnnnnnnnnnnnnn

SEQ ID NO: 254533 - DNA, 429 bp, Homo sapiens
  misc_feature: GYAE6OF01B4HOV.30.45.E01.1.454.CMB.1.raw
  modified_base (425)..(429): a, c, t, g, unknown or other
  misc_feature (425)..(429): n is a, c, g, or t
tcagcacgctacgtcacgaccggtgctcgatttagtgagtcagtaagggaagggctggagtggatttcatatattagtgctggtgctactaccatgaagtacgcagactctgtgagggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagacgcacctctggggcacagccagccctgggctgcctggtcaaggactacttccctctctcgactcctgagtcgggctgggcaaggcgcatagnnnnn

SEQ ID NO: 254534 - DNA, 427 bp, Homo sapiens
  misc_feature: GYAE6OF01A4PHG.30.45.E01.1.454.CMB.1.raw
  modified_base (421)..(427): a, c, t, g, unknown or other
  misc_feature (421)..(427): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctggggcacagcagccctgggctgcctggtcaaggactacttccacgtagcgtgctgagcgggctggcaaggcgcatagnnnnnnn

SEQ ID NO: 254535 - DNA, 164 bp, Homo sapiens
  misc_feature: GYAE6OF01APDIA.30.45.E01.1.454.CMB.1.raw
  modified_base (154)..(164): a, c, t, g, unknown or other
  misc_feature (154)..(164): n is a, c, g, or t
tcagcacgctacgtcacgaccggtgctcgatttagtgagtcagtaagggaaagggaccaaggtggaaatcaaacgaactgtggctgcaccatcctgtcttcatcttcccgccatctgatatacgatcgctgagcgggctggcaaggcgcatagnnnnnnnnnnn

SEQ ID NO: 254536 - DNA, 509 bp, Homo sapiens
  misc_feature: GYAE6OF01BK4U5.30.45.E01.1.454.CMB.1.raw
  modified_base (469)..(469): a, c, t, g, unknown or other
  misc_feature (469)..(469): n is a, c, g, or t
  modified_base (471)..(472): a, c, t, g, unknown or other
  misc_feature (471)..(472): n is a, c, g, or t
  modified_base (474)..(475): a, c, t, g, unknown or other
  misc_feature (474)..(475): n is a, c, g, or t
  modified_base (478)..(478): a, c, t, g, unknown or other
  misc_feature (478)..(478): n is a, c, g, or t
  modified_base (481)..(509): a, c, t, g, unknown or other
  misc_feature (481)..(509): n is a, c, g, or t
tcagcacgctacgtcacgaccggtgctcgatttagtgagtcagtaagggaagggggtcgtggagtggactttcatatattaagtgctggttgctactaccatgaagtacgcagactctgtgagggccgattcaccattttccgagggacgacgccaaggtaaatcagtatattctacaaatgagtagcctgagagacgaggacacggctgtggtattactgtgcgggccgggagccactcggaccaccctacaccaagactactggggccagggaaccctggtcgcccgtctccgtcacgcctccaccaagggccccatcggtcgttcccccctggccaccccgtcctcccgaacgacggccaccgtacgtcggggggcacaagcaagcccgtagggctggcctaggtacaaaggacttacgttccgacggtacgccgtgcgtcgagtcgggctggcaaggcgcatagnanncnntcnagnnnnnnnnnnnnnnnnnnnnnnnnnnnnn

SEQ ID NO: 254537 - DNA, 461 bp, Homo sapiens
  misc_feature: GYAE6OF01BD597.30.45.E01.1.454.CMB.1.raw
  modified_base (224)..(224): a, c, t, g, unknown or other
  misc_feature (224)..(224): n is a, c, g, or t
  modified_base (429)..(429): a, c, t, g, unknown or other
  misc_feature (429)..(429): n is a, c, g, or t
  modified_base (432)..(461): a, c, t, g, unknown or other
  misc_feature (432)..(461): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggganccactcggaccaccctacaccaagactactgggggccagggaaccctggtcgccgtctcctcagcctccaccaagggccccatcggtcttcccccctggccaccctcctccaagacgcacctctcgggggcacacgcacgccctgggctgcctggtcaaggactactcacgtagcgtgctgagcgggctggcaaggcgcagtagncgnnnnnnnnnnnnnnnnnnnnnnnnnnnnnn

SEQ ID NO: 254538 - DNA, 153 bp, Homo sapiens; identical to SEQ ID NO: 254506
  misc_feature: GYAE6OF01B1F7Z.30.45.E01.1.454.CMB.1.raw
  modified_base (153)..(153): a, c, t, g, unknown or other
  misc_feature (153)..(153): n is a, c, g, or t

SEQ ID NO: 254539 - DNA, 155 bp, Homo sapiens
  misc_feature: GYAE6OF01DWSSL.30.45.E01.1.454.CMB.1.raw
  modified_base (154)..(155): a, c, t, g, unknown or other
  misc_feature (154)..(155): n is a, c, g, or t
tcagcacgctacgttcacgaccggtgctcgatttagtgagtcagtaagggaaagggaccaaggtggaaatcaaacgaactgtggctgcaccatctgtcttcatcttcccgccatctgatatacgatcgctgagcgggctggcaaggcgcatagnn

SEQ ID NO: 254540 - DNA, 432 bp, Homo sapiens
  misc_feature: GYAE6OF01DSMR6.30.45.E01.1.454.CMB.1.raw
  modified_base (334)..(334): a, c, t, g, unknown or other
  misc_feature (334)..(334): n is a, c, g, or t
  modified_base (427)..(432): a, c, t, g, unknown or other
  misc_feature (427)..(432): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccgggagccactcggaccaccctacaccaagactactggggccagggaaccctggtcgccgtctcctcagcctccaccaagggcccatcggtcttccccctggcaccctcctccaanacgcacctctgggggcacgagcacgccctggggctcgcctggtcaaggactacttccacgtagcgtgctgagcgggctggcaaggcgcatagnnnnnn

SEQ ID NO: 254541 - DNA, 429 bp, Homo sapiens
  misc_feature: GYAE6OF01A58CK.30.45.E01.1.454.CMB.1.raw
  modified_base (423)..(429): a, c, t, g, unknown or other
  misc_feature (423)..(429): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttccccctggcaccctcctccaagagcacctctgggggcacagcagccctgggctgcctggtcaaggactacttccacgtagcgtgctgagcgggctggcaaggcgcatagnnnnnnn

SEQ ID NO: 254542 - DNA, 425 bp, Homo sapiens
  misc_feature: GYAE6OF01DFKZG.30.45.E01.1.454.CMB.1.raw
  modified_base (422)..(425): a, c, t, g, unknown or other
  misc_feature (422)..(425): n is a, c, g, or t
tcagcacgctacgtcacgaccggtgctcgatttagtgagtcagtaagggaagggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccgggagccactcggaccacctacaccaagactactggggccagggaaccctggtcgccgtctcctcagcctccaccaagggcccatcggtcttccccctcggcaccctcctccaagacgcacctctgggggcacagcagccctgggctgcctggtcaaggactacttccacgtagcgtgctgagcgggctggcaaggcgcatagnnnn

SEQ ID NO: 254543 - DNA, 153 bp, Homo sapiens; identical to SEQ ID NO: 254506
  misc_feature: GYAE6OF01BNI3T.30.45.E01.1.454.CMB.1.raw
  modified_base (153)..(153): a, c, t, g, unknown or other
  misc_feature (153)..(153): n is a, c, g, or t

SEQ ID NO: 254544 - DNA, 432 bp, Homo sapiens
  misc_feature: GYAE6OF01CUS0C.30.45.E01.1.454.CMB.1.raw
  modified_base (424)..(432): a, c, t, g, unknown or other
  misc_feature (424)..(432): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccgggagccacgtcggaccaccctacaccaagactacgtggggccgagggaaccctggtcgccgtctcctcagcctccaccaggcccatcggtcttcccctgcaccctcctccaagagcacctcgtgggggcacagcagcccctgggctcgcctggtcaaggactacttccacgtagcgtgctgagcgggctggcaaggcgcatagnnnnnnnnn

SEQ ID NO: 254545 - DNA, 428 bp, Homo sapiens
  misc_feature: GYAE6OF01C21BS.30.45.E01.1.454.CMB.1.raw
  modified_base (424)..(428): a, c, t, g, unknown or other
  misc_feature (424)..(428): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactactggggccagggaaccctggtcgccgtctcctcagcctccaccaagggcccatcggtcttccccctggcacccctcctccaagagcacctctgggggcacagcagccctgggctgcctggtcaaggactacttccacgtagcgtgctgagcgggctggcaaggcgcatagnnnnn

SEQ ID NO: 254546 - DNA, 425 bp, Homo sapiens
  misc_feature: GYAE6OF01ES30I.30.45.E01.1.454.CMB.1.raw
  modified_base (422)..(425): a, c, t, g, unknown or other
  misc_feature (422)..(425): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggccaccctcctccaagagcacctctgggggcacagcagccctgggctgcctggtcaaggactactccacgtagcgtgctgagcgggctggcaaggcgcatagnnnn

SEQ ID NO: 254547 - DNA, 432 bp, Homo sapiens
  misc_feature: GYAE6OF01D9EYS.30.45.E01.1.454.CMB.1.raw
  modified_base (427)..(432): a, c, t, g, unknown or other
  misc_feature (427)..(432): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccacgtcggaccaccctacaccaagactactggggccagggaaccctggtcgccgtctcctcagcctccaccagggcccatcggtcttccccctggccaccctcctccaagacgcacctcgtcgggggcacagcacgccctgggctcgcctggtacaaggactactcctctctcgactctgagcggctggcaaggcgcatagnnnnnn

SEQ ID NO: 254548 - DNA, 613 bp, Homo sapiens
  misc_feature: GYAE6OF01ACMCW.30.45.E01.1.454.CMB.1.raw
  modified_base (530)..(530): a, c, t, g, unknown or other
  misc_feature (530)..(530): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (544)..(544): a, c, t, g, unknown or other
  misc_feature (544)..(544): n is a, c, g, or t
  modified_base (605)..(605): a, c, t, g, unknown or other
  misc_feature (605)..(605): n is a, c, g, or t
tcagcacgctacgtcacgaccggtgctcgatttagtgagtcagtaagggaagggggctggagtggatttccatagtattagtgctggtgctactaccagtcgaagtacgcagactcctggtgaggggccgattcaccattttccgagggacgacgccgaagaaactcaggtatatctacaaatgagtacgcctgagagaccgaggacacggctgtgtattacgtggtgcgggccggggagccactcggaccaccctacaccaaggactactggggccagggaaccctggtcgccgttactccgtcagcctccaaccaaggggcccagtccggtaccttccccctggccaccctcctccaacgagccaccttcgtacgggggccgaccagtccaacggtcccctagggggctacggccgtagggtccaaaggggaccttacgttttaccctttccttccttaccggtaaccttccgttacggaacggccggggtccttggggccaaacggggccggacgtaagtttacggnacactntngacacnctctctctctctcgtcgtcgtcgcgacgcgcgacgacacgacgatgcgcgacactacactntctctctc

SEQ ID NO: 254549 - DNA, 427 bp, Homo sapiens
  misc_feature: GYAE6OF01E2T25.30.45.E01.1.454.CMB.1.raw
  modified_base (423)..(427): a, c, t, g, unknown or other
  misc_feature (423)..(427): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctgggcaaggcgcatagnnnnn

SEQ ID NO: 254550 - DNA, 425 bp, Homo sapiens
  misc_feature: GYAE6OF01ES5MZ.30.45.E01.1.454.CMB.1.raw
  modified_base (224)..(224): a, c, t, g, unknown or other
  misc_feature (224)..(224): n is a, c, g, or t
  modified_base (421)..(425): a, c, t, g, unknown or other
  misc_feature (421)..(425): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggganccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactactcctctctcgactctgagcgggctggcaaggcgcatagnnnnn

SEQ ID NO: 254551 - DNA, 444 bp, Homo sapiens
  misc_feature: GYAE6OF01DQ1FO.30.45.E01.1.454.CMB.1.raw
  modified_base (256)..(256): a, c, t, g, unknown or other
  misc_feature (256)..(256): n is a, c, g, or t
  modified_base (439)..(444): a, c, t, g, unknown or other
  misc_feature (439)..(444): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccaactcggaccacctacaccaagactacnggggccagggaaccctggtcgccgtctcctcagcctccaccgaacgggcccatccggtccttccccctggccacccctcctccaagacgccacctcgtcgggggcacgagcacgccccgtggggctgcctggtcaaggactactcctctctcgactctgacgcgggctggcaaggcgcatagnnnnnn

SEQ ID NO: 254552 - DNA, 235 bp, Homo sapiens
  misc_feature: GYAE6OF01BK9IU.30.45.E01.1.454.CMB.1.raw
  modified_base (232)..(235): a, c, t, g, unknown or other
  misc_feature (232)..(235): n is a, c, g, or t
tcagcacgctacgtcacgaccggtgctcgatttagtgagtcagtaagggaaggggctggagtggatttcatatattagtgctggtgctactaccatgaagtacgcagactctgtgagggccgattcaccatttccagggacgacgccaagaaatcagtatatctacaaatgagtagcctgagagacgaggacacggctgtgtattactgagcgggctggcaaggcgcatagnnnn

SEQ ID NO: 254553 - DNA, 425 bp, Homo sapiens
  misc_feature: GYAE6OF01CCVAD.30.45.E01.1.454.CMB.1.raw
  modified_base (421)..(425): a, c, t, g, unknown or other
  misc_feature (421)..(425): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactactccacgtagcgtgctgagcgggctggcaaggcgcatagnnnnn

SEQ ID NO: 254554 - DNA, 437 bp, Homo sapiens
  misc_feature: GYAE6OF01DZXNF.30.45.E01.1.454.CMB.1.raw
  modified_base (424)..(437): a, c, t, g, unknown or other
  misc_feature (424)..(437): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttccccctggcaccctcctccaagagcacctctgggggcacagcagccctgggctcgcctggtcaaggactacttcctctctcgactctgagcgggctggcaaggcgcatagnnnnnnnnnnnnnn

SEQ ID NO: 254555 - DNA, 426 bp, Homo sapiens
  misc_feature: GYAE6OF01B4EP6.30.45.E01.1.454.CMB.1.raw
  modified_base (423)..(426): a, c, t, g, unknown or other
  misc_feature (423)..(426): n is a, c, g, or t
tcagcacgctacgtcacgaccggtgctcgatttagtgagtcagtaagggaagggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggccacccctcctccaagagcacctctcgggggcacagcagccctgggctgcctggtcaaggctacttcctctctcgactctgagcgggctggcaaggcgcatagnnnn

SEQ ID NO: 254556 - DNA, 429 bp, Homo sapiens
  misc_feature: GYAE6OF01EYOGE.30.45.E01.1.454.CMB.1.raw
  modified_base (423)..(429): a, c, t, g, unknown or other
  misc_feature (423)..(429): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttccccctggcaccctcctccaagagcacctctgggggcacagcagccctgggctgcctggtcaaggctactccacgtagcgtgctgagcgggctgggcaaggcgcagtagnnnnnnn

SEQ ID NO: 254557 - DNA, 427 bp, Homo sapiens
  misc_feature: GYAE6OF01B8H9F.30.45.E01.1.454.CMB.1.raw
  modified_base (422)..(427): a, c, t, g, unknown or other
  misc_feature (422)..(427): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnn

SEQ ID NO: 254558 - DNA, 429 bp, Homo sapiens
  misc_feature: GYAE6OF01AL96V.30.45.E01.1.454.CMB.1.raw
  modified_base (422)..(429): a, c, t, g, unknown or other
  misc_feature (422)..(429): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcacccctcctccaagacgcacctctgggggcacagcagccctgggctgcctggtcaaggctactccacgtagcgtgctgagcgggctggcaaggcgcatagnnnnnnnn

SEQ ID NO: 254559 - DNA, 426 bp, Homo sapiens
  misc_feature: GYAE6OF01AB9UA.30.45.E01.1.454.CMB.1.raw
  modified_base (423)..(426): a, c, t, g, unknown or other
  misc_feature (423)..(426): n is a, c, g, or t
tcagcacgctacgtcacgaccggtgctcgatttagtgagtcagtaagggaagggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttccccctggcaccctcctccaacgagcacctctgggggcacagcagccctgggctgcctggtcaaggactacttccacgtagcgtgctgagcgggctggcaaggcgcatagnnnn

SEQ ID NO: 254560 - DNA, 428 bp, Homo sapiens
  misc_feature: GYAE6OF01AQ2ZB.30.45.E01.1.454.CMB.1.raw
  modified_base (422)..(428): a, c, t, g, unknown or other
  misc_feature (422)..(428): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactactcctctctcgactctgagcgggctggcaaggcgcatagnnnnnnn

SEQ ID NO: 254561 - DNA, 431 bp, Homo sapiens
  misc_feature: GYAE6OF01CP7P4.30.45.E01.1.454.CMB.1.raw
  modified_base (423)..(431): a, c, t, g, unknown or other
  misc_feature (423)..(431): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggccaccctcctccaagagcacctctgggggcacagcagccctgggctgcctggtcaaggactacttccacgtagcgtgctgagcgggctggcaaggcgcatagnnnnnnnnn

SEQ ID NO: 254562 - DNA, 426 bp, Homo sapiens
  misc_feature: GYAE6OF01D14UI.30.45.E01.1.454.CMB.1.raw
  modified_base (421)..(426): a, c, t, g, unknown or other
  misc_feature (421)..(426): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagacgcacctctgggggcacagcagccctgggctgcctggtcaaggctactccacgtagcgtgctgagcgggctggcaaggcgcatagnnnnnn

SEQ ID NO: 254563 - DNA, 428 bp, Homo sapiens
  misc_feature: GYAE6OF01BMIVK.30.45.E01.1.454.CMB.1.raw
  modified_base (422)..(428): a, c, t, g, unknown or other
  misc_feature (422)..(428): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnnn

SEQ ID NO: 254564 - DNA, 427 bp, Homo sapiens
  misc_feature: GYAE6OF01D57B0.30.45.E01.1.454.CMB.1.raw
  modified_base (424)..(427): a, c, t, g, unknown or other
  misc_feature (424)..(427): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttccccctggcacccctcctcccaagagcacctctgggggcacagcagccctgggctgcctggtcaaggactactccacgtagcgtgctgagcgggctggcaaggcgcatagnnnn

SEQ ID NO: 254565 - DNA, 427 bp, Homo sapiens
  misc_feature: GYAE6OF01AN4ZW.30.45.E01.1.454.CMB.1.raw
  modified_base (421)..(427): a, c, t, g, unknown or other
  misc_feature (421)..(427): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttccccctggcaccctcctccaagagcacctctggggcacagcagccctgggctgcctggtcaaggctacttccacgtagcgtgctgagcgggctggcaaggcgcatagnnnnnnn

SEQ ID NO: 254566 - DNA, 435 bp, Homo sapiens
  misc_feature: GYAE6OF01C09DS.30.45.E01.1.454.CMB.1.raw
  modified_base (429)..(435): a, c, t, g, unknown or other
  misc_feature (429)..(435): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttcccccctggccacccctccctcccaagacgcacctctgggggccacagcagccctgggctgcctggtcaaggactactccacgtagcgtgctgagcgggctggcaaggcgcatagnnnnnnn

SEQ ID NO: 254567 - DNA, 431 bp, Homo sapiens
  misc_feature: GYAE6OF01DT83I.30.45.E01.1.454.CMB.1.raw
  modified_base (424)..(431): a, c, t, g, unknown or other
  misc_feature (424)..(431): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactactggggccagggaaccctggtcgccgtctcctcagcctccaccaagggcccatcggtcttcccctggcaccctcctccaagacgcacctctgggggcacagcagccctgggctgcctggtcaaggactacttccacgtagcgtgctgagcgggctggcaaggcgcatacgnnnnnnnn

SEQ ID NO: 254568 - DNA, 429 bp, Homo sapiens
  misc_feature: GYAE6OF01EY433.30.45.E01.1.454.CMB.1.raw
  modified_base (225)..(225): a, c, t, g, unknown or other
  misc_feature (225)..(225): n is a, c, g, or t
  modified_base (422)..(429): a, c, t, g, unknown or other
  misc_feature (422)..(429): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggganccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactactcctctctcgactctgagcgggctggcaaggcgcatagnnnnnnnn

SEQ ID NO: 254569 - DNA, 434 bp, Homo sapiens
  misc_feature: GYAE6OF01C65GJ.30.45.E01.1.454.CMB.1.raw
  modified_base (426)..(434): a, c, t, g, unknown or other
  misc_feature (426)..(434): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactccggaccaccctacaccaagactacgtggggccagggaaccctggtcgccgtctcctcagcctccaccaagggcccatcggtcttccccctggcaccctcctccaagacgcacctctgggggcacagcagccctgggctgcctggtcaaggactacttccacgtagcgtgctgagcgggctggcaaggcgcatagnnnnnnnnn

SEQ ID NO: 254570 - DNA, 429 bp, Homo sapiens
  misc_feature: GYAE6OF01C2R59.30.45.E01.1.454.CMB.1.raw
  modified_base (422)..(429): a, c, t, g, unknown or other
  misc_feature (422)..(429): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccagggcccatcggtccttccccctggcacccctcctccaagagcacctctgggggcacagcagccctgggctgcctggtcaaggactacttcacgtagcgtgctgagcgggctggcaaggcgcatagnnnnnnnn

SEQ ID NO: 254571 - DNA, 429 bp, Homo sapiens
  misc_feature: GYAE6OF01BLFJJ.30.45.E01.1.454.CMB.1.raw
  modified_base (422)..(429): a, c, t, g, unknown or other
  misc_feature (422)..(429): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctggggcacagcacgccctgggctgcctggtcaaggactacttccacgtagcgtgctgagcgggctggcaaggcgcatagnnnnnnnn

SEQ ID NO: 254572 - DNA, 436 bp, Homo sapiens
  misc_feature: GYAE6OF01EW32Z.30.45.E01.1.454.CMB.1.raw
  modified_base (224)..(224): a, c, t, g, unknown or other
  misc_feature (224)..(224): n is a, c, g, or t
  modified_base (413)..(413): a, c, t, g, unknown or other
  misc_feature (413)..(413): n is a, c, g, or t
  modified_base (419)..(436): a, c, t, g, unknown or other
  misc_feature (419)..(436): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggganccactcgggaccaccctacaccaagactactgggggccagggaaccctggtcgccgtctcctcagcctcaccaggcccatcggtctcccctggccaccctcctccaagagcacctctggggcacgagcagccctgggctgcctggtcaaggctactccacgtagcgtgctgagcgggctggcaaggcgnatacgnnnnnnnnnnnnnnnnnn

SEQ ID NO: 254573 - DNA, 427 bp, Homo sapiens
  misc_feature: GYAE6OF01EUYBG.30.45.E01.1.454.CMB.1.raw
  modified_base (422)..(427): a, c, t, g, unknown or other
  misc_feature (422)..(427): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttccccctggcaccctcctccaagagcacctctgggggcacagcagccctgggctgcctggtcaaggactactccacgtagcgtgctgagcgggctggcaaggcgcatagnnnnnn

SEQ ID NO: 254574 - DNA, 431 bp, Homo sapiens
  misc_feature: GYAE6OF01BR2YL.30.45.E01.1.454.CMB.1.raw
  modified_base (425)..(431): a, c, t, g, unknown or other
  misc_feature (425)..(431): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgtggagccactcggaccaccctacaccaagactactggggccagggaaccctggtcgccgtctcctcagcctccaccaagggcccatcggtcttccccctggcaccctcctccaagacgcacctctcgggggcacagcagccctgggctgcctggtcaaggactacttccacgtagcgtgctgagcgggctgggcaaggcgcatagnnnnnnn

SEQ ID NO: 254575 - DNA, 459 bp, Homo sapiens
  misc_feature: GYAE6OF01CPQWH.30.45.E01.1.454.CMB.1.raw
  modified_base (356)..(356): a, c, t, g, unknown or other
  misc_feature (356)..(356): n is a, c, g, or t
  modified_base (427)..(427): a, c, t, g, unknown or other
  misc_feature (427)..(427): n is a, c, g, or t
  modified_base (431)..(459): a, c, t, g, unknown or other
  misc_feature (431)..(459): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactactggggccagggaaccctggtcgccgtctcctcagcctccaccaagggcccatcggtcttcccccctggccaccctcctccaagacgcacctctgggggcacngcagccctgggctgcctggtcaaggactactccacgtagcgtgctgagcgggctggcaaggcgcacgtagnagcnnnnnnnnnnnnnnnnnnnnnnnnnnnnn

SEQ ID NO: 254576 - DNA, 446 bp, Homo sapiens
  misc_feature: GYAE6OF01DFGER.30.45.E01.1.454.CMB.1.raw
  modified_base (225)..(225): a, c, t, g, unknown or other
  misc_feature (225)..(225): n is a, c, g, or t
  modified_base (438)..(446): a, c, t, g, unknown or other
  misc_feature (438)..(446): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccgggganccactcggaccacctacaccaagactacgtggggccagggaaccctggtcgccgtctcctcacgcctccaccaacgggcccatcggtccttccccctcggccacccctcctccaacgacgccacctctgggggcacagcacgccctgggctgcctggtacaacggactactccgacgtagcgtcgctgaggcgggctggcaaggcgcgatagnnnnnnnnn

SEQ ID NO: 254577 - DNA, 428 bp, Homo sapiens
  misc_feature: GYAE6OF01DCLM5.30.45.E01.1.454.CMB.1.raw
  modified_base (424)..(428): a, c, t, g, unknown or other
  misc_feature (424)..(428): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttccccctcggcaccctcctccaagagcacctctgggggcacagcagccctgggctgcctggtcaaggactacttccacgtagcgtgctgagcgggctggcaaggcgcatagnnnnn

SEQ ID NO: 254578 - DNA, 428 bp, Homo sapiens
  misc_feature: GYAE6OF01E4E2A.30.45.E01.1.454.CMB.1.raw
  modified_base (424)..(428): a, c, t, g, unknown or other
  misc_feature (424)..(428): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttccccctggcaccctcctccaagacgcacctctgggggcacagcagccctgggctgcctggtcaaggactactcctctctcgactctgagcgggctggcaaggcgcatagnnnnn

SEQ ID NO: 254579 - DNA, 423 bp, Homo sapiens
  misc_feature: GYAE6OF01E48BF.30.45.E01.1.454.CMB.1.raw
  modified_base (421)..(423): a, c, t, g, unknown or other
  misc_feature (421)..(423): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnn

SEQ ID NO: 254580 - DNA, 430 bp, Homo sapiens
  misc_feature: GYAE6OF01D2ZPG.30.45.E01.1.454.CMB.1.raw
  modified_base (417)..(417): a, c, t, g, unknown or other
  misc_feature (417)..(417): n is a, c, g, or t
  modified_base (423)..(430): a, c, t, g, unknown or other
  misc_feature (423)..(430): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacgggctgtgtattactgtgcgggccggggagccactcggaccaccctacaccaagactactggggccagggaaccctggtcgccgtctcctcagcctccaccaagggccccatcggtcttccccctggccaccctcctccaagagcacctctggggcacagcagccctgggctgcctggtcaaggctactcctcgtacgcactctgagcgggctggcaaggcncatagnnnnnnnn

SEQ ID NO: 254581 - DNA, 426 bp, Homo sapiens
  misc_feature: GYAE6OF01A8W73.30.45.E01.1.454.CMB.1.raw
  modified_base (422)..(426): a, c, t, g, unknown or other
  misc_feature (422)..(426): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnn

SEQ ID NO: 254582 - DNA, 429 bp, Homo sapiens
  misc_feature: GYAE6OF01EL3UX.30.45.E01.1.454.CMB.1.raw
  modified_base (423)..(429): a, c, t, g, unknown or other
  misc_feature (423)..(429): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttccccctggcaccctcctccaagagcacctctgggggcacagcagccctgggctgcctggtcaaggactacttcctctctcgactctgagcgggctggcaaggcgcatagnnnnnnn

SEQ ID NO: 254583 - DNA, 430 bp, Homo sapiens
  misc_feature: GYAE6OF01A5EHB.30.45.E01.1.454.CMB.1.raw
  modified_base (425)..(430): a, c, t, g, unknown or other
  misc_feature (425)..(430): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagaacctgagagacgaggacacggctgtgtattactgtgcgggccggggagccactcggaccaccctacaccaagactactggggccagggaaccctggtcgccgtctcctcagcctccaccaagggccccatcggtcttccccctggccaccctcctccaagagcacctctgggggcacagcagccctgggctgcctggtcaaggactactccacgtagcgtgctgagcgggctggcaaggcgcatagnnnnnn

SEQ ID NO: 254584 - DNA, 470 bp, Homo sapiens
  misc_feature: GYAE6OF01EN6EK.30.45.E01.1.454.CMB.1.raw
  modified_base (441)..(470): a, c, t, g, unknown or other
  misc_feature (441)..(470): n is a, c, g, or t
tcagcacgctacgtcacgaccggtgctcgatttagtgagtcagtaagggaagggggctggagtggatttcatatacttagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccacgtccggaccaccctacaccaagactactggggccagggaaccctggtcgccgtctcctcagcctccaccaagggccccatcggtccttcccccgtgggccaccctccgtccaaggacgcacctcgtagggggcacagcacgcccgtggctgcctggtcaaggacctaccgtccacgtagcgtgcctgagcgggctggcgaaggcgcatagcnnnnnnnnnnnnnnnnnnnnnnnnnnnnnn

SEQ ID NO: 254585 - DNA, 432 bp, Homo sapiens
  misc_feature: GYAE6OF01C08UW.30.45.E01.1.454.CMB.1.raw
  modified_base (428)..(432): a, c, t, g, unknown or other
  misc_feature (428)..(432): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactacgtggggccagggaaccctggtcgccgtctcctcagcctccaccaacgggcccatcggtcttccccctggccacccctcctccaagagcacctctgggggcacagcagccctgggctgcctggtcaaggactacttcccacgtagcgtgctgagcgggctggcaaggcgcatagnnnnn

SEQ ID NO: 254586 - DNA, 153 bp, Homo sapiens
  misc_feature: GYAE6OF01CODUI.30.45.E01.1.454.CMB.1.raw
  modified_base (153)..(153): a, c, t, g, unknown or other
  misc_feature (153)..(153): n is a, c, g, or t
tcagcacgctacgtcacgaccggtgctcgatttagtgagtcagtaagggaaagggaccaaggtggaaatcaaacgaactgtggctgcaccatctgtcttcatcttcccgccctcctctactgctagtctgagcgggctggcaaggcgcatagn

SEQ ID NO: 254587 - DNA, 427 bp, Homo sapiens
  misc_feature: GYAE6OF01EDGYG.30.45.E01.1.454.CMB.1.raw
  modified_base (422)..(427): a, c, t, g, unknown or other
  misc_feature (422)..(427): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggctacttccacgtagcgtgctgagcgggctggcaaggcgcagtagnnnnnn

SEQ ID NO: 254588 - DNA, 426 bp, Homo sapiens
  misc_feature: GYAE6OF01AWNFE.30.45.E01.1.454.CMB.1.raw
  modified_base (419)..(426): a, c, t, g, unknown or other
  misc_feature (419)..(426): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctggggcacagcagccctgggctgcctggtcaaggactactccacgtagcgtgctgagcgggctggcaggcgcatagnnnnnnnn

SEQ ID NO: 254589 - DNA, 152 bp, Homo sapiens
  misc_feature: GYAE6OF01AUI6D.30.45.E01.1.454.CMB.1.raw
tcagcacgctacgtcacgaccggtgctcgatttagtgagtcagtaagggaaagggaccaaggtggaaatcaaacgaactgtggctgcaccatctgtcttcatcttcccgccctcctctactgctagtctgagcgggctggcaaggcgcatag

SEQ ID NO: 254590 - DNA, 439 bp, Homo sapiens
  misc_feature: GYAE6OF01B1WKB.30.45.E01.1.454.CMB.1.raw
  modified_base (425)..(439): a, c, t, g, unknown or other
  misc_feature (425)..(439): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccacgtcggaccaccctacaccaagactactggggccagggaaccctggtcgccgtctcctcagcctccaccaagggccccatcggtcttccccctggcaccctcctccaagagcacctctgggggcacagcagccctgggctgcctggtcaaggactacttccacgtagcgtgctgagcgggctggcaaggcgcatagcnnnnnnnnnnnnnnn

SEQ ID NO: 254591 - DNA, 426 bp, Homo sapiens
  misc_feature: GYAE6OF01AFO6X.30.45.E01.1.454.CMB.1.raw
  modified_base (420)..(426): a, c, t, g, unknown or other
  misc_feature (420)..(426): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactactccacgtagcgtgctgagcgggctggcaggcgcatagnnnnnnn

SEQ ID NO: 254592 - DNA, 440 bp, Homo sapiens
  misc_feature: GYAE6OF01A5HIS.30.45.E01.1.454.CMB.1.raw
  modified_base (429)..(440): a, c, t, g, unknown or other
  misc_feature (429)..(440): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtccttccccctggccaccctcctccaagacgcacctcgtgggggcacacgcacgccctcgggctcgccgtggtcaacggactactccacgtagcgtgctgagcgggctggcaggcgcatgnnnnnnnnnnnn

SEQ ID NO: 254593 - DNA, 442 bp, Homo sapiens
  misc_feature: GYAE6OF01DI8TC.30.45.E01.1.454.CMB.1.raw
  modified_base (437)..(442): a, c, t, g, unknown or other
  misc_feature (437)..(442): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcacatttccagggacgacgccaagaaatcagtatatctacaaatgagtagcctgagagacgaggacacggctgtgtattactgtgcggggccggggagccactcggaccacctacaccaagactacgtggggccagggaaccctggtcgccggtctcctccagcctccaccaagggcccactcggtccttccccctggccaccctccctccaagacgcaccctcgtcgggggcacacgcacgccccgtgggctgccgtggtcgaaggactacttccacgtagcgtgctgagcgggctggcaggcgcatagnnnnnn

SEQ ID NO: 254594 - DNA, 434 bp, Homo sapiens
  misc_feature: GYAE6OF01DP4ZC.30.45.E01.1.454.CMB.1.raw
  modified_base (424)..(434): a, c, t, g, unknown or other
  misc_feature (424)..(434): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactactggggccagggaaccctggtcgccgtctcctcagcctccaccaagggccccatcggtccttcccctggcaccctcctccaagcgcacctctgggggcacagcagccctgggctgcctggtcaaggactacttcctctctcgactctgagcgggctggcaaggcgcatagnnnnnnnnnnn

SEQ ID NO: 254595 - DNA, 429 bp, Homo sapiens
  misc_feature: GYAE6OF01BEQYO.30.45.E01.1.454.CMB.1.raw
  modified_base (424)..(429): a, c, t, g, unknown or other
  misc_feature (424)..(429): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcacccctcctccaagagcacctctgggggcacagcagccctgggctgcctggtcaaggactacttccacgtagcgtgctgagcgggctgggcaaggcgcatagnnnnnn

SEQ ID NO: 254596 - DNA, 430 bp, Homo sapiens
  misc_feature: GYAE6OF01B30HJ.30.45.E01.1.454.CMB.1.raw
  modified_base (421)..(430): a, c, t, g, unknown or other
  misc_feature (421)..(430): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttccccctggcaccctcctccaagagcacctctgggggcacagcagccctgggctgcctggtcaaggactactccacgtagcgtgctgagcgggctggcaggcgcatagnnnnnnnnnn

SEQ ID NO: 254597 - DNA, 472 bp, Homo sapiens
  misc_feature: GYAE6OF01CQKMK.30.45.E01.1.454.CMB.1.raw
  modified_base (326)..(326): a, c, t, g, unknown or other
  misc_feature (326)..(326): n is a, c, g, or t
  modified_base (432)..(433): a, c, t, g, unknown or other
  misc_feature (432)..(433): n is a, c, g, or t
  modified_base (435)..(437): a, c, t, g, unknown or other
  misc_feature (435)..(437): n is a, c, g, or t
  modified_base (441)..(472): a, c, t, g, unknown or other
  misc_feature (441)..(472): n is a, c, g, or t
tcagcacgctacgtcacgaccggtgctcgatttagtgagtcagtaagggaagggggctgggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactactggggccagggaaccctggtcgccgtctcctcagcctccaccaagggcccatcggtcttccccctggccncccctcctccaagcgcaccctcgtgggggcacgagcacgccctgggctgcctggtcgaaggactacttccacgtagcgtgctgagcgggctggcaggcgcagtagnnannnagcnnnnnnnnnnnnnnnnnnnnnnnnnnnnnnnn

SEQ ID NO: 254598 - DNA, 431 bp, Homo sapiens
  misc_feature: GYAE6OF01EAB69.30.45.E01.1.454.CMB.1.raw
  modified_base (424)..(431): a, c, t, g, unknown or other
  misc_feature (424)..(431): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactactggggccagggaaccctggtcgccgtctcctcagcctccaccaagggcccatcggtcttccccctggcaccctcctccaagagcacctcgtgggggcacgagcagccctgggctgcctggtcaaggactactccacgtagcgtgctgagcgggctggcaaggcgcatagnnnnnnnn

SEQ ID NO: 254599 - DNA, 464 bp, Homo sapiens
  misc_feature: GYAE6OF01A7BOZ.30.45.E01.1.454.CMB.1.raw
  modified_base (452)..(464): a, c, t, g, unknown or other
  misc_feature (452)..(464): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagaggacgaggacacggctgtgtattactgtgcggggccgggagccacgtcggaccaccctacaccaagactacgtggggccagggaaccctggtcgccgtctcctcacgcctccaccgaacggcccagtccggtccttcccccgtcggccacccgtcctccaagacgccacctcgtcgggggcacgacgcacgcccgtgggctcgccgtggtacaacggacttaccgttcctctctcgactctgaggcggcgtggacgaaggcgcatagnnnnnnnnnnnnn

SEQ ID NO: 254600 - DNA, 429 bp, Homo sapiens
  misc_feature: GYAE6OF01B0UYZ.30.45.E01.1.454.CMB.1.raw
  modified_base (424)..(429): a, c, t, g, unknown or other
  misc_feature (424)..(429): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactactggggccagggaaccctggtcgccgtctcctcagcctccaccaagggcccatcggtcttccccctggccaccctcctccaagagcacctctgggggcacagcagccctgggctgcctggtcaaggactactccacgtagcgtgctgagcgggctggcgaaggcgcatagnnnnnn

SEQ ID NO: 254601 - DNA, 427 bp, Homo sapiens
  misc_feature: GYAE6OF01EU26N.30.45.E01.1.454.CMB.1.raw
  modified_base (419)..(427): a, c, t, g, unknown or other
  misc_feature (419)..(427): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaaggcccatcggtcttccccctggcaccctcctccaagacgcacctctgggggcacagcagccctgggctgcctgtcaaggctactccacgtagcgtgctgagcgggctggcaggcgcatagcnnnnnnnnn

SEQ ID NO: 254602 - DNA, 432 bp, Homo sapiens
  misc_feature: GYAE6OF01COJJ9.30.45.E01.1.454.CMB.1.raw
  modified_base (337)..(337): a, c, t, g, unknown or other
  misc_feature (337)..(337): n is a, c, g, or t
  modified_base (426)..(432): a, c, t, g, unknown or other
  misc_feature (426)..(432): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactactggggccagggaaccctggtcgccgtctcctcagcctccaccaagggccccatcggtcttccccctggcaccctcctccaagngcacctctgggggcacagcacgcccctgggctgccctggtcaaggactacttcctctctcgactctgagcgggctggcaaggcgcatgnnnnnnn

SEQ ID NO: 254603 - DNA, 446 bp, Homo sapiens
  misc_feature: GYAE6OF01BUL6Z.30.45.E01.1.454.CMB.1.raw
  modified_base (432)..(446): a, c, t, g, unknown or other
  misc_feature (432)..(446): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttccccctggccaccctcctccaagacgcacctctgggggccacagcacgccctgggctcgcctggtcaaggacctacttccacgtagcgtgctgagcgggctgggcaaggcgcagtacgnnnnnnnnnnnnnnn

SEQ ID NO: 254604 - DNA, 423 bp, Homo sapiens
  misc_feature: GYAE6OF01BYKYV.30.45.E01.1.454.CMB.1.raw
  modified_base (419)..(423): a, c, t, g, unknown or other
  misc_feature (419)..(423): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttcccctggcaccctctccagagcacctctgggggcacagcagccctgggctgcctggtcaaggactacttccacgtagcgtgctgagcgggctggcaaggcgcatagnnnnn

SEQ ID NO: 254605 - DNA, 462 bp, Homo sapiens
  misc_feature: GYAE6OF01CBCLI.30.45.E01.1.454.CMB.1.raw
  modified_base (446)..(462): a, c, t, g, unknown or other
  misc_feature (446)..(462): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcacgcctccaccaacgggccccatccggtccttcccccctggccacccctccctccaacgacgccacctcgtgggggccacgagccacgccccgtgggcctgcagtggtcgaaggactacttccacgtagcgtgctgaggcgggctggcaaggcgacatagnnnnnnnnnnnnnnnnn

SEQ ID NO: 254606 - DNA, 154 bp, Homo sapiens; identical to SEQ ID NO: 254505
  misc_feature: GYAE6OF01ED6X9.30.45.E01.1.454.CMB.1.raw
  modified_base (153)..(154): a, c, t, g, unknown or other
  misc_feature (153)..(154): n is a, c, g, or t

SEQ ID NO: 254607 - DNA, 424 bp, Homo sapiens
  misc_feature: GYAE6OF01DGMWC.30.45.E01.1.454.CMB.1.raw
  modified_base (412)..(412): a, c, t, g, unknown or other
  misc_feature (412)..(412): n is a, c, g, or t
  modified_base (418)..(424): a, c, t, g, unknown or other
  misc_feature (418)..(424): n is a, c, g, or t
tcagcacgctacgtcacgaccggtgctcgatttagtgagtcagtaagggaagggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactactggggccaggaaccctggtcgccgtctcctcagcctccaccaaggcccatcggtcttccccctggcaccctcctccaagagcacctctggggcacagcagccctgggctgcctgtcaaggactacttccacgtagcgtgctgagcgggctggcaaggcncatagnnnnnnn

SEQ ID NO: 254608 - DNA, 435 bp, Homo sapiens
  misc_feature: GYAE6OF01CZSLO.30.45.E01.1.454.CMB.1.raw
  modified_base (425)..(435): a, c, t, g, unknown or other
  misc_feature (425)..(435): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctaacaaatgagtagcctgagagacgaggacacggctgtgtattactgtgcggggccggggagccactcggaccaccctacaccaagactacgtggggccagggaaccctggtcgccgtctcctcagcctccaccagggcccatcggtcttcccctggcaccctcctccaagagcaccctctgggggcacagcagccctgggctgcctggtcaaggactacttccacgtagcgtgctgagcgggctgggcaaggcgcatagnnnnnnnnnnn

SEQ ID NO: 254609 - DNA, 151 bp, Homo sapiens
  misc_feature: GYAE6OF01DZ2QK.30.45.E01.1.454.CMB.1.raw
  modified_base (146)..(146): a, c, t, g, unknown or other
  misc_feature (146)..(146): n is a, c, g, or t
  modified_base (151)..(151): a, c, t, g, unknown or other
  misc_feature (151)..(151): n is a, c, g, or t
tcagcacgctacgtcacgaccggtgctcgatttagtgagtcagtaagggaagggaccaaggtggaaatcaaacgaactgtggctgcaccatctgtcttcatctcccgcatctgatatacgatcgtgagcgggtctggacaaggccnatagn

SEQ ID NO: 254610 - DNA, 439 bp, Homo sapiens
  misc_feature: GYAE6OF01EPFG7.30.45.E01.1.454.CMB.1.raw
  modified_base (430)..(439): a, c, t, g, unknown or other
  misc_feature (430)..(439): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactacgtggggccagggaaccctggtcgccgtctcctcagcctccaccaagggccccatccggtccttccccctggccaccctccctccaacgagcacctcgtgggggcacagcacgccctgggctgcctggtcaaggactactccacgtagcgtgctgagcgggctggcaaggcgcatagnnnnnnnnnn

SEQ ID NO: 254611 - DNA, 427 bp, Homo sapiens
  misc_feature: GYAE6OF01DRYRI.30.45.E01.1.454.CMB.1.raw
  modified_base (421)..(427): a, c, t, g, unknown or other
  misc_feature (421)..(427): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaacaagactactggggccagggaaccctggtcgccgtctcctcagcctccaccaagggcccatcggtcttcccctggcaccctcctccaagagcacctctgggggcacagcagccctgggctgcctggtcaaggactacttccacgtagcgtgctgagcgggctggcaaggcgcatagnnnnnnn

SEQ ID NO: 254612 - DNA, 500 bp, Homo sapiens
  misc_feature: GYAE6OF01DT309.30.45.E01.1.454.CMB.1.raw
  modified_base (461)..(461): a, c, t, g, unknown or other
  misc_feature (461)..(461): n is a, c, g, or t
  modified_base (485)..(500): a, c, t, g, unknown or other
  misc_feature (485)..(500): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaaagaaatcagtatatctaacaaatgagtagcctgagagacgaggacacggctgtgtattactgtggcggggccggggagccacgtccggacccaaccctacaccaagactacgtggggccgagggaacccgtggtcgccgtctcctccagcctccaccgaacgggcccacgtccggtccttccccctggccacccctccctccaagacgccaccctcgtcggggcacagcacgcccgtgggacgtcgccgtcggtacgaacggtacttaccgttccaacggtacggcgttcgccgtagacgggccgggtcgngggaccgaaagggccgactagagnnnnnnnnnnnnnnnn

SEQ ID NO: 254613 - DNA, 458 bp, Homo sapiens
  misc_feature: GYAE6OF01DN398.30.45.E01.1.454.CMB.1.raw
  modified_base (448)..(458): a, c, t, g, unknown or other
  misc_feature (448)..(458): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactacgtggggccagggaaccctggtccgccgtctcctcagcctccaccaagggccccatcggtccttccccctggccaccctcctccaagacgccacctcgtgggggccacacgcacgccccgtgggctcgcctggtccaaacggtactacttccaacgtagcgtgctgaggccgggctcggacaaggcgacagtagnnnnnnnnnnn

SEQ ID NO: 254614 - DNA, 435 bp, Homo sapiens
  misc_feature: GYAE6OF01DSU4D.30.45.E01.1.454.CMB.1.raw
  modified_base (336)..(336): a, c, t, g, unknown or other
  misc_feature (336)..(336): n is a, c, g, or t
  modified_base (426)..(435): a, c, t, g, unknown or other
  misc_feature (426)..(435): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactacgtggggccagggaaccctggtcgccgtctcctcagcctccaccaggccccatcggtccttccccctggcaccctcctccaagngcacctcgtgggggcacgagcacgcccgtgggctgcctggtcaaggactacttcctcgtagcactctgagcgggctggcaggcgcatagnnnnnnnnnn

SEQ ID NO: 254615 - DNA, 437 bp, Homo sapiens
  misc_feature: GYAE6OF01BX7HL.30.45.E01.1.454.CMB.1.raw
  modified_base (228)..(228): a, c, t, g, unknown or other
  misc_feature (228)..(228): n is a, c, g, or t
  modified_base (358)..(358): a, c, t, g, unknown or other
  misc_feature (358)..(358): n is a, c, g, or t
  modified_base (429)..(437): a, c, t, g, unknown or other
  misc_feature (429)..(437): n is a, c, g, or t
tcagcacgctacgtcacgaccggtgctcgatttagtgagtcagtaagggaaggggtcgtggagtggatttcatactattagtgctggtgcgtactaccatgaagtacgcagactctgtgagggccgtattcaccatttccagggacgacgccaagaaatcagtatatctacaaatgagtagcctgagagacgaggacacggctgtgtattactgtgcgggccgggganccactcggaccacccctacaccaagactactggggccagggaaccctggtcgccgtctcctcagcctccaccaagggcccatcggtcttccccctggccaccctcctccaagagcacctctcggggcacngcagccctgggctgcctggtcaaggactacttccacgtagcgtgctgagcgggctggcgaaggcgcatagnnnnnnnnn

SEQ ID NO: 254616 - DNA, 430 bp, Homo sapiens
  misc_feature: GYAE6OF01DY3EX.30.45.E01.1.454.CMB.1.raw
  modified_base (421)..(430): a, c, t, g, unknown or other
  misc_feature (421)..(430): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactactggggccagggaaccctggtcgccgtctcctcagcctccaccaagggcccatcggtcttcccctggcaccctcctccaagagcacctctgggggcacagcagccctgggctgcctggtcaaggactactccacgtagcgtgctgagcgggctggcaaggcgcatagnnnnnnnnnn

SEQ ID NO: 254617 - DNA, 424 bp, Homo sapiens
  misc_feature: GYAE6OF01EXM8Z.30.45.E01.1.454.CMB.1.raw
  modified_base (224)..(224): a, c, t, g, unknown or other
  misc_feature (224)..(224): n is a, c, g, or t
  modified_base (418)..(424): a, c, t, g, unknown or other
  misc_feature (418)..(424): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggganccactcggaccaccctacaccaagactactggggccagggaaccctggtcgccgtctcctcagcctccaccagggcccatcggtcttccccctggcaccctcctccagagcacctctgggggcacagcagccctgggctgcctggtcaggactactccacgtagcgtgctgagcgggctggcaaggcgcatagnnnnnnn

SEQ ID NO: 254618 - DNA, 433 bp, Homo sapiens
  misc_feature: GYAE6OF01AW2PA.30.45.E01.1.454.CMB.1.raw
  modified_base (427)..(433): a, c, t, g, unknown or other
  misc_feature (427)..(433): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttccccctcggcacccctcctccaagacgcacctctgggggcacagcacgccctgggctgcctggtcaaggactacttccacgtagcgtgctgagcgggctggcaaggcgcatagnnnnnnn

SEQ ID NO: 254619 - DNA, 235 bp, Homo sapiens; identical to SEQ ID NO: 254552
  misc_feature: GYAE6OF01A8U1V.30.45.E01.1.454.CMB.1.raw
  modified_base (232)..(235): a, c, t, g, unknown or other
  misc_feature (232)..(235): n is a, c, g, or t

SEQ ID NO: 254620 - DNA, 429 bp, Homo sapiens
  misc_feature: GYAE6OF01DZUQV.30.45.E01.1.454.CMB.1.raw
  modified_base (424)..(429): a, c, t, g, unknown or other
  misc_feature (424)..(429): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaaggcccatcggtcttccccctggcaccctcctccaagacgcacctctgggggcacagcacgccctgggctgcctggtcaaggactacttccacgtagcgtgctgagcgggcgtggcaaggcgcatagnnnnnn

SEQ ID NO: 254621 - DNA, 441 bp, Homo sapiens
  misc_feature: GYAE6OF01AG3EU.30.45.E01.1.454.CMB.1.raw
  modified_base (431)..(441): a, c, t, g, unknown or other
  misc_feature (431)..(441): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccactcggtccttccccctcggccaccctcctccaagacgcacctctgggggcacacgcacgccctggggctcgcctggtcaaggactacttccacgtagcgtgctgagcgggctggcaggcgcatagnnnnnnnnnnn

SEQ ID NO: 254622 - DNA, 434 bp, Homo sapiens
  misc_feature: GYAE6OF01CEWHB.30.45.E01.1.454.CMB.1.raw
  modified_base (422)..(434): a, c, t, g, unknown or other
  misc_feature (422)..(434): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnnnnnnnnn

SEQ ID NO: 254623 - DNA, 466 bp, Homo sapiens
  misc_feature: GYAE6OF01DU55Y.30.45.E01.1.454.CMB.1.raw
  modified_base (225)..(225): a, c, t, g, unknown or other
  misc_feature (225)..(225): n is a, c, g, or t
  modified_base (445)..(445): a, c, t, g, unknown or other
  misc_feature (445)..(445): n is a, c, g, or t
  modified_base (448)..(466): a, c, t, g, unknown or other
  misc_feature (448)..(466): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccgggganccagtcggaaccaccctaacaccaagacctacgtggggaccgagggaaccctggtcgccgtcgtcctcagcctccaccaacgggccatcggtcttcccccctggcccaccctcctccaacgacgcaaccctcgtgggggccacgagccaacgcccgtgggctcgcctggtacaaggactacttccgacgtagcgtgctggagcgggctggcaaggcgacnagnnnnnnnnnnnnnnnnnnn

SEQ ID NO: 254624 - DNA, 458 bp, Homo sapiens
  misc_feature: GYAE6OF01DT8BA.30.45.E01.1.454.CMB.1.raw
  modified_base (447)..(458): a, c, t, g, unknown or other
  misc_feature (447)..(458): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactacgtggggccagggaaccctggtcgccgtctcctcacgccctccaccaacgggcccacgtccggtccttccccctggccacccctccctccaagagccacctcgtgggggcacagcacgcccgtgggctcgcctggtaccgaaggactacttcctcttcctcgactctgacgcgggctggccagggcgcatacgnnnnnnnnnnnn

SEQ ID NO: 254625 - DNA, 453 bp, Homo sapiens
  misc_feature: GYAE6OF01CZGVZ.30.45.E01.1.454.CMB.1.raw
  modified_base (438)..(453): a, c, t, g, unknown or other
  misc_feature (438)..(453): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtatactgtgcggggccggggagccactccggaccaccctacaccaagactacgtggggccagggaaccctggtcgccggtctcctcagcctccaccaagggccccatcggtccttccccctggccaccctcctccaagagcacctcgtcgggggcacgagcgacgcccgtggggctcgcctggtccaaggactacttcctctctcgactctgacgcggctggcaggcgacatagnnnnnnnnnnnnnnnn

SEQ ID NO: 254626 - DNA, 434 bp, Homo sapiens
  misc_feature: GYAE6OF01BQTBV.30.45.E01.1.454.CMB.1.raw
  modified_base (426)..(434): a, c, t, g, unknown or other
  misc_feature (426)..(434): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttcccccctggccacccctcctccaagacgcacctctgggggcacagcagccctgggctgcctggtcaaggactactccacgtagcgtgctgagcgggctggcaaggcgcatagnnnnnnnnn

SEQ ID NO: 254627 - DNA, 430 bp, Homo sapiens
  misc_feature: GYAE6OF01CENVJ.30.45.E01.1.454.CMB.1.raw
  modified_base (422)..(422): a, c, t, g, unknown or other
  misc_feature (422)..(422): n is a, c, g, or t
  modified_base (424)..(430): a, c, t, g, unknown or other
  misc_feature (424)..(430): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagcccctgggctgcctggtcaaggactactccacgtagcgtgctgagcgggctggcaaggcgcatagngnnnnnnn

SEQ ID NO: 254628 - DNA, 454 bp, Homo sapiens
  misc_feature: GYAE6OF01C3ADC.30.45.E01.1.454.CMB.1.raw
  modified_base (441)..(454): a, c, t, g, unknown or other
  misc_feature (441)..(454): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactggtgcggggccggggagcccactccggaccaccctacaccaagactacgtggggccagggaaccctggtcgccgtctcctcagcctccaccaggcccatcggtccttcccctcggcaccctccctccaagacgcacctctcgggggcacagcacgccccgtgggctcgcctcggtcaaggactacttccacggtagcgtgcgtgacgcgggcgtggacgaaggcgcagtagnnnnnnnnnnnnnn

SEQ ID NO: 254629 - DNA, 526 bp, Homo sapiens
  misc_feature: GYAE6OF01DZNDV.30.45.E01.1.454.CMB.1.raw
  modified_base (508)..(526): a, c, t, g, unknown or other
  misc_feature (508)..(526): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccacgtcggaccaccctacaccaagactacgtggggccgacggacccgtcggtcgccgtcctcctcacgccctccaccgaacggcccacgtccggtccttcccccctcggccctaccccctccctacccaacgacgccgtaccctcggtcgggggccaaccgacgccacgccccgtggggctcgcccgtggtaccgaacggtaccttacctcccgtaacggtacggtccggtggccgtaggtacgggccggggtccgtgggaccgaacgggccgacgataggnnnnnnnnnnnnnnnnnnn

SEQ ID NO: 254630 - DNA, 466 bp, Homo sapiens
  misc_feature: GYAE6OF01DDHY0.30.45.E01.1.454.CMB.1.raw
  modified_base (437)..(437): a, c, t, g, unknown or other
  misc_feature (437)..(437): n is a, c, g, or t
  modified_base (460)..(466): a, c, t, g, unknown or other
  misc_feature (460)..(466): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtatactgtgcgggccggggacggccactcggccgaccctaccaccaacgactactggggccgacgggaacccgtacggtcggccgtccgtccctccagcctcccaccaacgggccccgactacggtccttccccctccggcgacccctccctccaacgacgccacctccgtggggcgacagcacgcccgtcgggctcgcctggtcgaacggacgtacttccacgtagcgtgctgnggcgggcgtggcaaggcgcatgnnnnnnn

SEQ ID NO: 254631 - DNA, 433 bp, Homo sapiens
  misc_feature: GYAE6OF01BKSM4.30.45.E01.1.454.CMB.1.raw
  modified_base (427)..(433): a, c, t, g, unknown or other
  misc_feature (427)..(433): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttccccctggccaccctcctccaagagcacctcgtgggggcacagcacgccctgggctgcctggtcaaggactacttcctctctcgactctgacgcggctggcaaggcgcatagnnnnnnn

SEQ ID NO: 254632 - DNA, 436 bp, Homo sapiens
  misc_feature: GYAE6OF01CN6BU.30.45.E01.1.454.CMB.1.raw
  modified_base (428)..(436): a, c, t, g, unknown or other
  misc_feature (428)..(436): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggccaccctccctccaagacgcaccctctcgggggcacagcacgccctgggctgcctggtcaaggactacttccacgtagcgtgctgagcgggctggcaaggcgcatagnnnnnnnnn

SEQ ID NO: 254633 - DNA, 454 bp, Homo sapiens
  misc_feature: GYAE6OF01D768J.30.45.E01.1.454.CMB.1.raw
  modified_base (428)..(428): a, c, t, g, unknown or other
  misc_feature (428)..(428): n is a, c, g, or t
  modified_base (430)..(454): a, c, t, g, unknown or other
  misc_feature (430)..(454): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttccccctggccacccgtcctccaagacgcacctctgggggcacagcagccctgggctgcctggcaaggactactccacgtagcgtgctgagcgggctgggcaaaggcgacatagngnnnnnnnnnnnnnnnnnnnnnnnnn

SEQ ID NO: 254634 - DNA, 503 bp, Homo sapiens
  misc_feature: GYAE6OF01CGN2S.30.45.E01.1.454.CMB.1.raw
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
  modified_base (465)..(503): a, c, t, g, unknown or other
  misc_feature (465)..(503): n is a, c, g, or t
tcagcacgctacgtcacgaccggtgctcgatttagtgagtcagtaagggaaggggcgtggagtggatttcatatattagtgctggtgctactaccatgaagtacgcagactctgtgagggccgattcaccatttccagggcacgccaagaaatcagtatatctacaaatgagtagcctgagagacgaggacacggctgtgtattacngtgcgggccgggganccactcggaccacccgtacaccaagactacgtggggaccagggaaccctggtacgccgtctcctcacgcctccaccgaacggcccatcggtccttcccccgtcggccacccctcctaccaagacgctacctcgtcgggggcacgagcacgcctgggctcgcctcggtacgaaggtacctacgttaccgacgtacgcgtacgcctggacggccgggtcgtcggacgacggcgtacgagtacggnnnnnnnnnnnnnnnnnnnnnnnnnnnnnnnnnnnnnnn

SEQ ID NO: 254635 - DNA, 508 bp, Homo sapiens
  misc_feature: GYAE6OF01DOZNM.30.45.E01.1.454.CMB.1.raw
  modified_base (214)..(214): a, c, t, g, unknown or other
  misc_feature (214)..(214): n is a, c, g, or t
  modified_base (229)..(229): a, c, t, g, unknown or other
  misc_feature (229)..(229): n is a, c, g, or t
  modified_base (458)..(461): a, c, t, g, unknown or other
  misc_feature (458)..(461): n is a, c, g, or t
  modified_base (463)..(466): a, c, t, g, unknown or other
  misc_feature (463)..(466): n is a, c, g, or t
  modified_base (468)..(468): a, c, t, g, unknown or other
  misc_feature (468)..(468): n is a, c, g, or t
  modified_base (475)..(475): a, c, t, g, unknown or other
  misc_feature (475)..(475): n is a, c, g, or t
  modified_base (479)..(482): a, c, t, g, unknown or other
  misc_feature (479)..(482): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
  modified_base (488)..(490): a, c, t, g, unknown or other
  misc_feature (488)..(490): n is a, c, g, or t
  modified_base (492)..(494): a, c, t, g, unknown or other
  misc_feature (492)..(494): n is a, c, g, or t
  modified_base (497)..(498): a, c, t, g, unknown or other
  misc_feature (497)..(498): n is a, c, g, or t
  modified_base (500)..(500): a, c, t, g, unknown or other
  misc_feature (500)..(500): n is a, c, g, or t
  modified_base (502)..(506): a, c, t, g, unknown or other
  misc_feature (502)..(506): n is a, c, g, or t
  modified_base (508)..(508): a, c, t, g, unknown or other
  misc_feature (508)..(508): n is a, c, g, or t
tcagcacgctacgtcacgaccggtgctcgatttagtgagtcagtaagggaagggggcgtgggagtggatttcatatattaggtgctggtgctactaccatgaagtacgcagacctctgtgaggggccattcaccatttccagggacgacgccaagaaatcagtatatctaacaaatgagtagcctgagagacgaggacacggctgtgtattacngtgcgggccgggganccatcggacccaccctacaccgaaagactacgtcggggccaagggaccctggtccgccgtctcctcgagccctccacgaagggccccatcggtcctccccgtggccaccccgtctccaagacgcacctcgtcggggaccacagcacgcccgtggggcctgccgtggtacgaaggacctacttcccgacgtagcgtcgctggacggcgggctggacaagggcgcagtagnnnngnnnntnatgcagncgtnnnngngngnnngnnncanncngnnnnngn

SEQ ID NO: 254636 - DNA, 432 bp, Homo sapiens
  misc_feature: GYAE6OF01CLZXO.30.45.E01.1.454.CMB.1.raw
  modified_base (424)..(432): a, c, t, g, unknown or other
  misc_feature (424)..(432): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactacgtggggccagggaaccctggtcgccgtctcctcagcctccaccagggcccatcggtccttcccctggccaccctcctccaagcgcacctctgggggcacagcagcctgggctgcctggtcaaggactacttccacgtagcgtgctgagcgggctggcgaaggcgcatagnnnnnnnnn

SEQ ID NO: 254637 - DNA, 470 bp, Homo sapiens
  misc_feature: GYAE6OF01E16ZY.30.45.E01.1.454.CMB.1.raw
  modified_base (430)..(430): a, c, t, g, unknown or other
  misc_feature (430)..(430): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
  modified_base (439)..(470): a, c, t, g, unknown or other
  misc_feature (439)..(470): n is a, c, g, or t
tcagcacgctacgtcacgaccggtgctcgatttagtgagtcagtaaggggaaggggcgtggagtggatttcattatattagtggctggtgctacctaccatgaagtacgcagactctgtgagggccgattcaccatttccagggacgacgccaagaaattcagtatatctacaaatgagtagcctgagagacgaggacgacggctgtgtattactgtgcgggccggggagccactcggaccaccctacaccaagactacgtcggggccgagggaaccctaggtcgccgtctccctcagcctccaccaagggcccatcggtctccccctggccaccctcctccaagagcacctctgggggcactagcagccctgggctgcctgggtcaaggactactccacgtagcgtgctgagcgggctggcaaggccgntanacgntnnnnnnnnnnnnnnnnnnnnnnnnnnnnnnnn

SEQ ID NO: 254638 - DNA, 466 bp, Homo sapiens
  misc_feature: GYAE6OF01C9SWX.30.45.E01.1.454.CMB.1.raw
  modified_base (442)..(466): a, c, t, g, unknown or other
  misc_feature (442)..(466): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacacccaagactactggggcagggaaccctggtccgccgtctcctcagcctccaccacgggccccatccggtccttccccctggcacccctcctccaagacgccacctcgtcgggggccacagcacgcccgtgggctgccgtggtcaaggtactacttccacgtagcgtgctgagcgggctggcgaacggcgacgaatacgnnnnnnnnnnnnnnnnnnnnnnnnn

SEQ ID NO: 254639 - DNA, 429 bp, Homo sapiens
  misc_feature: GYAE6OF01DD9JR.30.45.E01.1.454.CMB.1.raw
  modified_base (421)..(421): a, c, t, g, unknown or other
  misc_feature (421)..(421): n is a, c, g, or t
  modified_base (426)..(429): a, c, t, g, unknown or other
  misc_feature (426)..(429): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactactggggccagggaaccctggtcgccgtctcctcagcctccaccaaggcccatcggtccttcccctggccaccctcctccaagagccacctcgtcggggcacagcacgcccctgggctgcctggtcaaggactacttccacgtagcgtgctgagcgggctggcaaggcncatgnnnn

SEQ ID NO: 254640 - DNA, 430 bp, Homo sapiens
  misc_feature: GYAE6OF01EKU0K.30.45.E01.1.454.CMB.1.raw
  modified_base (401)..(401): a, c, t, g, unknown or other
  misc_feature (401)..(401): n is a, c, g, or t
  modified_base (425)..(430): a, c, t, g, unknown or other
  misc_feature (425)..(430): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtccttccccctggccaccctcctccaagagcacctctgggggcacagcacgccctgggctgcctggtcaaggctacttcctctctcgactcngagcgggctggcaaggcgcatagnnnnnn

SEQ ID NO: 254641 - DNA, 428 bp, Homo sapiens
  misc_feature: GYAE6OF01D2T93.30.45.E01.1.454.CMB.1.raw
  modified_base (224)..(224): a, c, t, g, unknown or other
  misc_feature (224)..(224): n is a, c, g, or t
  modified_base (423)..(428): a, c, t, g, unknown or other
  misc_feature (423)..(428): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggganccactcggaccaccctacaccaagactactggggccagggaaccctggtcgccgtctcctcagcctccaccaagggcccatcggtcttccccctggccaccctcctccaagagcacctctgggggcacagcagccctgggctgcctggtcaaggactacttccacgtagcgtgctgagcgggctggcaaggcgcatagnnnnnn

SEQ ID NO: 254642 - DNA, 566 bp, Homo sapiens
  misc_feature: GYAE6OF01DR3PW.30.45.E01.1.454.CMB.1.raw
  modified_base (542)..(566): a, c, t, g, unknown or other
  misc_feature (542)..(566): n is a, c, g, or t
tcagcacgctacgtcacgaccggtgctcgatttagtgagtcagtaagggaaggggctggagtggatttcatatattagtgctggtgctactaccatgaagtacgcagactctgtggaggggccgattcaccatttccagggacgacgccaaagaaatcagtatatctaacaaatgagtagcctgagagacgaggacacggctgtgtattactggtggccggggccggggagccacgtccggaccacccgtacaaccaagacttacggcggggaccgtaacgggaacccgtggtccgcccgttcctccctcacgccctaccaccgaacgggcccagttccggtccttcccccgtcggacccctacccctccctaccgaagacgaccctaccgttcgggacgggggaccacgacggccgaaccggccccgtggggcctcggcccgttacggtaacgaaacggtaccttacccgttacccggaaggttaccggcggttcgcgttaggacgggtcggggtcctgggaaccaaggtcgactagagcnnnnnnnnnnnnnnnnnnnnnnnnn

SEQ ID NO: 254643 - DNA, 449 bp, Homo sapiens
  misc_feature: GYAE6OF01B23FB.30.45.E01.1.454.CMB.1.raw
  modified_base (224)..(224): a, c, t, g, unknown or other
  misc_feature (224)..(224): n is a, c, g, or t
  modified_base (427)..(427): a, c, t, g, unknown or other
  misc_feature (427)..(427): n is a, c, g, or t
  modified_base (432)..(449): a, c, t, g, unknown or other
  misc_feature (432)..(449): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggganccatcggaccaccctacaccaagactactggggccagggaaccctggtccgccgtcgtcctcagcctccaccaacgggcccatcggtccttccccctggccaccctcctaccaagacgccacctcgtcgggggcacagcacgcccgtgggctcgcctggtcaaggactacgtcctctctcgactctgagcggctggcaagcgnatagnnnnnnnnnnnnnnnnnn

SEQ ID NO: 254644 - DNA, 595 bp, Homo sapiens
  misc_feature: GYAE6OF01ALZJ6.30.45.E01.1.454.CMB.1.raw
  modified_base (279)..(279): a, c, t, g, unknown or other
  misc_feature (279)..(279): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (570)..(595): a, c, t, g, unknown or other
  misc_feature (570)..(595): n is a, c, g, or t
tcagcacgctacgtcacgaccggtgctcgatttagtgagtcagtaagggaagggggcgtgggagtggatttcatatattagtgctggtgctactaccatgaagtacgcagactctgtggaggggccgattcaccatttccagggacgacgccaagaaatcagtatatctacaaatgagtagcctgagagacgaggacacggctggtgtattactggtggccgggggccggggagccaacgtccgggaacccacccctaacacccgaaagaaccttacgnggggggaccccaaggggaaccccgtcgggtccggcccgttccgtcccttccaaggtcccctaccccaacccgaaacggggccccctagtcccggtcccgtttccccccctcgggcccctacccccgtccttacccgaaggacgccaaccctcggtcgggggccacgaggcctacggccccggtgggccgtcgtccgtacggtacgaaacggtcttaccgttccgaacggtagtcgtcggctcgggacggcggggtctcgggacgacgggacgtcaaacgtaggcangnacnnnnnnnnnnnnnnnnnnnnnnnnnn

SEQ ID NO: 254645 - DNA, 443 bp, Homo sapiens
  misc_feature: GYAE6OF01BRJKK.30.45.E01.1.454.CMB.1.raw
  modified_base (434)..(443): a, c, t, g, unknown or other
  misc_feature (434)..(443): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggacccaccctacaccaagactacgtggggccagggaaccctggtcgccgtctcctcagccctccaccaagggccccatcggtccttcccccgtggccacccctcctcccaagcgcacctcgtggggcacagcagcccgtgggctgcctggtcaaggactacttccacgtagcgtgctgagcgggcgtggcaaggcgcatagnnnnnnnnnn

SEQ ID NO: 254646 - DNA, 448 bp, Homo sapiens
  misc_feature: GYAE6OF01BF49Y.30.45.E01.1.454.CMB.1.raw
  modified_base (439)..(448): a, c, t, g, unknown or other
  misc_feature (439)..(448): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactactggggccaggaaccctggtcgccgtctcctcagcctccaccaagggccccatcggtcttccccctggccaccctcctccaagacgccaccctcgtgggggcacgacgcacgccccgtgggctgccctggtccaaggcctacttccacgtacgcgtgctgagccgggcgtggcaaggcgcgatagnnnnnnnnnn

SEQ ID NO: 254647 - DNA, 474 bp, Homo sapiens
  misc_feature: GYAE6OF01ADREU.30.45.E01.1.454.CMB.1.raw
  modified_base (464)..(474): a, c, t, g, unknown or other
  misc_feature (464)..(474): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactccggaccaccctacaccaagactacgtggggccagggaaccctggtcgccggtctccctcagccctccaccaagggccccacgtccggtccttcccccctggccacccctccctcccaacgacgccaccctccgtggggggccacacgcacgccccgtggggctgccctcggtcaacggacttaccttccaacggtcgcgtgctggacgcggggctggcgaacggcgcagtagnnnnnnnnnnn

SEQ ID NO: 254648 - DNA, 461 bp, Homo sapiens
  misc_feature: GYAE6OF01EJLUI.30.45.E01.1.454.CMB.1.raw
  modified_base (435)..(461): a, c, t, g, unknown or other
  misc_feature (435)..(461): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactactggggccagggaccctggtcgccgtctcctcagcctccaccaggcccatcggtccttccccctggccaccctcctccaagacgcacctcgtcgggggccacagcacgccccgtgggctgcctggtcgaaggactacctcacgtagcgtgctgacggcgggctcggacgacggcgacagtgnnnnnnnnnnnnnnnnnnnnnnnnnnn

SEQ ID NO: 254649 - DNA, 425 bp, Homo sapiens
  misc_feature: GYAE6OF01DIHX6.30.45.E01.1.454.CMB.1.raw
  modified_base (416)..(425): a, c, t, g, unknown or other
  misc_feature (416)..(425): n is a, c, g, or t
tcagcacgctacgtcacgaccggtgctcgatttagtgagtcagtaagggaaggggctggagtggatttcatatattagtgctggtgctactaccatgaagtacgcagactctgtgagggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccacaggcccatcggtctcccctggcaccctcctccagagcacctctgggggcacagcagccctgggctgcctggtcaaggactacttccacgtagcgtgctgagcgggctggcaaggcgcagtagnnnnnnnnnn

SEQ ID NO: 254650 - DNA, 156 bp, Homo sapiens
  misc_feature: GYAE6OF01CEUXE.30.45.E01.1.454.CMB.1.raw
  modified_base (153)..(156): a, c, t, g, unknown or other
  misc_feature (153)..(156): n is a, c, g, or t
tcagcacgctacgtcacgaccggtgctcgatttagtgagtcagtaagggaaagggaccaaggtggaaatcaaacgaactgtggctgcaccatctgtcttcatcttcccgcatctgatacgtgagctctggagcgggctggcaaggcgcatagnnnn

SEQ ID NO: 254651 - DNA, 154 bp, Homo sapiens
  misc_feature: GYAE6OF01D10QO.30.45.E01.1.454.CMB.1.raw
  modified_base (153)..(154): a, c, t, g, unknown or other
  misc_feature (153)..(154): n is a, c, g, or t
tcagcacgctacgtcacgaccggtgctcgatttagtgagtcagtaagggaaagggaccaaggtggaaatcaaacgaactgtggctgcaccatctgtcttcatcttcccgccatctgatatacgatcgctgagcgggctggcaaggcgcatagnn

SEQ ID NO: 254652 - DNA, 430 bp, Homo sapiens
  misc_feature: GYAE6OF01ATOAO.30.45.E01.1.454.CMB.1.raw
  modified_base (423)..(430): a, c, t, g, unknown or other
  misc_feature (423)..(430): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtacttccccctggcaccctcctccaagacgcacctctgggggcacagcacgccctgggctgcctggtcaaggctacttccacgtagcgtgctgagcgggctggcaggcgcatagnnnnnnnn

SEQ ID NO: 254653 - DNA, 174 bp, Homo sapiens
  misc_feature: GYAE6OF01ARIK2.30.45.E01.1.454.CMB.1.raw
  modified_base (147)..(147): a, c, t, g, unknown or other
  misc_feature (147)..(147): n is a, c, g, or t
  modified_base (153)..(174): a, c, t, g, unknown or other
  misc_feature (153)..(174): n is a, c, g, or t
tcagcacgctacgtcacgaccggtgctcgattttagtgagtcagtaagggaaagggaccaaggtggaaatcaaacgaactgtggctgcaccatctgtcttcatcttcccgcatctgatatacgatcgctgagcgggctggcaaggcncatagnnnnnnnnnnnnnnnnnnnnnn

SEQ ID NO: 254654 - DNA, 467 bp, Homo sapiens
  misc_feature: GYAE6OF01EYOGG.30.45.E01.1.454.CMB.1.raw
  modified_base (431)..(433): a, c, t, g, unknown or other
  misc_feature (431)..(433): n is a, c, g, or t
  modified_base (436)..(467): a, c, t, g, unknown or other
  misc_feature (436)..(467): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccaggggacgacgccaagaaatcagtatatctacaaatgagtagcctgagagacgaggacacggctgtgtattactgtgcgggccggggagccactcggaccaccctacaccaagctactggggcccagggaaccctggtcgccgtctcctcagcctccaccagggcccatcggtcttccccctggccaccctcctccaagagcacctctgggggcacagcagccctgggctgcctggtcaacggactacttccacgtagcgtgctggagtcgggctggcaagggtcgcgagtacgnnncgnnnnnnnnnnnnnnnnnnnnnnnnnnnnnnnn

SEQ ID NO: 254655 - DNA, 469 bp, Homo sapiens
  misc_feature: GYAE6OF01C5EPS.30.45.E01.1.454.CMB.1.raw
  modified_base (256)..(256): a, c, t, g, unknown or other
  misc_feature (256)..(256): n is a, c, g, or t
  modified_base (325)..(325): a, c, t, g, unknown or other
  misc_feature (325)..(325): n is a, c, g, or t
  modified_base (451)..(469): a, c, t, g, unknown or other
  misc_feature (451)..(469): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactacgnggggccacgggaaccctggtccgccgtctcctcacgcctccacaacgggcccatccggtccttcccccnggccacccctcctccaagcgccacctcgtggggccacagccacgccccgtggggctcgcccgtggtaccaaggtacctaccttccacggtagcgtgctggacgcgggctgggccaaggcgacatgnnnnnnnnnnnnnnnnnnn

SEQ ID NO: 254656 - DNA, 486 bp, Homo sapiens
  misc_feature: GYAE6OF01DKDBF.30.45.E01.1.454.CMB.1.raw
  modified_base (378)..(378): a, c, t, g, unknown or other
  misc_feature (378)..(378): n is a, c, g, or t
  modified_base (432)..(432): a, c, t, g, unknown or other
  misc_feature (432)..(432): n is a, c, g, or t
  modified_base (465)..(486): a, c, t, g, unknown or other
  misc_feature (465)..(486): n is a, c, g, or t
tcagcacgctacgtcacgaccggtgctcgatttagtgagtcagtaagggaaggggctggagtggatttcatatattagtgctggtgctactaccatgaagtacgcagactctgtggaggggccgattcaccatttccagggacgacgccaagaaatcagtatatctaacaaatgagtagcctgagagacgaggacacggctgtgtattactgtgcggggccggggagccacgtcggacccacctacaccaagactactggggccagggaacccgtggccgccgtctcctcacgccctccaccaacgggccctacgtccggtccttccccccgtggcccaccctccctaccaagacgccaccctcggcgggggccacgngcgacgccgtgggctcgccgtggacgaaggtcctacttcctatcctcgtactcncggacggcgggctcggacaacggcacgatagcnnnnnnnnnnnnnnnnnnnnnn

SEQ ID NO: 254657 - DNA, 491 bp, Homo sapiens
  misc_feature: GYAE6OF01BBJJS.30.45.E01.1.454.CMB.1.raw
  modified_base (226)..(226): a, c, t, g, unknown or other
  misc_feature (226)..(226): n is a, c, g, or t
  modified_base (257)..(257): a, c, t, g, unknown or other
  misc_feature (257)..(257): n is a, c, g, or t
  modified_base (471)..(491): a, c, t, g, unknown or other
  misc_feature (471)..(491): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtggcggggccgggganccactcggaccaccctacaccaagactacgnggggccacgggaccctggtcgccgtctcctcacgccctccaccgaacgggccccacgttccggtccttccccccgtggcccaccccgtccctaccaagacgccaccgtcggtcgggggcacgacgcacgcccgtgggctcgcctggtacaacggcctactccgacggtagcgtgcgtggacggcgggcgtcgggacgtaacggcgactagtcgnnnnnnnnnnnnnnnnnnnnn

SEQ ID NO: 254658 - DNA, 459 bp, Homo sapiens
  misc_feature: GYAE6OF01APJZQ.30.45.E01.1.454.CMB.1.raw
  modified_base (271)..(271): a, c, t, g, unknown or other
  misc_feature (271)..(271): n is a, c, g, or t
  modified_base (443)..(459): a, c, t, g, unknown or other
  misc_feature (443)..(459): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactactggggccagggaacccnggtcgccgtctcctcacgcctccaccaagggcccatcggtccttccccctggccaccctcctccaagacgcaccctcgtgggggcacacgcgacgcccgtgggctgcctggtcaaggtactactccgacgtagcgtgcgtgacggcgggctgggacgaacggcgcgagtagnnnnnnnnnnnnnnnnn

SEQ ID NO: 254659 - DNA, 440 bp, Homo sapiens
  misc_feature: GYAE6OF01AY9C8.30.45.E01.1.454.CMB.1.raw
  modified_base (431)..(440): a, c, t, g, unknown or other
  misc_feature (431)..(440): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactactggggccagggaaccctggtcgccgtctcctcagcctccaccaacgggcccatcggtcttccccctggccaccctcctccaacgacgccacctctgggggcacgacgcacgccctgggctgcctggtcaaggactactccacgtacgcgtgctgagcgggctggcaaggcgcatagnnnnnnnnnn

SEQ ID NO: 254660 - DNA, 543 bp, Homo sapiens
  misc_feature: GYAE6OF01CY5Y7.30.45.E01.1.454.CMB.1.raw
  modified_base (234)..(234): a, c, t, g, unknown or other
  misc_feature (234)..(234): n is a, c, g, or t
  modified_base (308)..(308): a, c, t, g, unknown or other
  misc_feature (308)..(308): n is a, c, g, or t
  modified_base (495)..(495): a, c, t, g, unknown or other
  misc_feature (495)..(495): n is a, c, g, or t
  modified_base (498)..(499): a, c, t, g, unknown or other
  misc_feature (498)..(499): n is a, c, g, or t
  modified_base (502)..(502): a, c, t, g, unknown or other
  misc_feature (502)..(502): n is a, c, g, or t
  modified_base (504)..(506): a, c, t, g, unknown or other
  misc_feature (504)..(506): n is a, c, g, or t
  modified_base (508)..(511): a, c, t, g, unknown or other
  misc_feature (508)..(511): n is a, c, g, or t
  modified_base (513)..(517): a, c, t, g, unknown or other
  misc_feature (513)..(517): n is a, c, g, or t
  modified_base (519)..(519): a, c, t, g, unknown or other
  misc_feature (519)..(519): n is a, c, g, or t
  modified_base (521)..(521): a, c, t, g, unknown or other
  misc_feature (521)..(521): n is a, c, g, or t
  modified_base (523)..(524): a, c, t, g, unknown or other
  misc_feature (523)..(524): n is a, c, g, or t
  modified_base (526)..(527): a, c, t, g, unknown or other
  misc_feature (526)..(527): n is a, c, g, or t
  modified_base (530)..(530): a, c, t, g, unknown or other
  misc_feature (530)..(530): n is a, c, g, or t
  modified_base (532)..(543): a, c, t, g, unknown or other
  misc_feature (532)..(543): n is a, c, g, or t
tcagcacgctacgtcacgaccggtgctcgatttagtgagtcagtaagggaaggggcgtgggagtggatttcatatattagtgctggtgctacctaccatgaagtacgcagactctgtggagggccgattcaccatttccgagggacgacgaccaaagaaatcagtatatctaacaaatgagtagctgagagacgaggacacggctgtgtatacgtggtggccggggccgggganccacgtccggaacccacccgtacaaccaagacctacgtcggggccgaacgggaaccctggtccgaccgtctccncacgccctccaccacgggcccatccggtccttccccgcggccacccctccctaccgaacgcgccaccgtcgtcggggcaccgagcacgcccgtgggcgtcgccgtggtacgaacggtacctacgtttcccacgtacgcgtcgctggacggccgggcgtgggaccgaaagggtccgacgtaagtacgnagnngtntnnngnnnngnnnnngngngnngnnagnannnnnnnnnnnn

SEQ ID NO: 254661 - DNA, 466 bp, Homo sapiens
  misc_feature: GYAE6OF01EGBXM.30.45.E01.1.454.CMB.1.raw
  modified_base (447)..(466): a, c, t, g, unknown or other
  misc_feature (447)..(466): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactacgtcggggaccagggaaccctggtcgccgtcctcctcacgccctccaccaacgggccccactccggtccttcccccgtggccacccctccctccaacgacgccacctcgtcggggcacgagcacgcccgtgggctgcctggcaagcttactcttctctcgactctgacggcggcgtgggacaacggcgcagtagnnnnnnnnnnnnnnnnnnnn

SEQ ID NO: 254662 - DNA, 446 bp, Homo sapiens
  misc_feature: GYAE6OF01BOJG5.30.45.E01.1.454.CMB.1.raw
  modified_base (436)..(439): a, c, t, g, unknown or other
  misc_feature (436)..(439): n is a, c, g, or t
  modified_base (441)..(446): a, c, t, g, unknown or other
  misc_feature (441)..(446): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactacgtggggccagggaaccctggtcgccgtctcctcagcctccaccaagggcccatcggtccttccccctggccaccctcctccaagacgccacctcgtgggggcacacgcacgcccgtcgggctcgcctcggtcaacggactactccacgtagcgtgctggacgcgggctggcaaggcgcatgnnnngnnnnnn

SEQ ID NO: 254663 - DNA, 497 bp, Homo sapiens
  misc_feature: GYAE6OF01APF0B.30.45.E01.1.454.CMB.1.raw
  modified_base (224)..(224): a, c, t, g, unknown or other
  misc_feature (224)..(224): n is a, c, g, or t
  modified_base (289)..(289): a, c, t, g, unknown or other
  misc_feature (289)..(289): n is a, c, g, or t
  modified_base (468)..(497): a, c, t, g, unknown or other
  misc_feature (468)..(497): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggganccacgtcggaccacctacaccaagactacgtgggaccagggaaccctggtcgccgtctcctcacncctccaccgaacgggccccagtccggtccttcccccctggccaccccgtcctaccgaacgtacgccaccctcggtcgggggccacgacgcacggccccgttcggggcctcgccgtggtcaaggaccttacgtcccgacgtagcgtgcgtggagcgggctgggctaacggcgacagtagnnnnnnnnnnnnnnnnnnnnnnnnnnnnnn

SEQ ID NO: 254664 - DNA, 462 bp, Homo sapiens
  misc_feature: GYAE6OF01BB5EU.30.45.E01.1.454.CMB.1.raw
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
  modified_base (427)..(462): a, c, t, g, unknown or other
  misc_feature (427)..(462): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactactgggggccagggaaccctggtcgccgtctcctcagcctccaccaagggccccatcgtctccccctggcaccctctccaagagcacctctgggggcacagcagccctgggctgcctggtcaaaggactacttccacgtagcgtgctgagcgggctggcaaggcgnagtagnagnnnnnnnnnnnnnnnnnnnnnnnnnnnnnnnnnnnn

SEQ ID NO: 254665 - DNA, 446 bp, Homo sapiens
  misc_feature: GYAE6OF01D5T5V.30.45.E01.1.454.CMB.1.raw
  modified_base (430)..(446): a, c, t, g, unknown or other
  misc_feature (430)..(446): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaggcccatcggtccttcccctggccaccctcctccagacgcacctcgtcggggcacagcacgcccgtgggctcgcctggtacaagactactccacgtagcgtgctgacggcgggcgtggcgaaggcgacagtagnnnnnnnnnnnnnnnnn

SEQ ID NO: 254666 - DNA, 435 bp, Homo sapiens
  misc_feature: GYAE6OF01CA5K1.30.45.E01.1.454.CMB.1.raw
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (427)..(435): a, c, t, g, unknown or other
  misc_feature (427)..(435): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggganccactcggaccaccctanaccaagactactggggccagggaaccctggtcgccgtctcctcagcctccaccaagggcccaatcggtcttccccctggccaccctcctccaagagcacctctgggggcacagcagccctgggctgcctggtcaaggactacttccacgtagcgtgctgagcgggctggcaaggcgacatagnnnnnnnnn

SEQ ID NO: 254667 - DNA, 467 bp, Homo sapiens
  misc_feature: GYAE6OF01BYIT3.30.45.E01.1.454.CMB.1.raw
  modified_base (448)..(467): a, c, t, g, unknown or other
  misc_feature (448)..(467): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactacgtggggccagggaaccctggtcgccgtctcctcagcctccaccaacgggcccagtccggtccttcccccctggccacccctcctaccaacgacgccacctcgtcgggggcaccgagcacgcccgtgggctgccgtggtcaaggactactccacgtagcgtgcgtgacggcgggctcggacaaggcgacaatagnnnnnnnnnnnnnnnnnnnn

SEQ ID NO: 254668 - DNA, 247 bp, Homo sapiens
  misc_feature: GYAE6OF01C73PE.30.45.E01.1.454.CMB.1.raw
  modified_base (238)..(247): a, c, t, g, unknown or other
  misc_feature (238)..(247): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcacctatttccagggacgacgccaagaaatcagtatatctaacaaatgagtagcctgagagacgaggacacggctgtagtattactgagcgggctggacaaggcgacatagnnnnnnnnnn

SEQ ID NO: 254669 - DNA, 455 bp, Homo sapiens
  misc_feature: GYAE6OF01A9HSY.30.45.E01.1.454.CMB.1.raw
  modified_base (226)..(226): a, c, t, g, unknown or other
  misc_feature (226)..(226): n is a, c, g, or t
  modified_base (431)..(431): a, c, t, g, unknown or other
  misc_feature (431)..(431): n is a, c, g, or t
  modified_base (437)..(455): a, c, t, g, unknown or other
  misc_feature (437)..(455): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacgggctgtgtattactgtgcgggccggggganccactcggaccaccctacaccaagactactggggccagggaaccctggtcgccgtctcctcagcctccaccaagggcccactcggtcttccccctggccaccctcctaccaacgagccacctcgtcgggggcacgagccagccccgtcgggctgcctggtcaaggactacttccacgtagcgtgctgagtcgggctggcaaggcncatagnnnnnnnnnnnnnnnnnnn

SEQ ID NO: 254670 - DNA, 446 bp, Homo sapiens
  misc_feature: GYAE6OF01EW1OL.30.45.E01.1.454.CMB.1.raw
  modified_base (437)..(446): a, c, t, g, unknown or other
  misc_feature (437)..(446): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccacgtcggaccaccctacaccaagactactggggccagggaaccctggtcgccgtctcctcagcctccaccaaggccccatcggtcttccccctggccaccctcctccaacgacgcacctctcgggggcacagcacgcccgtcgggctcggccgtggtacaaggactaccttccacgtagcgtgctgacgcgggctggcaaggcgcatagnnnnnnnnnn

SEQ ID NO: 254671 - DNA, 524 bp, Homo sapiens
  misc_feature: GYAE6OF01B4DX7.30.45.E01.1.454.CMB.1.raw
  modified_base (222)..(222): a, c, t, g, unknown or other
  misc_feature (222)..(222): n is a, c, g, or t
  modified_base (474)..(474): a, c, t, g, unknown or other
  misc_feature (474)..(474): n is a, c, g, or t
  modified_base (478)..(478): a, c, t, g, unknown or other
  misc_feature (478)..(478): n is a, c, g, or t
  modified_base (486)..(486): a, c, t, g, unknown or other
  misc_feature (486)..(486): n is a, c, g, or t
  modified_base (491)..(491): a, c, t, g, unknown or other
  misc_feature (491)..(491): n is a, c, g, or t
  modified_base (493)..(503): a, c, t, g, unknown or other
  misc_feature (493)..(503): n is a, c, g, or t
  modified_base (507)..(510): a, c, t, g, unknown or other
  misc_feature (507)..(510): n is a, c, g, or t
  modified_base (512)..(513): a, c, t, g, unknown or other
  misc_feature (512)..(513): n is a, c, g, or t
  modified_base (516)..(516): a, c, t, g, unknown or other
  misc_feature (516)..(516): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
tcagcacgctacgtcacgaccggtgctcgatttagtgagtcagtaagggaaggggctggagtggatttcatatattagtgctggtgctactaccatgaagtacgcagactctgtgagggccattcaccatttccagggacgacgccaagaaatcagtatatctacaaatgagtagcctgagagacgaggacacggctgtcgtattactgtgcgggccggganccactccggaccacccgtacaccaagacctacgtcggggccacgggaaccctggtcgccgtctcctcacgcctccacacggcccatcggcttcccctggccaccctcctccaacgacgccaccgtcgtcggggccacgtacgcgacgcccgtgggctcggccgtcggtacaaggactaccgttaccacggtacgtccgtacgccgttaggaacggccgggtacgttcggacgaacggcgtacagttagctgnactncagcagcngtacngnnnnnnnnnnncgcnnnncnngcngncngngn

SEQ ID NO: 254672 - DNA, 531 bp, Homo sapiens
  misc_feature: GYAE6OF01DBE1Y.30.45.E01.1.454.CMB.1.raw
  modified_base (227)..(227): a, c, t, g, unknown or other
  misc_feature (227)..(227): n is a, c, g, or t
  modified_base (393)..(393): a, c, t, g, unknown or other
  misc_feature (393)..(393): n is a, c, g, or t
  modified_base (513)..(531): a, c, t, g, unknown or other
  misc_feature (513)..(531): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactggtggcggggccggggancccacgtccggaccaccctacaaccaagactacgtggggccgacgggaacccgtgggtccgccgtctcctcacgccctccaccgaacgggcccctacgtccggttcctcccccctggccctacccctcctacccaacgacgcctacccgtcggtcgggggcaacgngcaaccggcccgtcgggctcgcccgtggtacaacggtaccttaccctttcccgtacttccgtccggtaccttcgtcgggtacggccggggtcgtacgggccgaagggccgacgactaggnnnnnnnnnnnnnnnnnnn

SEQ ID NO: 254673 - DNA, 432 bp, Homo sapiens
  misc_feature: GYAE6OF01BBRDZ.30.45.E01.1.454.CMB.1.raw
  modified_base (421)..(432): a, c, t, g, unknown or other
  misc_feature (421)..(432): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccacgtcggaccaccctacaccaagactactggggccagggaaccctggtcgccgtctcctcagcctccaccagggcccatcggtcttccccctggccaccctcctccagacgcacctctgggggcacagcagccctgggctgcctggtcaaggctactcctctctcgactctgagcggctggcaaggcgcatagnnnnnnnnnnnn

SEQ ID NO: 254674 - DNA, 428 bp, Homo sapiens
  misc_feature: GYAE6OF01ACI96.30.45.E01.1.454.CMB.1.raw
  modified_base (423)..(428): a, c, t, g, unknown or other
  misc_feature (423)..(428): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactactggggccagggaaccctggtcgccgtctcctcagcctccaccaagggcccatcggtcttccccctggcaccctcctccaagacgcacctctgggggcacagcagccctgggctgcctggtcaaggactactccacgtagcgtgctgagcgggctggcaaggcgcatagnnnnnn

SEQ ID NO: 254675 - DNA, 574 bp, Homo sapiens
  misc_feature: GYAE6OF01DIGJ2.30.45.E01.1.454.CMB.1.raw
  modified_base (227)..(227): a, c, t, g, unknown or other
  misc_feature (227)..(227): n is a, c, g, or t
  modified_base (539)..(574): a, c, t, g, unknown or other
  misc_feature (539)..(574): n is a, c, g, or t
tcagcacgctacgtcacgaccggtgctcgatttagtgagtcagtaagggaaggggctggagtggatttcatatattagtgctggtgctactaccatgaagtacgcagactctgtggaggggccgattcaccatttccagggcacgccaagaaatcagtatatctaacaaatgagtagcctgagagacgaggacacggctgtgtattactggtgccggggccgggganccacgtccggacccaccctacaccaagactacgtcggggaccgacgggaacccgtggtccgccgtcctcctaccgaacgccctaccaaccgaacgggacccctacgtcccggttaccttccccccgtcggaccctacccctccctaccaacggacgcctaacccgtcggtcgggggaccaacgacgccgacgcccggtacgggcctcgcccgtaggtaccgaaagggtaaccttaccgttacccgaacggtacgtccggtacgccgtaggacggtcgggcgtacgggaccgtaacgggcgaacgagtagacnnnnnnnnnnnnnnnnnnnnnnnnnnnnnnnnnnnn

SEQ ID NO: 254676 - DNA, 426 bp, Homo sapiens
  misc_feature: GYAE6OF01A898T.30.45.E01.1.454.CMB.1.raw
  modified_base (224)..(224): a, c, t, g, unknown or other
  misc_feature (224)..(224): n is a, c, g, or t
  modified_base (417)..(417): a, c, t, g, unknown or other
  misc_feature (417)..(417): n is a, c, g, or t
  modified_base (422)..(426): a, c, t, g, unknown or other
  misc_feature (422)..(426): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggganccactcggaccaccctacaccaagactactgggggccagggaaccctggtcgccggtctcctcagcctccaccaagggcccatcggtcttccccctggcaccctcctccaagagcacctctgggggcacagcagccctgggctgcctggtcaggactactcacgtagcgtgctgagtcgggctggcaaggcgnatagnnnnn

SEQ ID NO: 254677 - DNA, 693 bp, Homo sapiens
  misc_feature: GYAE6OF01DF7T6.30.45.E01.1.454.CMB.1.raw
tcagcacgctacgtcacgaccggtgctcgatttagtgagtcagtaaggaagggggctggagtggactttcataactattagtgctcggtgctactaccactgaagtacgcagtacctctgtgaggggccgagttcaccgagtttccagggcgtacgtccgaaggaaatcagtatatctaacgaaatcgagtacgccgtgagagacgaggacacggctggtggtattacgtggtgacggggccggggagtccgacctccgggaccacccgtaacgaccctaagactaccgtgggggcctagggaaccctggtccgacccgttcctacccgtcacgtcctaccaaccaaaggggtccccgagtccggttaccttacccccgtcggccacccctccgtccctaagacggccgaacccgtcggtcggggacctacgacgacacggccccgtgggactcggtccgtaggtaccgaacggacccttaacttacccgtaacggttacgccggttacgacgtacgaacggccgggtaccgtcgggaaccgtaaacggcccgaacgtaacgacggaactcgacgtacgagtagtacgtccgagcgaacgcgcgacgtacgacgtacacgcgtacgtcctacgtacgttcgcgacgtagtacgtcgtacgtcgtcgtacggtacgtacgtacggtgtcgtacg

SEQ ID NO: 254678 - DNA, 447 bp, Homo sapiens
  misc_feature: GYAE6OF01CJ8DM.30.45.E01.1.454.CMB.1.raw
  modified_base (375)..(375): a, c, t, g, unknown or other
  misc_feature (375)..(375): n is a, c, g, or t
  modified_base (428)..(428): a, c, t, g, unknown or other
  misc_feature (428)..(428): n is a, c, g, or t
  modified_base (433)..(447): a, c, t, g, unknown or other
  misc_feature (433)..(447): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggatgacgccaagaaatcagtatatctacaaatgagtagcctgagagacgaggacacggctgtgtattactgtgcgggccgggagccacgtcggaccaccctacaccaaagactacgtggggccagggaaaccctggtcgccggtctcctcagccctccaccaagggcccactcggtcttccccctggccaccctcctccaagagcaccctcgtgggggcacagcacgccctgggcngcctggtccaaggactactccacgtagcgtgctggagcgggctgggcaaggcnatagnnnnnnnnnnnnnnn

SEQ ID NO: 254679 - DNA, 472 bp, Homo sapiens
  misc_feature: GYAE6OF01BALNB.30.45.E01.1.454.CMB.1.raw
  modified_base (446)..(447): a, c, t, g, unknown or other
  misc_feature (446)..(447): n is a, c, g, or t
  modified_base (449)..(472): a, c, t, g, unknown or other
  misc_feature (449)..(472): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactactggggccagggaaccctggtcgccgtctcctcagcctccaccaacgggccccactcggtccttccccctggccacccgtcctccaacgacgcacctcgtcgggggcacgacgcgacgcccgtgggctcgcctggtcaaggactaccttccacgtagcgtgctgaggcgggcgtggctaacggcgcagtacgnngnnnnnnnnnnnnnnnnnnnnnnnn

SEQ ID NO: 254680 - DNA, 520 bp, Homo sapiens
  misc_feature: GYAE6OF01BO9V0.30.45.E01.1.454.CMB.1.raw
  modified_base (225)..(225): a, c, t, g, unknown or other
  misc_feature (225)..(225): n is a, c, g, or t
  modified_base (472)..(472): a, c, t, g, unknown or other
  misc_feature (472)..(472): n is a, c, g, or t
  modified_base (480)..(480): a, c, t, g, unknown or other
  misc_feature (480)..(480): n is a, c, g, or t
  modified_base (484)..(489): a, c, t, g, unknown or other
  misc_feature (484)..(489): n is a, c, g, or t
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
  modified_base (495)..(502): a, c, t, g, unknown or other
  misc_feature (495)..(502): n is a, c, g, or t
  modified_base (504)..(517): a, c, t, g, unknown or other
  misc_feature (504)..(517): n is a, c, g, or t
  modified_base (519)..(520): a, c, t, g, unknown or other
  misc_feature (519)..(520): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactggtgcggggccggggngccacgtccggaccacccctacaaccaagactacgtggggccgaggaccctggtcgccgtcctcctcacgcctccaccgacggccccatccggtccttcccctggccacccctcctccaagacgccaccgtcgtgggggccacgacgcacgcccgtgggctcgccgtcggtacgaacggtaccttaccttcccgtacgtacggtcggtcgcgtggacggcgggcgtcggacgaacggcgacagtagngactgcancgannnnnncngngnnnnnnnngnnnnnnnnnnnnnngnn

SEQ ID NO: 254681 - DNA, 685 bp, Homo sapiens
  misc_feature: GYAE6OF01AZUT5.30.45.E01.1.454.CMB.1.raw
  modified_base (664)..(664): a, c, t, g, unknown or other
  misc_feature (664)..(664): n is a, c, g, or t
tcagcacgctacgtcacgaccggtgctcgatttagtgagtcagtaagggaaaggggctggagtggatttcatatattagtgctggtgctactaccatgaagtacgcagactctgtgagggccgattcaccatttccagggacgacgccaagaaatcagtatatctacaaatgagtagcctgagagacgaggacacggctgtgtattactgtgcgggccgggagccacgtcggaccaccctacaccaagactacgtgggaccgacggaaccctcggtcgacccgtcctcctcacgcctccaccgaacggcccacgtccggtacttccccccgtggaccctacccctcctaccaacgtacgcctaaccgttccggcggggaccaacgacggaccgtacgccccggtacgggtccgtccgtccgtacggtaaccgtaaacggtaaccctttacccgttacccgttccgttacccgtaccgttaaccgtaccgttacgggaaccgggcccggggttaccgtaacgggaacccgggtaaacccgggaccggtaccgttaaaaccggtacgtacgacgtacgacgtacgacgacgtacgatacgacgtacgacgacgtacacgtacgtacgacacgacgtagtacgtacgtacgcgacgtacgtacacanacgtacgacgtacacgacaga

SEQ ID NO: 254682 - DNA, 518 bp, Homo sapiens
  misc_feature: GYAE6OF01DXILA.30.45.E01.1.454.CMB.1.raw
  modified_base (226)..(226): a, c, t, g, unknown or other
  misc_feature (226)..(226): n is a, c, g, or t
  modified_base (258)..(258): a, c, t, g, unknown or other
  misc_feature (258)..(258): n is a, c, g, or t
  modified_base (483)..(518): a, c, t, g, unknown or other
  misc_feature (483)..(518): n is a, c, g, or t
tcagcacgctacgtcacgaccggtgctcgatttagtgagtcagtaaggggaaggggctggagtggatttcatatattagtgctggtgctactaccatgaagtacgcagactctgtggaggggccattcaccatttccaggggacacgccaagaaatcagtatatctaacaaatgagtagcctgagagacgaggacacggctgtgtattactgtgcggggcgggganccactcggaccaccctacaaccaagactacgnggggaccacgggaaccctggtcgccgtctcctcacgcctcccacaacgggcccatccggtccttcccccgtggccacccctcctccgaagacgccaccctcgtcgggggccacagccacgccgtggggctgcccgtggtaccaacggtacctaccgttccgaacggtacggccgtagccgtaggacggccgggacgtcgggacgaacgggtcgacgtagtaggcnnnnnnnnnnnnnnnnnnnnnnnnnnnnnnnnnnnn

SEQ ID NO: 254683 - DNA, 440 bp, Homo sapiens
  misc_feature: GYAE6OF01B1S5T.30.45.E01.1.454.CMB.1.raw
  modified_base (424)..(424): a, c, t, g, unknown or other
  misc_feature (424)..(424): n is a, c, g, or t
  modified_base (429)..(440): a, c, t, g, unknown or other
  misc_feature (429)..(440): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggacccaccctacaccaagactacgtggggccgagggaaccctggtcgccgtctcctcagcctccaccaaggccatcggtccttccccctgccaccctcctccaagacgccacctcgtggggcacgagcacgccctgggctgcctcggtcaaggactacttccacgtagacgtgcgtgagcgggctgcgagcgnatagnnnnnnnnnnnn

SEQ ID NO: 254684 - DNA, 505 bp, Homo sapiens
  misc_feature: GYAE6OF01BQ259.30.45.E01.1.454.CMB.1.raw
  modified_base (476)..(477): a, c, t, g, unknown or other
  misc_feature (476)..(477): n is a, c, g, or t
  modified_base (479)..(505): a, c, t, g, unknown or other
  misc_feature (479)..(505): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactccggaccacccctacaccaagactacgtggggaccacgggaccctcggtcgccgtctcctcacgcctccaccgaacgggccccatccggtccttcccccctggcccacccctccctaccaagacgccacccgtcgtcgggggccacgacgcgacgcccgtgggcctcgtcctggtacaaggaccttaccgtccacgtacgcgtgtcgtggacggccgggcgtcgggacgaacgggcgacagtacgnngnnnnnnnnnnnnnnnnnnnnnnnnnnn

SEQ ID NO: 254685 - DNA, 484 bp, Homo sapiens
  misc_feature: GYAE6OF01DU7TV.30.45.E01.1.454.CMB.1.raw
  modified_base (223)..(223): a, c, t, g, unknown or other
  misc_feature (223)..(223): n is a, c, g, or t
  modified_base (439)..(439): a, c, t, g, unknown or other
  misc_feature (439)..(439): n is a, c, g, or t
  modified_base (447)..(447): a, c, t, g, unknown or other
  misc_feature (447)..(447): n is a, c, g, or t
  modified_base (449)..(451): a, c, t, g, unknown or other
  misc_feature (449)..(451): n is a, c, g, or t
  modified_base (453)..(484): a, c, t, g, unknown or other
  misc_feature (453)..(484): n is a, c, g, or t
tcagcacgctacgtcacgaccggtgctcgatttagtgagtcagtaagggaaggggctggagtggatttcatatattagtgctggtgctactaccatgaagtacgcagactctgtgagggccgattcaccatttccagggacacgccaagaaatcagtatatctacaaatgagtagcctgagagacgaggacacggctgtgtattactgtgcggggccgggganccactcggaccacctacaccaagactactggggaccagggaaccctggtcgccgtctcctcacgcctccaccaagggccccatccggtccttccccctgggccacccctccctccaacgacgcctacctcgtcgggggcacgagcagcccgtgggctgcctggtcaacggactacttccacggtagcgtagctgacggcgggctgggacaagggcncgagtagnannntnnnnnnnnnnnnnnnnnnnnnnnnnnnnnnnn

SEQ ID NO: 254686 - DNA, 708 bp, Homo sapiens
  misc_feature: GYAE6OF01DKZZB.30.45.E01.1.454.CMB.1.raw
  modified_base (702)..(702): a, c, t, g, unknown or other
  misc_feature (702)..(702): n is a, c, g, or t
tcagcacgctacgtcacgaccggtgctcgatttagtgagtcagtaagggaagggctggagtggatttcatatattagtgctggtgctactaccatgaagtacgcagactctgtgaggggccgattcaccatttccgagggacgacgccaaagaaatcagtatatctaacaaatgagtagcctgagagacgaggacgacggtctgtgttattacgtggtgcggggcggggacgccacgtccggaacccaccctaccaaccgaagacctacgtcggggaccgacgggaccgtcggtccgccgtctcctcgacgccctaccgaccgacggacccacgtccggttcccttcccccgtcggcccctaccccgtccctaccgaacgaccgacccgtacccgttcgggtaccggggaccaaccggacgaccgaacccggtccccggtcggggtcccgtccggtaccggttcggtaaccgtaaacggtaacccttaccggttaccccgaacggtacggtccggtacgggtaccgtaacgggtcgggtaccggggaccggttacgggaccggaaacgggccggtaaccgtaaagggttaacggcgtaagacgacgacgtcgcgagacgacgacgacacgacgtagacgtcgtacgacgacgacgtagcgacgcgtacgtgacgtacgacgacgtacgtacgacgagtacgntcgtag

SEQ ID NO: 254687 - DNA, 558 bp, Homo sapiens
  misc_feature: GYAE6OF01AOP44.30.45.E01.1.454.CMB.1.raw
  modified_base (207)..(207): a, c, t, g, unknown or other
  misc_feature (207)..(207): n is a, c, g, or t
  modified_base (231)..(231): a, c, t, g, unknown or other
  misc_feature (231)..(231): n is a, c, g, or t
  modified_base (428)..(428): a, c, t, g, unknown or other
  misc_feature (428)..(428): n is a, c, g, or t
  modified_base (524)..(524): a, c, t, g, unknown or other
  misc_feature (524)..(524): n is a, c, g, or t
  modified_base (528)..(558): a, c, t, g, unknown or other
  misc_feature (528)..(558): n is a, c, g, or t
tcagcacgctacgtcacgaccggtgctcgatttagtgagtcagtaagggaaggggctggagtggatttcatatattagtgctggtgctactaccatgaagtacgcagactctgtggaggggccgattcaccatttccgagggacgacgccaaagaaatcagtatatctaacaaatgagtagcctggagagacgaggacacggctgtntattactgtggcggggccggggancccactccggacccaccctacaaccaagactacgtggggacccacgggaaccctggtccggccgtcctcctcacgccctccaccggacggccccacgtccggttccccttcccccgtcggcccaccccttccctaccgaacggacgcccaccggttccggcgggggccacgacgccgaccggtccccggtgggtccnccggtccgtcgggtaccgaaacggtcctttaacccgtaccgtacggtacgcggtcgtcgtcggacgggcggcgtacgggacgaccggtcacgtagngacnnnnnnnnnnnnnnnnnnnnnnnnnnnnnnn

SEQ ID NO: 254688 - DNA, 479 bp, Homo sapiens
  misc_feature: GYAE6OF01DK6RC.30.45.E01.1.454.CMB.1.raw
  modified_base (196)..(196): a, c, t, g, unknown or other
  misc_feature (196)..(196): n is a, c, g, or t
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (224)..(224): a, c, t, g, unknown or other
  misc_feature (224)..(224): n is a, c, g, or t
  modified_base (279)..(279): a, c, t, g, unknown or other
  misc_feature (279)..(279): n is a, c, g, or t
  modified_base (286)..(286): a, c, t, g, unknown or other
  misc_feature (286)..(286): n is a, c, g, or t
  modified_base (349)..(349): a, c, t, g, unknown or other
  misc_feature (349)..(349): n is a, c, g, or t
  modified_base (386)..(386): a, c, t, g, unknown or other
  misc_feature (386)..(386): n is a, c, g, or t
  modified_base (421)..(421): a, c, t, g, unknown or other
  misc_feature (421)..(421): n is a, c, g, or t
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
  modified_base (444)..(444): a, c, t, g, unknown or other
  misc_feature (444)..(444): n is a, c, g, or t
  modified_base (450)..(479): a, c, t, g, unknown or other
  misc_feature (450)..(479): n is a, c, g, or t
tcagcacgctacgtcacgaccggtgctcgatttagtgagtcagtaagggaaggggctggagtggatttcatatattagtgctggtgctactaccatgaagtacgcagactctgtggaggggccgatcacatttccagggcacgccaaagaaatcaagtatatactaacaaaatgaagtagcctgagagacgagacncggctgngtatactgngccgggcgggancacgtcgacctaccacacgacacgtacggcggacgacggaccctggtccgctccnctcgacnccctccaacgacggccctaacgtccgggttccttccccgagccctacccgtcccacgaaggcnccgacgcggtcgggacagacgtcacgcgtaggcctanccgtagacgaagtactctacaggtacgcctggtcngaggccgggtnggcgaagnaacngagcgnnnnnnnnnnnnnnnnnnnnnnnnnnnnnn

SEQ ID NO: 254689 - DNA, 451 bp, Homo sapiens
  misc_feature: GYAE6OF01BEMUX.30.45.E01.1.454.CMB.1.raw
  modified_base (224)..(224): a, c, t, g, unknown or other
  misc_feature (224)..(224): n is a, c, g, or t
  modified_base (440)..(451): a, c, t, g, unknown or other
  misc_feature (440)..(451): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggganccacgtcggaccaccctacaccaagactacgtggggccagggaaccctggtcgccgtctcctcagccctccaccaacgggccccatcggtccttccccctggccacccctcctccaacgagcacctcgtgggggcacgagcaacgccctggggctcgccgtggtcaaggctaccttccgacgtagcgtgctgagcgggctggcgaaggcgcatagnnnnnnnnnnnn

SEQ ID NO: 254690 - DNA, 603 bp, Homo sapiens
  misc_feature: GYAE6OF01BUPSJ.30.45.E01.1.454.CMB.1.raw
  modified_base (210)..(210): a, c, t, g, unknown or other
  misc_feature (210)..(210): n is a, c, g, or t
  modified_base (225)..(225): a, c, t, g, unknown or other
  misc_feature (225)..(225): n is a, c, g, or t
  modified_base (516)..(516): a, c, t, g, unknown or other
  misc_feature (516)..(516): n is a, c, g, or t
  modified_base (522)..(522): a, c, t, g, unknown or other
  misc_feature (522)..(522): n is a, c, g, or t
  modified_base (537)..(537): a, c, t, g, unknown or other
  misc_feature (537)..(537): n is a, c, g, or t
  modified_base (549)..(549): a, c, t, g, unknown or other
  misc_feature (549)..(549): n is a, c, g, or t
  modified_base (555)..(555): a, c, t, g, unknown or other
  misc_feature (555)..(555): n is a, c, g, or t
  modified_base (585)..(585): a, c, t, g, unknown or other
  misc_feature (585)..(585): n is a, c, g, or t
  modified_base (594)..(594): a, c, t, g, unknown or other
  misc_feature (594)..(594): n is a, c, g, or t
  modified_base (599)..(599): a, c, t, g, unknown or other
  misc_feature (599)..(599): n is a, c, g, or t
tcagcacgctacgtcacgaccggtgctcgatttagtgagtcagtaagggaaggggctggagtggatttcgatatattagtgctggtgctactaccatgaagtacgcagactctgtgagggccgattcaccatttccagggaccgacgccaagaaatcagtatatctacaaatgagtagcctgagagacgaggaccaggctgtgtattacngtgcgggtccggganccactccggaccaccctacaaccgaagtactacgtcggggaccagggaaccctggtcgccgtctcctcacgcctccaccgaacgggcccactcggtccttacccccgtggccaccctcctaccgtaacgcgcctaccgtcgtcggggtacacgacgcacgcccgtagggctcggtcctggtaccaacggacctacgttacccgacggtagtccgttacgtcgttaggacggtccgggtacgttacggggaaccgttaacgggacccggtacgtaaacgttacggacgtcgngtacgngacggactgccgtanagagacgagcgngacgancgacgtctctcgtcgcgtcgacgactcacngactcacanctcgngtcg

SEQ ID NO: 254691 - DNA, 435 bp, Homo sapiens
  misc_feature: GYAE6OF01DROOZ.30.45.E01.1.454.CMB.1.raw
  modified_base (225)..(225): a, c, t, g, unknown or other
  misc_feature (225)..(225): n is a, c, g, or t
  modified_base (336)..(336): a, c, t, g, unknown or other
  misc_feature (336)..(336): n is a, c, g, or t
  modified_base (420)..(421): a, c, t, g, unknown or other
  misc_feature (420)..(421): n is a, c, g, or t
  modified_base (423)..(435): a, c, t, g, unknown or other
  misc_feature (423)..(435): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccgggganccactcggaccaccctacaccaagactacgtggggccagggaaccctggtcgccgtctcctcagcctccaccaagggcccatcggtcttcccctggcaccctcctccaagncacctctgggggcacagcacgccctgggctgcctggtcaaggactactccacgtagcgtgctgagcggctggcaggcgcatagnngnnnnnnnnnnnnn

SEQ ID NO: 254692 - DNA, 545 bp, Homo sapiens
  misc_feature: GYAE6OF01CWSSX.30.45.E01.1.454.CMB.1.raw
  modified_base (224)..(224): a, c, t, g, unknown or other
  misc_feature (224)..(224): n is a, c, g, or t
  modified_base (348)..(348): a, c, t, g, unknown or other
  misc_feature (348)..(348): n is a, c, g, or t
  modified_base (511)..(511): a, c, t, g, unknown or other
  misc_feature (511)..(511): n is a, c, g, or t
  modified_base (513)..(545): a, c, t, g, unknown or other
  misc_feature (513)..(545): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccattcaccatttccagggacgacgccaagaaatcagtatatctaacaaatgagtagcctgagagacgaggacacggctgtgtattactgtgcggggcgggganccactcggaccaccctacaccagactacgtggggccagggaaccctggtcgccgtctcctcagcctccaccgacgggcccagtccggtccttcccccgtcggccacccctccctaccaacgacnccacccgtcggtcgggggccacgacgcgacgccccggtcgggctcgccgtacgggtaccaaaggtaccttacccgtttaccgaacggttacggccggtcgtccgtagggtaaccggccgggggtacgttcgggaaccgtaacggggccgaccgtaagtacggngnnnnnnnnnnnnnnnnnnnnnnnnnnnnnnnnn

SEQ ID NO: 254693 - DNA, 545 bp, Homo sapiens
  misc_feature: GYAE6OF01AIBIZ.30.45.E01.1.454.CMB.1.raw
  modified_base (225)..(225): a, c, t, g, unknown or other
  misc_feature (225)..(225): n is a, c, g, or t
  modified_base (289)..(289): a, c, t, g, unknown or other
  misc_feature (289)..(289): n is a, c, g, or t
  modified_base (507)..(508): a, c, t, g, unknown or other
  misc_feature (507)..(508): n is a, c, g, or t
  modified_base (510)..(545): a, c, t, g, unknown or other
  misc_feature (510)..(545): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccgggganccacgtcggaccaccctacaccaagactacgtggggccacgggaaccctggtccgccgtctccncacgcctccaccgacgggccccagtccggtccttcccccgtgccctaccctccctaccaagacgccacctcggtcgggggaccacgacgccacgtcccgtcggggcctcggccgtcggtacgaacggtaccttacctttcccttcctccgtccgaaccttcgtacgggacgggccggggtccgtcggggtaccgaaacgggccgtacctaagtacggnngnnnnnnnnnnnnnnnnnnnnnnnnnnnnnnnnnnnn

SEQ ID NO: 254694 - DNA, 444 bp, Homo sapiens
  misc_feature: GYAE6OF01BSPQ2.30.45.E01.1.454.CMB.1.raw
  modified_base (416)..(416): a, c, t, g, unknown or other
  misc_feature (416)..(416): n is a, c, g, or t
  modified_base (423)..(444): a, c, t, g, unknown or other
  misc_feature (423)..(444): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactgggggccagggaaccctggtcgccgtctcctcagcctccaccaaggcccatcggtcttcccctggcaccatcctccaagacgcacctctgggggcacagcggccctgggctgcctggtcaaggctacttccacgtagcgtgctgagcgggctggcaaggcgnacgtagnnnnnnnnnnnnnnnnnnnnnn

SEQ ID NO: 254695 - DNA, 509 bp, Homo sapiens
  misc_feature: GYAE6OF01EWYY2.30.45.E01.1.454.CMB.1.raw
  modified_base (258)..(258): a, c, t, g, unknown or other
  misc_feature (258)..(258): n is a, c, g, or t
  modified_base (481)..(482): a, c, t, g, unknown or other
  misc_feature (481)..(482): n is a, c, g, or t
  modified_base (484)..(509): a, c, t, g, unknown or other
  misc_feature (484)..(509): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactggtgcggggccggggagccacgtcggacccaccctacaccaagctacgnggggccagggaaccctggtccgccgtctcctcacgccctccaccaagggccccagtccggtccttcccccgtggcccacccctccctaccaacgacgcctaccgtcgtgggggccacgacgccagccccgtgggctgccctggtaccgaacggtactacctccgaacgtacggcggtcgcgtgggacggcggggtcctgggacgtaacgggccgacagtacgnngnnnnnnnnnnnnnnnnnnnnnnnnnn

SEQ ID NO: 254696 - DNA, 527 bp, Homo sapiens
  misc_feature: GYAE6OF01EUVCB.30.45.E01.1.454.CMB.1.raw
  modified_base (223)..(223): a, c, t, g, unknown or other
  misc_feature (223)..(223): n is a, c, g, or t
  modified_base (256)..(256): a, c, t, g, unknown or other
  misc_feature (256)..(256): n is a, c, g, or t
  modified_base (500)..(527): a, c, t, g, unknown or other
  misc_feature (500)..(527): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggngccacgtcggaccaccctacaccaagactacgnggggccagggaaccctggtcgccgtctcctcacgcctccaccgaacgggccccagtccggtcccttccccccgtcgggcctaccccttccctacccaacgacgcccaacccttcggtcggggggaccacgacgccgacgccccgtcgggcgtcgcccgtgggtacgaacggtaccttaccttcccgtaacggtacgctcgtactcggacggccggggcgtgggacgaacgggcgctacgtagcnnnnnnnnnnnnnnnnnnnnnnnnnnnn

SEQ ID NO: 254697 - DNA, 553 bp, Homo sapiens
  misc_feature: GYAE6OF01EORCX.30.45.E01.1.454.CMB.1.raw
  modified_base (168)..(168): a, c, t, g, unknown or other
  misc_feature (168)..(168): n is a, c, g, or t
  modified_base (178)..(178): a, c, t, g, unknown or other
  misc_feature (178)..(178): n is a, c, g, or t
  modified_base (209)..(209): a, c, t, g, unknown or other
  misc_feature (209)..(209): n is a, c, g, or t
  modified_base (463)..(463): a, c, t, g, unknown or other
  misc_feature (463)..(463): n is a, c, g, or t
  modified_base (502)..(502): a, c, t, g, unknown or other
  misc_feature (502)..(502): n is a, c, g, or t
  modified_base (516)..(516): a, c, t, g, unknown or other
  misc_feature (516)..(516): n is a, c, g, or t
  modified_base (518)..(523): a, c, t, g, unknown or other
  misc_feature (518)..(523): n is a, c, g, or t
  modified_base (525)..(553): a, c, t, g, unknown or other
  misc_feature (525)..(553): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccattcaccatttccagggacgacgccaaagaaatcagtatatctanaaatgagtancctgagagacgagacacggctgtgtattacnggtggccggggcggggagccacgtccggaacccaccctacaccaagactagcggggccagggaaccctggccgcccgtctcctcacgccctacccaaccgaacggacccctacgttccggtcccctttccccccgtcgggccccaccccttccctaccaagacgcctaccgtcggtacggggccacacgccaccggcccgtcgggcgtcgccctgggacaaacggtaccttacgtcccgtaaggtacgtcggtnacggtggacgggtccgggacgtcggacggaacgggccgngtaagacggcagtngnnnnnngnnnnnnnnnnnnnnnnnnnnnnnnnnnnn

SEQ ID NO: 254698 - DNA, 455 bp, Homo sapiens
  misc_feature: GYAE6OF01DN9RJ.30.45.E01.1.454.CMB.1.raw
  modified_base (436)..(455): a, c, t, g, unknown or other
  misc_feature (436)..(455): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggacccaccctacaccaagactacgtggggccagggaaccctggtccgccgtctcctcagcctccaccgaacgggcccagtcggtccttcccccgtggccaccctcctccaagcgccacctcgtggggcacagcacgccctgggctgcctgcaaggactactccacgtagcgtgcgtgacggcggctaggcaaggcgacagtacgnnnnnnnnnnnnnnnnnnnn

SEQ ID NO: 254699 - DNA, 446 bp, Homo sapiens
  misc_feature: GYAE6OF01BXC4L.30.45.E01.1.454.CMB.1.raw
  modified_base (423)..(446): a, c, t, g, unknown or other
  misc_feature (423)..(446): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttccccctggcaccctcctccaagagcacctctgggggcacagcagccctgggctgcctggtcaaggactacttcctctctcgactctgagcgggctggcaggcgcatacgnnnnnnnnnnnnnnnnnnnnnnnn

SEQ ID NO: 254700 - DNA, 549 bp, Homo sapiens
  misc_feature: GYAE6OF01A4R0W.30.45.E01.1.454.CMB.1.raw
  modified_base (231)..(231): a, c, t, g, unknown or other
  misc_feature (231)..(231): n is a, c, g, or t
  modified_base (514)..(514): a, c, t, g, unknown or other
  misc_feature (514)..(514): n is a, c, g, or t
  modified_base (516)..(549): a, c, t, g, unknown or other
  misc_feature (516)..(549): n is a, c, g, or t
tcagcacgctacgtcacgaccggtgctcgatttagtgagtcagtaagggaaggggctggagtggatttcatatattagtgctggtgctactaccatgaagtacgcagactctgtggaggggccgattcaccatttccagggacgacgccaaagaaatcagtatatctaacaaatgagtagcctgagagacgaggacacggctggtgtattactggtggcggggccgggganccacgtccggacccaccctacaccaagactacgtggggaccgagggaaccctggtcgccggtctcctcacgccctccaccgaacggccccagtccggtccttcccccgtggccacccctccctaccaacgcgcccacctcggtcggggccacgcgccacgcccgtgggactccgcgtacgggtaccgaaacgggtaccttaccgtacccgtacggtacggtccgttcgtacgcggggtaccggtccggttacgggacgaacgggccgtacgaaggtacgcgancnnnnnnnnnnnnnnnnnnnnnnnnnnnnnnnnnn

SEQ ID NO: 254701 - DNA, 531 bp, Homo sapiens
  misc_feature: GYAE6OF01CJOVN.30.45.E01.1.454.CMB.1.raw
  modified_base (292)..(292): a, c, t, g, unknown or other
  misc_feature (292)..(292): n is a, c, g, or t
  modified_base (469)..(475): a, c, t, g, unknown or other
  misc_feature (469)..(475): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (487)..(488): a, c, t, g, unknown or other
  misc_feature (487)..(488): n is a, c, g, or t
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
  modified_base (498)..(498): a, c, t, g, unknown or other
  misc_feature (498)..(498): n is a, c, g, or t
  modified_base (501)..(504): a, c, t, g, unknown or other
  misc_feature (501)..(504): n is a, c, g, or t
  modified_base (508)..(510): a, c, t, g, unknown or other
  misc_feature (508)..(510): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (527)..(527): a, c, t, g, unknown or other
  misc_feature (527)..(527): n is a, c, g, or t
  modified_base (529)..(529): a, c, t, g, unknown or other
  misc_feature (529)..(529): n is a, c, g, or t
tcagcacgctacgtcacgaccggtgctcgattttagtgagtcagtaagggaaggggctggaggtggatttcatatattagtgctggtgctactaccatgaagtacgcagactctgtggaggggccgagttcaccattttccagggacgacgccaagaaatcaggtatatctacaaatgagtagcctgagagacgaggcacggctgtgtattactgtgcgggccggggagccaagtcggaaccacctacaaccaagactactggggccagggaaccctgtcgaccgtctcctnagccttacaccaagggccaagtcggacttccccgaggccacccgtcctcaacgagccacctcgtggggacacgagcacgttacccgagggtactagaccgtggtacgaagacgtactttcgacgttacgctactacgtcggaggcggcgtttacggacgaagggcaccgatacggannnnnnnanananananannatnanacganatnnnncgcnnncagagagacgananacngnga

SEQ ID NO: 254702 - DNA, 526 bp, Homo sapiens
  misc_feature: GYAE6OF01DY1YW.30.45.E01.1.454.CMB.1.raw
  modified_base (225)..(225): a, c, t, g, unknown or other
  misc_feature (225)..(225): n is a, c, g, or t
  modified_base (495)..(496): a, c, t, g, unknown or other
  misc_feature (495)..(496): n is a, c, g, or t
  modified_base (500)..(526): a, c, t, g, unknown or other
  misc_feature (500)..(526): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccgggganccacgtccggaccaccctacaccaagactacgtggggccagggaaccctggtccgccgtctcctcacgccctaccaccgaacgggccccagtccggttacccttcccccccgtggccctaccccgtccctacccgaagacgccctaacccgtcggtcgggggccaacgcgccacgtcccgtgggctcgccgtcggacaacggtccttaccttaccgacgtacggcgtcgcgtcggacggcgggcgtgggacgaacggcgacgtagtaggnntgcnnnnnnnnnnnnnnnnnnnnnnnnnnn

SEQ ID NO: 254703 - DNA, 554 bp, Homo sapiens
  misc_feature: GYAE6OF01C18M7.30.45.E01.1.454.CMB.1.raw
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (475)..(475): a, c, t, g, unknown or other
  misc_feature (475)..(475): n is a, c, g, or t
  modified_base (523)..(554): a, c, t, g, unknown or other
  misc_feature (523)..(554): n is a, c, g, or t
tcagcacgctacgtcacgaccggtgctcgatttagtgagtcagtaagggaagggggctgggagtggatttcatatattagtgctggtgctactaccatgaagtacgcagactctgtgaggggccgattcaccatttccagggacgacgccaaagaaatcagtatatctaacaaatgagtagcctgagagacgaggacacggntgtgtatactgtggcggggccgggganccactccggaccacctacaccaagactacgtcggggccgaacgggaccctcggtccgcccgttcctccctccacgccctaccccaaccgaacggcccacgtccggttcccttcccccgtcggccccacccctccctaccgaaggaccgcctacccgtcggtcgggggaccaccgagccgacgtcccggtacgggctcggccgttcggtacgaacggtacctacccgttaccgaacggtacgtcggntccgtaggaccggcgggtcgtggaaccggaaggtccgacgtaataggnnnnnnnnnnnnnnnnnnnnnnnnnnnnnnnn

SEQ ID NO: 254704 - DNA, 156 bp, Homo sapiens
  misc_feature: GYAE6OF01ACRFJ.30.45.E01.1.454.CMB.1.raw
  modified_base (153)..(156): a, c, t, g, unknown or other
  misc_feature (153)..(156): n is a, c, g, or t
tcagcacgctacgtcacgaccggtgctcgatttagtgagtcagtaagggaaagggaccaaggtggaaatcaaacgaactgtggctgcaccatctgtcttcatcttcccgccatctgaacgtagcgtgctgagcgggctggcaaggcgcatagnnnn

SEQ ID NO: 254705 - DNA, 570 bp, Homo sapiens
  misc_feature: GYAE6OF01DKGFT.30.45.E01.1.454.CMB.1.raw
  modified_base (211)..(211): a, c, t, g, unknown or other
  misc_feature (211)..(211): n is a, c, g, or t
  modified_base (227)..(227): a, c, t, g, unknown or other
  misc_feature (227)..(227): n is a, c, g, or t
  modified_base (532)..(533): a, c, t, g, unknown or other
  misc_feature (532)..(533): n is a, c, g, or t
  modified_base (535)..(570): a, c, t, g, unknown or other
  misc_feature (535)..(570): n is a, c, g, or t
tcagcacgctacgtcacgaccggtgctcgatttagtgagtcagtaagggaaaggggctggagtggatttcatatattagtgctggtgctactaccatgaagtacgcagactctgtggagggccgattcacatttccagggacgacgccaagaaatcagtatatctaacaaatgagtagcctgagagacgaggacacggctgtgtattacgngtggcggggcgggganccactccggacccaccctacaccaagactacgtggggccacggggaaccctggtcgcccgtctccctcgacgcccctccgaacccgaacgggcccctacgtccggttcccttccccccgtggcccctaacccccttccctaccgaacgaccgcctacccgtcggtacggggccacgacgcgaccggccgtcgggctcgcccgttaggaccgtaaacggtacctttacccgttccctaccttccgtaccggtaccttcgtcggacggtccgggcgttacgggaccgtaaggccgtacgaagtcggnntnnnnnnnnnnnnnnnnnnnnnnnnnnnnnnnnnnnn

SEQ ID NO: 254706 - DNA, 490 bp, Homo sapiens
  misc_feature: GYAE6OF01BBSBS.30.45.E01.1.454.CMB.1.raw
  modified_base (254)..(254): a, c, t, g, unknown or other
  misc_feature (254)..(254): n is a, c, g, or t
  modified_base (348)..(348): a, c, t, g, unknown or other
  misc_feature (348)..(348): n is a, c, g, or t
  modified_base (455)..(490): a, c, t, g, unknown or other
  misc_feature (455)..(490): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactacnggggccagggaaccctggtcgccgtctccctcacgcctccacccgaagggccccagtccggtcttcccccctggccacccctccctccaacganccacctcgtgggggcacacgcacgccctggggctgcctggtcgaacggacctacttcccaacgtagcgtgcctgagtcgggactgggacaagggcgacactagcgtnnnnnnnnnnnnnnnnnnnnnnnnnnnnnnnnnnnn

SEQ ID NO: 254707 - DNA, 467 bp, Homo sapiens
  misc_feature: GYAE6OF01B2LSH.30.45.E01.1.454.CMB.1.raw
  modified_base (455)..(467): a, c, t, g, unknown or other
  misc_feature (455)..(467): n is a, c, g, or t
tcagcacgctacgtcacgaccggtgctcgatttagtgagtcagtaagggaaggggctggagtggatttcatatattagtgctaggtgctactaccatgaagtacgcagactctgtgaggggccgattcaccatttccagggacgacgccaagaaatcagtatatctacaaatgagtagcctgagagacgaggacacggctgtgtattactgtgcggggccggggagccacgtcggaccacccctacaccaagactactggggccagggaaccctggtcgccgtctcctcacgcctccaccaacgggccccactcggtccttcccccctcggccacccctcctccgaacgacgcaccctccgtagggggccacgacgcacgcccgtgggctcgcctcggtcaacggtactaccttccacgtacgcgtcgctgacgcgggctggcaggccgcatagnnnnnnnnnnnnn

SEQ ID NO: 254708 - DNA, 506 bp, Homo sapiens
  misc_feature: GYAE6OF01B03HP.30.45.E01.1.454.CMB.1.raw
  modified_base (474)..(476): a, c, t, g, unknown or other
  misc_feature (474)..(476): n is a, c, g, or t
  modified_base (478)..(506): a, c, t, g, unknown or other
  misc_feature (478)..(506): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactacgtggggccagggaaccctggtcgccgtctccctcacgcctccaccaacgggccccatcggtccttccccctcggccacccctcctccaacgacgccacctcgtgggggcacgacgcacgccccgtgggctcgccgtcggtcgaaggtaccttacgttacccacggtacgccggtcgcgtggacgggccgggtcgtcgggaccgaagggccgcacgtacggnnncnnnnnnnnnnnnnnnnnnnnnnnnnnnnn

SEQ ID NO: 254709 - DNA, 454 bp, Homo sapiens
  misc_feature: GYAE6OF01ETCRD.30.45.E01.1.454.CMB.1.raw
  modified_base (225)..(225): a, c, t, g, unknown or other
  misc_feature (225)..(225): n is a, c, g, or t
  modified_base (445)..(454): a, c, t, g, unknown or other
  misc_feature (445)..(454): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccgggganccactcggaccaccctacaccaagactacgtggggccagggaaccctggtccgccgtctcctcacgccctccaccaacgggccccatccggtccttccccccgtggcccaccctccctaccgaacgcgccacctcggtcggggcacgacgcacgcccgtggctcgctggacgaggctactccgacgtgcgtgctgcggcgggctggacgaggcgacatgnnnnnnnnnn

SEQ ID NO: 254710 - DNA, 627 bp, Homo sapiens
  misc_feature: GYAE6OF01AWBRU.30.45.E01.1.454.CMB.1.raw
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
  modified_base (448)..(448): a, c, t, g, unknown or other
  misc_feature (448)..(448): n is a, c, g, or t
  modified_base (466)..(466): a, c, t, g, unknown or other
  misc_feature (466)..(466): n is a, c, g, or t
  modified_base (582)..(582): a, c, t, g, unknown or other
  misc_feature (582)..(582): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (593)..(593): a, c, t, g, unknown or other
  misc_feature (593)..(593): n is a, c, g, or t
  modified_base (595)..(597): a, c, t, g, unknown or other
  misc_feature (595)..(597): n is a, c, g, or t
  modified_base (599)..(600): a, c, t, g, unknown or other
  misc_feature (599)..(600): n is a, c, g, or t
  modified_base (602)..(627): a, c, t, g, unknown or other
  misc_feature (602)..(627): n is a, c, g, or t
tcagcacgctacgtcacgaccggtgctcgatttagtgagtcagtaagggaagggggcgtgggagtgggatttcatatattagtgctggtgctactaccatgaagtacgcagactctgtggagggcgattcacatttcgaggacgacgccaaagaaatcagtatatactaacaaatgaagtagcctagagaggacgtaggacnccggtntggtgttaattactggtgggcgggggtccgggacgccaccggtacggaacccaccctacgaccaaagtacgtaaccggtgggggaccaccggtaaccgcggttccggccctactcccgttcacggtacccctaccgaacccggaacgggccccaagtttccccgggtccttaccccccggtgcccctaaaccctcccgtacgaaacggtcgacccctaaccggttcgccgggggtactancgacccgacggtccccgnggggtaccgcctcccggtaagggtacccaaaggggaccctttacgtccccggtaagtaacgggcccggtttcgagtcggtaacggcggtacgcgggtacgaggccggtgacgtagngcgtgncngcncnnncnngnnnnnnnnnnnnnnnnnnnnnnnnnn

SEQ ID NO: 254711 - DNA, 507 bp, Homo sapiens
  misc_feature: GYAE6OF01CFYR4.30.45.E01.1.454.CMB.1.raw
  modified_base (478)..(478): a, c, t, g, unknown or other
  misc_feature (478)..(478): n is a, c, g, or t
  modified_base (481)..(507): a, c, t, g, unknown or other
  misc_feature (481)..(507): n is a, c, g, or t
tcagcacgctacgtcacgaccggtgctcgatttagtgagtcagtaagggaaggggctggagtggatttcatatattagtgctggtgctactaccatgaagtacgcagactctgtgagggccgattcaccatttccagggacgacgccaagaaatcagtatatctaacaaatgagtagcctgagagacgaggacacggctgtgtattactggtgcggggccggggagccacgtcggacccaccctacaccaagactacgtggggccgacgggaacccgtggtccgcccgtcctcctcacgcctcccaccgaacgggccccactccggtccttccccccgtggccacccctccctaccaacgacgcaccctcgtcgggggccacgagcacgcccgtgggctcgcctggtcgaacggactaccttcccacggtacgcgtcgcgtggacggccgggcgtggccgaaggccgcaagtaggcancgnnnnnnnnnnnnnnnnnnnnnnnnnnn

SEQ ID NO: 254712 - DNA, 164 bp, Homo sapiens
  misc_feature: GYAE6OF01AYY7F.30.45.E01.1.454.CMB.1.raw
  modified_base (153)..(164): a, c, t, g, unknown or other
  misc_feature (153)..(164): n is a, c, g, or t
tcagcacgctacgtcacgaccggtgctcgatttagtgagtcagtaagggaaagggaccaaggtggaaatcaaacgaactgtggctgcacatctgtcttcatcttcccgccatctgaactagtgcgattgaggcgggctggcaaggcgcatagnnnnnnnnnnnn

SEQ ID NO: 254713 - DNA, 493 bp, Homo sapiens
  misc_feature: GYAE6OF01BQ4FQ.30.45.E01.1.454.CMB.1.raw
  modified_base (475)..(493): a, c, t, g, unknown or other
  misc_feature (475)..(493): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactggtggcggggccggggagccacgtccggacccaccctaccaccaagacctacgtggggccgagggaaccctggtcgccgtctcctcacgcctccaccgacgggccccacgtccggtccttccccctcggcccacccctccctaccaacgacgccaccctcggtcgggggcaccgacgccgacgcccgtcgggctcgccgtcggtacgaacggtaccttacctccacggtagcgtcgctggcggcgggcgtcggcgaggcgcagtgnnnnnnnnnnnnnnnnnnn

SEQ ID NO: 254714 - DNA, 449 bp, Homo sapiens
  misc_feature: GYAE6OF01EZU8Q.30.45.E01.1.454.CMB.1.raw
  modified_base (438)..(449): a, c, t, g, unknown or other
  misc_feature (438)..(449): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggcggggagccactcggaccaccctacaccaaagactacgtggggccagggaaccctggtccgcccgtctcctcagcctccaccaacggcccatcggtcttccccctggccaccctccctccaagacgcacctcgtggggcacacgcacgccctgggctgcctggtcaaggtactactccacggtagcgtgctgaggcgggcgtggacgaaggcgcagtacgnnnnnnnnnnnn

SEQ ID NO: 254715 - DNA, 570 bp, Homo sapiens
  misc_feature: GYAE6OF01DECWW.30.45.E01.1.454.CMB.1.raw
  modified_base (258)..(258): a, c, t, g, unknown or other
  misc_feature (258)..(258): n is a, c, g, or t
  modified_base (540)..(540): a, c, t, g, unknown or other
  misc_feature (540)..(540): n is a, c, g, or t
  modified_base (542)..(570): a, c, t, g, unknown or other
  misc_feature (542)..(570): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacgctgtgtattactgtgcggggccggggagcccactccggaccaccctacaccaagaactacgnggggaccaacgggaacccgtggtccgccgtcctcctccacgccctcccaaccgaacgggcccctagtccggttcccttcccccgtcggcccacccctcctacccaaacgacgcccaccgtccggtcgggggacaccgacgccacgtccccggtcgggccgtccggtccgtacggtaccgaaacggtaccccttacccgtttacccgaaccgttacggtacccggtcggtaccggtacgggtacggaccggggtcgtacgggacggaaacgggcacgaatgcngnnnnnnnnnnnnnnnnnnnnnnnnnnnnn

SEQ ID NO: 254716 - DNA, 544 bp, Homo sapiens
  misc_feature: GYAE6OF01CVI4S.30.45.E01.1.454.CMB.1.raw
  modified_base (211)..(211): a, c, t, g, unknown or other
  misc_feature (211)..(211): n is a, c, g, or t
  modified_base (222)..(222): a, c, t, g, unknown or other
  misc_feature (222)..(222): n is a, c, g, or t
  modified_base (251)..(251): a, c, t, g, unknown or other
  misc_feature (251)..(251): n is a, c, g, or t
  modified_base (326)..(326): a, c, t, g, unknown or other
  misc_feature (326)..(326): n is a, c, g, or t
  modified_base (362)..(362): a, c, t, g, unknown or other
  misc_feature (362)..(362): n is a, c, g, or t
  modified_base (511)..(514): a, c, t, g, unknown or other
  misc_feature (511)..(514): n is a, c, g, or t
  modified_base (516)..(544): a, c, t, g, unknown or other
  misc_feature (516)..(544): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcacatttccagggacgacgccaaagaaatcagtatatctaacaaatgagtagcctgagagacgaggacacggctgtgtatactgngcgggcgggancacgtcgaccaccctacaccaagactagnggggaccaggacctggccgccgtctcctcacgccctccaaccgaacgggcccagttcccggtccctttcccccgnggccctacccctcccgtaccgaacgacgcctacccncggtgggggaccacgacggccgaaccgtcccgcggggtctcggccgttacggtacgaacggtacttacccgtaccgaacggttacgccggttcggctacgggacggggtccgggaccggtacggacggaaacgggtcgaacgaagaggnnnngnnnnnnnnnnnnnnnnnnnnnnnnnnnnn

SEQ ID NO: 254717 - DNA, 444 bp, Homo sapiens
  misc_feature: GYAE6OF01BQ2B4.30.45.E01.1.454.CMB.1.raw
  modified_base (225)..(225): a, c, t, g, unknown or other
  misc_feature (225)..(225): n is a, c, g, or t
  modified_base (436)..(444): a, c, t, g, unknown or other
  misc_feature (436)..(444): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccgggganccactcggaccaccctacaccaagactacgtggggccagggaaccctggtcgccgtctcctcagcctccaccaagggccccatcggtccttccccctggccaccctcctccaagacgcaccctcgtcgggggcacacgcacgcccgtggggctcgcctggtcaaggacctactccacgtagcgtgctgagcgggctggcaaggcgcatagnnnnnnnnn

SEQ ID NO: 254718 - DNA, 554 bp, Homo sapiens
  misc_feature: GYAE6OF01B5C9U.30.45.E01.1.454.CMB.1.raw
  modified_base (213)..(213): a, c, t, g, unknown or other
  misc_feature (213)..(213): n is a, c, g, or t
  modified_base (406)..(406): a, c, t, g, unknown or other
  misc_feature (406)..(406): n is a, c, g, or t
  modified_base (520)..(554): a, c, t, g, unknown or other
  misc_feature (520)..(554): n is a, c, g, or t
tcagcacgctacgtcacgaccggtgctcgatttagtgagtcagtaaggggaaggggctggagtggatttcatatattagtgctggtgctactaccatgaagtacgcagactctgtggaggggccgattcaccatttccagggacgacgccaaagaaatcagtatatctaacaaatgagtagcctgagagacgaggacacggctgtgtattacnggtggcggggcggggagccgacgtccggacccaccctacaaccgaaagactacgtcgggggccaacggggtaaccctcggtccgccgtcctcctcgacgtcccaccaccgaacgggcccacgtccggttccctacccccgtcgccctacccctcccgtacgaacgacgccacccgttcggccggggaccacgngaccacgcccgtcggccgtacgcgtacggacgaacggtactacctaccgtacggtacgcgtacgccgttaggacggtcgggacgtacggacgaacgggcctgaacgtgcagtgnnnnnnnnnnnnnnnnnnnnnnnnnnnnnnnnnnn

SEQ ID NO: 254719 - DNA, 540 bp, Homo sapiens
  misc_feature: GYAE6OF01B2JOW.30.45.E01.1.454.CMB.1.raw
  modified_base (231)..(231): a, c, t, g, unknown or other
  misc_feature (231)..(231): n is a, c, g, or t
  modified_base (264)..(264): a, c, t, g, unknown or other
  misc_feature (264)..(264): n is a, c, g, or t
  modified_base (504)..(504): a, c, t, g, unknown or other
  misc_feature (504)..(504): n is a, c, g, or t
  modified_base (508)..(540): a, c, t, g, unknown or other
  misc_feature (508)..(540): n is a, c, g, or t
tcagcacgctacgtcacgaccggtgctcgatttagtgagtcagtaaggggaagggggctggagtggatttcatatattagtgctggtgctactaccatgaagtacgcagactctgtggaggggccgattcaccatttccaggggacgacgccaagaaatcagtatatctacaaatgagtagcctgagagacgaggacacgggctgtgtattactgtggcggggccgggganccacgtcggacccaccctacaccaagactacgnggggccgagggaaccctggtccgcccgtctccctcacgccctaccaccgaacgggccccagtccggtcccttcccccgtcggcccacccctccctaccgaacgcgtcccacccgtcggtacgggggcacgacgccgaccggcccgtgggcgtcgtccgtaggtacgacggtaccttacctaccgacggtacggcggtcgtcgtcggacggcgggcgtcgggacgacggccgatacgtagntgcnnnnnnnnnnnnnnnnnnnnnnnnnnnnnnnnn

SEQ ID NO: 254720 - DNA, 596 bp, Homo sapiens
  misc_feature: GYAE6OF01CBVBH.30.45.E01.1.454.CMB.1.raw
  modified_base (215)..(215): a, c, t, g, unknown or other
  misc_feature (215)..(215): n is a, c, g, or t
  modified_base (234)..(234): a, c, t, g, unknown or other
  misc_feature (234)..(234): n is a, c, g, or t
  modified_base (270)..(270): a, c, t, g, unknown or other
  misc_feature (270)..(270): n is a, c, g, or t
  modified_base (559)..(559): a, c, t, g, unknown or other
  misc_feature (559)..(559): n is a, c, g, or t
  modified_base (561)..(596): a, c, t, g, unknown or other
  misc_feature (561)..(596): n is a, c, g, or t
tcagcacgctacgtcacgaccggtgctcgatttagtgagtcagtaagggaagggggctggagtggatttcatatattagtgctggtgctactaccatgaagtacgcagactctgtggaggggccgattcactattccgagggacgacgccaagaaatcagtatatctaacaaatgagtagcctgagaggacgaggacacggctgtagtattacgngtcggcgggggccgggganccacgtcggaacccaccctacaccgaagactacggnggggccaacgggacctggtccgccgtctcctcacgccctaccgaccgaacgggcctagtccggtaccctccccgtggacccaccctaccctaccgaagaccgcctacccgtgggtccggggaccaccgacggtccgaccggtcccggtacgggcgtccgtaccgttcgggaaccgtaaaccgggtcccttaaccctttcccgtccgttacccgtccgtaacccgttcggtaccgggacggggccgggtacggtaccggggacggtaacgggccgtaacgaagttaggcngnnnnnnnnnnnnnnnnnnnnnnnnnnnnnnnnnnnn

SEQ ID NO: 254721 - DNA, 493 bp, Homo sapiens
  misc_feature: GYAE6OF01EZK35.30.45.E01.1.454.CMB.1.raw
  modified_base (325)..(325): a, c, t, g, unknown or other
  misc_feature (325)..(325): n is a, c, g, or t
  modified_base (467)..(468): a, c, t, g, unknown or other
  misc_feature (467)..(468): n is a, c, g, or t
  modified_base (470)..(493): a, c, t, g, unknown or other
  misc_feature (470)..(493): n is a, c, g, or t
tcagcacgctacgtcacgaccggtgctcgatttagtgagtcagtaagggaaggggctggagtggatttcatatattagtgctggtgctactaccatgaagtacgcagactctgtggaggggccgattcaccatttccaggggacgacgccaagaaatcagtatatctacaaatgagtagcctgagagacgaggacacggctgtgtattactgtggcggggccggggagccactcggacccaccctacaccaagactacgtggggccagggaaccctggtcgcccgtctcctcagcctccaccaggccccatcggtccttcccccnggccacccctccctaccaacgacgccacctcgtgggggcacacgcacgcccgtgggctcgcctggtccaaggacctacttcccacggtacgcgtcggcctggacggccggggcgtcgggacgtaacgggcgcgtacgtaggnngnnnnnnnnnnnnnnnnnnnnnnnn

SEQ ID NO: 254722 - DNA, 583 bp, Homo sapiens
  misc_feature: GYAE6OF01DH7WX.30.45.E01.1.454.CMB.1.raw
  modified_base (230)..(230): a, c, t, g, unknown or other
  misc_feature (230)..(230): n is a, c, g, or t
  modified_base (557)..(583): a, c, t, g, unknown or other
  misc_feature (557)..(583): n is a, c, g, or t
tcagcacgctacgtcacgaccggtgctcgatttagtgagtcagtaagggaaggggctggagtggatttcatatattagtgctggtgctactaccatgaagtacgcagactctgtggaggggccattcacatttccagggacgacgccaagaaatcagtatatctaacaaatgagtagcctgagagacgaggacacggctgtgtattacgtggtggccgggggccgggganccaacgtccggacccacccgtacaacccaaaggacctacgtggggccgaacgggaaccctggtccgcccgttcctcctcacgccctacccaaccgaacgggccccctagttccgggtcccctttccccctcgggcccacccctccctaccaaagacgaccctacccgttcggcgggggaccacgagaccgcggcccgtgggcctcggccgtacgggtacgaacggtaacctacctttacccgaacggttaacggcggtttcgccgggttacggaacgggccgggggtaccgttacggggaccgaaacggggccgacgtaagtagcgnnnnnnnnnnnnnnnnnnnnnnnnnnn

SEQ ID NO: 254723 - DNA, 652 bp, Homo sapiens
  misc_feature: GYAE6OF01D4HBV.30.45.E01.1.454.CMB.1.raw
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
  modified_base (615)..(615): a, c, t, g, unknown or other
  misc_feature (615)..(615): n is a, c, g, or t
  modified_base (617)..(618): a, c, t, g, unknown or other
  misc_feature (617)..(618): n is a, c, g, or t
  modified_base (620)..(652): a, c, t, g, unknown or other
  misc_feature (620)..(652): n is a, c, g, or t
tcagcacgctacgtcacgaccggtgctcgatttagtgagtcagtaaggggaaaggggctgggagtggatttcatatattagtgctggtgctactaccatgaagtacgcagactctgtggagggccattccactatttccgagggacgacgcaaagaaatcagtatatctacaaatgagtagctgagagacgaggacacggntgtgttattacgtggcgggcggggccggggacnccaccgtccggaaccaccctacaacaagtaccgtacggtcggggaccgaacgggtacccgtggtcccgccgttcctcctaccgaccgcccctacccgaaccggaaccgggccccttaacggtttccccgggtttacccccttcccccggtcggtacccccctaccccttacccgaacccgaaacggtacgccccgtaacccggttcgggcgggggaaccacgtacggccgaccggtccggtcgggtcctcggtccggtacggtaaccgaaacgtttcccctaccgtttacccgtaaggtccgtacctaaccggtttcgtcggggaacccggggttccggggcgggtaccggtaaccgggacggaccccgtagaaggtgcancnngnnnnnnnnnnnnnnnnnnnnnnnnnnnnnnnnn

SEQ ID NO: 254724 - DNA, 533 bp, Homo sapiens
  misc_feature: GYAE6OF01B28AH.30.45.E01.1.454.CMB.1.raw
  modified_base (229)..(229): a, c, t, g, unknown or other
  misc_feature (229)..(229): n is a, c, g, or t
  modified_base (500)..(533): a, c, t, g, unknown or other
  misc_feature (500)..(533): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaaagaaatcagtatatctacaaatgagtagcctgagagacgaggacacggctgtgtattacgtggtggcggggccggggancccacgtccggacccacccctacaccgaagactacgtcgggggaccgacgggaacccgtggtccgcccgtctcctcacgccctccaccgaacgggccccacgtccggtccttcccccgtcgggccctacccctcctaccgaagcgccacctcggtcggggcacgcgcacgccggtgggcgtcgccgtcggtacgaaggtacctaccgtccgacggtacggtccgtgcgtggacgggccgggcgtcgggacgaacgggccgacgagtagcgnnnnnnnnnnnnnnnnnnnnnnnnnnnnnnnnnn

SEQ ID NO: 254725 - DNA, 493 bp, Homo sapiens
  misc_feature: GYAE6OF01DKFJI.30.45.E01.1.454.CMB.1.raw
  modified_base (335)..(335): a, c, t, g, unknown or other
  misc_feature (335)..(335): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
  modified_base (455)..(493): a, c, t, g, unknown or other
  misc_feature (455)..(493): n is a, c, g, or t
tcagcacgctacgtcacgaccggtgctcgatttagtgagtcagtaagggaagggggctggagtggatttcatatattagtgctggtgctactaccatgaaagtacgcagactctgtggaggggccgattcacatttccaggggacacgccaaagaaatcagtatatctaacaaaatgagtagcctgagagacgaaggacacggctgtgtatactgtggcggggcgggagccacgtcggaccaccctacaaccaagactacgtcggggaccaacgggtaccctggtccgccgtcctcctcacgcctaccaacgaacggcccagtccgtccttcccngccaccctccacaagcnctaccngtcgggacacngacncgccgtggctcgctggtacaacgtctactcgaacgtgcgtcgcgtaggcggccgggtacgtggacgacggcgaacgagtagnnnnnnnnnnnnnnnnnnnnnnnnnnnnnnnnnnnnnnn

SEQ ID NO: 254726 - DNA, 528 bp, Homo sapiens
  misc_feature: GYAE6OF01EYZN6.30.45.E01.1.454.CMB.1.raw
  modified_base (227)..(227): a, c, t, g, unknown or other
  misc_feature (227)..(227): n is a, c, g, or t
  modified_base (493)..(493): a, c, t, g, unknown or other
  misc_feature (493)..(493): n is a, c, g, or t
  modified_base (497)..(500): a, c, t, g, unknown or other
  misc_feature (497)..(500): n is a, c, g, or t
  modified_base (502)..(528): a, c, t, g, unknown or other
  misc_feature (502)..(528): n is a, c, g, or t
tcagcacgctacgtcacgaccggtgctcgatttagtgagtcagtaagggaagggggcgtggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccgggganccactcggacccaccctacaccaagactacgtggggccgagggaaccctggtcgccgtctcctcagcctccaccagggcccatcggtccttcccccgtggccacccctcctccaacgagccaccctcggtcgggggaccacgacgccgaacgccccgtggggtcctcggaccgttgggtaccaaagggtaccttaccttcccgaacggttacgccggttcgcgttaggacggtccggggctcgggacgaacgggcgacgagtaggntcgnnnngnnnnnnnnnnnnnnnnnnnnnnnnnnn

SEQ ID NO: 254727 - DNA, 541 bp, Homo sapiens
  misc_feature: GYAE6OF01DNCAQ.30.45.E01.1.454.CMB.1.raw
  modified_base (227)..(227): a, c, t, g, unknown or other
  misc_feature (227)..(227): n is a, c, g, or t
  modified_base (295)..(295): a, c, t, g, unknown or other
  misc_feature (295)..(295): n is a, c, g, or t
  modified_base (507)..(507): a, c, t, g, unknown or other
  misc_feature (507)..(507): n is a, c, g, or t
  modified_base (509)..(541): a, c, t, g, unknown or other
  misc_feature (509)..(541): n is a, c, g, or t
tcagcacgctacgtcacgaccggtgctcgatttagtgagtcagtaagggaaaggggctggagtggatttcatatattagtgctggtgctactaccatgaagtacgcagactctgtggaggggccgattcacctatttccaggggcacgccaaagaaatcagtatatctacaaatgagtagcctgagagacgaggacaggctgtgtatacgtgtggcgggcggggacnccactcggacccaccctacaccaagactacgcggggaccgacggaccctggtccgccgtcctcctacncgccctccaccgacgggcccctagtccggtcccttcccccgtggccctaccccgtccctaccaacggtacgcctacccgtcggtcggggacacgacgcacggccgtgggctcgtccgtggtaacgtaacggtaccttaccgttcctcctccgtaccgtacgtcgtcggacggccgggtacgtccgggtaacgaacgggtccgacgtaagcgngnnnnnnnnnnnnnnnnnnnnnnnnnnnnnnnnn

SEQ ID NO: 254728 - DNA, 482 bp, Homo sapiens
  misc_feature: GYAE6OF01DTSMQ.30.45.E01.1.454.CMB.1.raw
  modified_base (177)..(177): a, c, t, g, unknown or other
  misc_feature (177)..(177): n is a, c, g, or t
  modified_base (205)..(205): a, c, t, g, unknown or other
  misc_feature (205)..(205): n is a, c, g, or t
  modified_base (209)..(209): a, c, t, g, unknown or other
  misc_feature (209)..(209): n is a, c, g, or t
  modified_base (213)..(213): a, c, t, g, unknown or other
  misc_feature (213)..(213): n is a, c, g, or t
  modified_base (236)..(236): a, c, t, g, unknown or other
  misc_feature (236)..(236): n is a, c, g, or t
  modified_base (240)..(240): a, c, t, g, unknown or other
  misc_feature (240)..(240): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
  modified_base (350)..(350): a, c, t, g, unknown or other
  misc_feature (350)..(350): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (375)..(375): a, c, t, g, unknown or other
  misc_feature (375)..(375): n is a, c, g, or t
  modified_base (381)..(381): a, c, t, g, unknown or other
  misc_feature (381)..(381): n is a, c, g, or t
  modified_base (449)..(454): a, c, t, g, unknown or other
  misc_feature (449)..(454): n is a, c, g, or t
  modified_base (456)..(482): a, c, t, g, unknown or other
  misc_feature (456)..(482): n is a, c, g, or t
tcagcacgctacgtcacgaccggtgctcgatttagtgagtcagtaaggggaaggggctgggagtggatttcatatattagtgctggtgctacctaccatgaagtacgcagactctgtggagggccgattcactatttccgagggacgacgaccgaaagaaatcaagtatatactaanaaagtgagtagcctgagagacgaggacncggntgtntatactgtggccggggacggggncccncgtccgaccaccctacacgaagactagcgggacgacggaccgtgccgcgtcacctnacnccaccaacgacggccatccggtcctccccngccaccctccacaacggnacnccgtgtcggcaacgcgngaccncgngggacngtccgtgacgaacggtctacgtcagtagccgtgctaggacggtcggagtcgggacgagcgtacagtgnnnnnngnnnnnnnnnnnnnnnnnnnnnnnnnnn

SEQ ID NO: 254729 - DNA, 542 bp, Homo sapiens
  misc_feature: GYAE6OF01CGE2K.30.45.E01.1.454.CMB.1.raw
  modified_base (504)..(504): a, c, t, g, unknown or other
  misc_feature (504)..(504): n is a, c, g, or t
  modified_base (507)..(515): a, c, t, g, unknown or other
  misc_feature (507)..(515): n is a, c, g, or t
  modified_base (517)..(521): a, c, t, g, unknown or other
  misc_feature (517)..(521): n is a, c, g, or t
  modified_base (523)..(527): a, c, t, g, unknown or other
  misc_feature (523)..(527): n is a, c, g, or t
  modified_base (529)..(542): a, c, t, g, unknown or other
  misc_feature (529)..(542): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtggcgggccgggggagccactcggacccaccctacactcaagactacgtggggccaacgggaccctggtcgccgtctcctcagcctccaccgacgggcccatccggtccttcccccgtcggccaccccttccctaccgaacgacgccaccctcgtcggggggaccacgacgccacggcccgtggggcctcgccgtggtaccgaacggtacctacttaccgacggtaacgcgtacgcgttggacggtcggggtaccgtcggggcccgaaagggccggacgtaatacgggcatcgngannnnnnnnnannnnngnnnnngnnnnnnnnnnnnnn

SEQ ID NO: 254730 - DNA, 495 bp, Homo sapiens
  misc_feature: GYAE6OF01EKXSF.30.45.E01.1.454.CMB.1.raw
  modified_base (226)..(226): a, c, t, g, unknown or other
  misc_feature (226)..(226): n is a, c, g, or t
  modified_base (359)..(359): a, c, t, g, unknown or other
  misc_feature (359)..(359): n is a, c, g, or t
  modified_base (477)..(495): a, c, t, g, unknown or other
  misc_feature (477)..(495): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtggcggggccgggganccacgtccggaccaccctacaccaagacctacgtggggccgagggaacccctggtccgcccgtctccctcacgccctccaccgaacgggccccagtccggtccttccccccctggccacccctcctccaacgngccacctcgtgggggccacgagcacgcccgtgggcctgccgtcggtacgaacggtactaccttccgacgtacgcgttcgcgtggacggccgggcgtaggacgaaggcgactagtacgnnnnnnnnnnnnnnnnnnn

SEQ ID NO: 254731 - DNA, 486 bp, Homo sapiens
  misc_feature: GYAE6OF01AFHZ0.30.45.E01.1.454.CMB.1.raw
  modified_base (190)..(190): a, c, t, g, unknown or other
  misc_feature (190)..(190): n is a, c, g, or t
  modified_base (255)..(255): a, c, t, g, unknown or other
  misc_feature (255)..(255): n is a, c, g, or t
  modified_base (344)..(344): a, c, t, g, unknown or other
  misc_feature (344)..(344): n is a, c, g, or t
  modified_base (371)..(371): a, c, t, g, unknown or other
  misc_feature (371)..(371): n is a, c, g, or t
  modified_base (455)..(455): a, c, t, g, unknown or other
  misc_feature (455)..(455): n is a, c, g, or t
  modified_base (457)..(486): a, c, t, g, unknown or other
  misc_feature (457)..(486): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccgattcaccatttccagggacgacgccaagaaatcagtatatctacaaatgagtagcctgagagacgnggacacgctgtgtattactgtgcgggccggggagccactcggaccaccctacaccaagactacgnggggccagggaaccctggtccgccgtctcctcagccctccaccgaacgggccacgtccggtccttccccgtcgccacccctctccagcnccacctcgtggggcacagcacgcccgnggctcgcgtgtacgaacgtactacttccaacggtcgcgtagtcgaggtacgggccgggtcgtggcgaacggcgtacgactaggncnnnnnnnnnnnnnnnnnnnnnnnnnnnnnn

SEQ ID NO: 254732 - DNA, 530 bp, Homo sapiens
  misc_feature: GYAE6OF01AJSJR.30.45.E01.1.454.CMB.1.raw
  modified_base (344)..(344): a, c, t, g, unknown or other
  misc_feature (344)..(344): n is a, c, g, or t
  modified_base (356)..(356): a, c, t, g, unknown or other
  misc_feature (356)..(356): n is a, c, g, or t
  modified_base (375)..(375): a, c, t, g, unknown or other
  misc_feature (375)..(375): n is a, c, g, or t
  modified_base (378)..(378): a, c, t, g, unknown or other
  misc_feature (378)..(378): n is a, c, g, or t
  modified_base (391)..(391): a, c, t, g, unknown or other
  misc_feature (391)..(391): n is a, c, g, or t
  modified_base (492)..(492): a, c, t, g, unknown or other
  misc_feature (492)..(492): n is a, c, g, or t
  modified_base (495)..(500): a, c, t, g, unknown or other
  misc_feature (495)..(500): n is a, c, g, or t
  modified_base (503)..(504): a, c, t, g, unknown or other
  misc_feature (503)..(504): n is a, c, g, or t
  modified_base (506)..(530): a, c, t, g, unknown or other
  misc_feature (506)..(530): n is a, c, g, or t
tcagcacgctacgtcacgaccggtgctcgatttagtgagtcagtaagggaaggggcgtggagtgggatttcatatattagtgctggtgctactaccatgaagtacacagactctgtgaggggccgattcacattcgagggacgacgccaagaaatccagtatatctaacaaatgaggtagcctgagagacgaggacacggctggttgtattactggtcggccgggggtcggggacgcctacgtccgggacccaccctaccacaagactacggtggggccgacggaaccgtcggtcgccgtctctcacgccctcaccgacggacctacgtccggtccttcccccnggaccctccccncctacccgtaacgacgccnccncggtcggggcacngccgacgccgacgggctcggcgtcggacgacgactaccttcgacgaggtcggtcgtcgtggacgggcggccgtgggtacgacgggcgtcggaactggcacngtnnnnnntanngnnnnnnnnnnnnnnnnnnnnnnnnn

SEQ ID NO: 254733 - DNA, 519 bp, Homo sapiens
  misc_feature: GYAE6OF01COOJ1.30.45.E01.1.454.CMB.1.raw
  modified_base (225)..(225): a, c, t, g, unknown or other
  misc_feature (225)..(225): n is a, c, g, or t
  modified_base (446)..(446): a, c, t, g, unknown or other
  misc_feature (446)..(446): n is a, c, g, or t
  modified_base (491)..(491): a, c, t, g, unknown or other
  misc_feature (491)..(491): n is a, c, g, or t
  modified_base (494)..(519): a, c, t, g, unknown or other
  misc_feature (494)..(519): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaaagaaatcagtatatctaacaaatgagtagcctgagagacgaggacacggctgtgtattactgtgcgggcgggganccactcggaccaccgtacaccaagactacgtcgggccagggaaccctggtccgccgtctcctcacgccctaccaccgacgggcccacgtccggtcccttcccccgtcggccctaccccttccctaccaacgtacgccacccgttccggcgggggccaaccagccgtacgccccgtcgggtctcggccgttacggaccgaaaggtcccttacttccctcctntaccgactcgtcggacgggccgggtactgggacacggcgacgtancgnnnnnnnnnnnnnnnnnnnnnnnnnn

SEQ ID NO: 254734 - DNA, 526 bp, Homo sapiens
  misc_feature: GYAE6OF01D0GRU.30.45.E01.1.454.CMB.1.raw
  modified_base (236)..(236): a, c, t, g, unknown or other
  misc_feature (236)..(236): n is a, c, g, or t
  modified_base (313)..(313): a, c, t, g, unknown or other
  misc_feature (313)..(313): n is a, c, g, or t
  modified_base (482)..(482): a, c, t, g, unknown or other
  misc_feature (482)..(482): n is a, c, g, or t
  modified_base (497)..(497): a, c, t, g, unknown or other
  misc_feature (497)..(497): n is a, c, g, or t
  modified_base (501)..(526): a, c, t, g, unknown or other
  misc_feature (501)..(526): n is a, c, g, or t
tcagcacgctacgtcacgaccggtgctcgatttagtgagtcagtaagggaaggggctggagtggatttcatatattagtgctggtgctactaccatgaagtacgcagactctgtggaggggccgattcaccatttccgagggacgacgccaaagaaatcagtatatctaacaaatgaagtacgcctgagagacggaggacacggctgtgtattacgtggtggcggggccggggacnccacgtccggacccaccctacacccacgacgtacgtcggggaccgacgggaacccgtggccgccgtctcccgtcacnccctaccaaccgacgggccccacgtccggttcccttccccgcgcccaccccttccaccaacgcgccaccgtacggtcggggccaacgcgcgaccgccggtaggtctcgccgtcggtacgaacgtacctccgttaccgtcggtacgcggttcgcgtaggcggtcgggtcnggacggaaggcgtanatgnnnnnnnnnnnnnnnnnnnnnnnnnn

SEQ ID NO: 254735 - DNA, 579 bp, Homo sapiens
  misc_feature: GYAE6OF01CGFMW.30.45.E01.1.454.CMB.1.raw
  modified_base (492)..(492): a, c, t, g, unknown or other
  misc_feature (492)..(492): n is a, c, g, or t
  modified_base (509)..(509): a, c, t, g, unknown or other
  misc_feature (509)..(509): n is a, c, g, or t
  modified_base (543)..(543): a, c, t, g, unknown or other
  misc_feature (543)..(543): n is a, c, g, or t
  modified_base (545)..(546): a, c, t, g, unknown or other
  misc_feature (545)..(546): n is a, c, g, or t
  modified_base (549)..(549): a, c, t, g, unknown or other
  misc_feature (549)..(549): n is a, c, g, or t
  modified_base (551)..(579): a, c, t, g, unknown or other
  misc_feature (551)..(579): n is a, c, g, or t
tcagcacgctacgtcacgaccggtgctcgatttagtgagtcagtaagggaaggggctggagtggatttcatatattagtgctggtgctactaccatgaagtacgcagactctgtggaggggccgattcacctatttccgagggacacgccaagaaatcagtatatactaacaaatgagtagcctgagagacggaggacgacggctgtgtattacgtggtcggccggggcgggacgccgacgtcggaacccacctaacaccgaagactacggtcggggaccgacgggacccgtcggtccgtccgtcctccacgaccgtccctccgaacccggacggccccacgttccggttccccttcccccggtcgccctacccctccctacgaacgtaccgcctaccgtcggtcggggcaccgacgaccgccgccgtggggcctacgccggtagtaaccgaacggttactacccttacggaacgtcggtacgtcgttcggnggtacgggcgggtacgnggtaaccgacgggctacgagtacggctggcagcngnngancnnnnnnnnnnnnnnnnnnnnnnnnnnnnn

SEQ ID NO: 254736 - DNA, 553 bp, Homo sapiens
  misc_feature: GYAE6OF01ELA0S.30.45.E01.1.454.CMB.1.raw
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (247)..(247): a, c, t, g, unknown or other
  misc_feature (247)..(247): n is a, c, g, or t
  modified_base (514)..(516): a, c, t, g, unknown or other
  misc_feature (514)..(516): n is a, c, g, or t
  modified_base (518)..(519): a, c, t, g, unknown or other
  misc_feature (518)..(519): n is a, c, g, or t
  modified_base (521)..(527): a, c, t, g, unknown or other
  misc_feature (521)..(527): n is a, c, g, or t
  modified_base (529)..(553): a, c, t, g, unknown or other
  misc_feature (529)..(553): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccattcacatttccagggacgacgccaagaaatcagtatatctacaaatgatagcctgagagacgagacacgctgtgtattangtgcgggcggganccacgtcgacccaccctcaccaagactacgngggccacggaacctggtcgtcccgtctccctcacgtccctacccaccgaacgggccctatctacgttcccttccccccgtcggccctacccctccctacctaacgcgaccacccgtcggtcgggggaccacgacggaccgaccgcccggtcgggccgtcggcccgtgggtaacaacggtaccgttaccttccctccttcctaccgtaacgtcgtacggacgggcccgggtcgtacgggtaccggaacgggcgtacgtaagtacgtannncnncnnnnnnntnnnnnnnnnnnnnnnnnnnnnnnnn

SEQ ID NO: 254737 - DNA, 587 bp, Homo sapiens
  misc_feature: GYAE6OF01CCV5F.30.45.E01.1.454.CMB.1.raw
  modified_base (551)..(551): a, c, t, g, unknown or other
  misc_feature (551)..(551): n is a, c, g, or t
  modified_base (553)..(587): a, c, t, g, unknown or other
  misc_feature (553)..(587): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctaacaaatgagtagcctgagagacgaggacacggctgtgtattactggtggcggggccggggagccacgtccggaccaccctacaccaagactacgtcggggccgacgggaccctggtccgccggtcctcctcacgtccctccaccgaaccgggccccacgtccggtcccttcccccgtcggccccaccccgtccctacccgaaacggtccgaccgtacccgttcgggtcggggaccaccgacgtaccgacggtaccccggtcgggtctcggttacgtacgggtaccgtaacggtaccttaccgttaccccgtaacggtacggccggttcgtccgtaggaccggggttccggggccggtcggaccgaacggggcctacgagtaacgncnnnnnnnnnnnnnnnnnnnnnnnnnnnnnnnnnnn

SEQ ID NO: 254738 - DNA, 550 bp, Homo sapiens
  misc_feature: GYAE6OF01CN61K.30.45.E01.1.454.CMB.1.raw
  modified_base (201)..(201): a, c, t, g, unknown or other
  misc_feature (201)..(201): n is a, c, g, or t
  modified_base (516)..(516): a, c, t, g, unknown or other
  misc_feature (516)..(516): n is a, c, g, or t
  modified_base (518)..(550): a, c, t, g, unknown or other
  misc_feature (518)..(550): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacacgccaagaaatcagtatatctaacaaatgagtagcctgagagacgaggcacggctgtntattactggtgcggggccggggagccacgtccggaccaccctacaaccaagactacgcggggccacgggaccctggtccgccgtcctccgtcacgccctaccaaccgacgggccccacgtccgtcccttcccccgtggccctacccctcctacccgaagcgaccgtacccgtcggtcggggaccacgacgaccaccggcccgtggggtcctcggtacccgtggtaaccgaacggtaacctaccgttaccgtacggtacgtcggtacgcgtcggacggtccggggcgtgggaaccgtaacggcgaatacgtgagcngnnnnnnnnnnnnnnnnnnnnnnnnnnnnnnnnn

SEQ ID NO: 254739 - DNA, 474 bp, Homo sapiens
  misc_feature: GYAE6OF01DJMOF.30.45.E01.1.454.CMB.1.raw
  modified_base (118)..(118): a, c, t, g, unknown or other
  misc_feature (118)..(118): n is a, c, g, or t
  modified_base (184)..(184): a, c, t, g, unknown or other
  misc_feature (184)..(184): n is a, c, g, or t
  modified_base (200)..(200): a, c, t, g, unknown or other
  misc_feature (200)..(200): n is a, c, g, or t
  modified_base (321)..(321): a, c, t, g, unknown or other
  misc_feature (321)..(321): n is a, c, g, or t
  modified_base (327)..(327): a, c, t, g, unknown or other
  misc_feature (327)..(327): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (349)..(349): a, c, t, g, unknown or other
  misc_feature (349)..(349): n is a, c, g, or t
  modified_base (352)..(353): a, c, t, g, unknown or other
  misc_feature (352)..(353): n is a, c, g, or t
  modified_base (361)..(361): a, c, t, g, unknown or other
  misc_feature (361)..(361): n is a, c, g, or t
  modified_base (430)..(430): a, c, t, g, unknown or other
  misc_feature (430)..(430): n is a, c, g, or t
  modified_base (437)..(438): a, c, t, g, unknown or other
  misc_feature (437)..(438): n is a, c, g, or t
  modified_base (440)..(441): a, c, t, g, unknown or other
  misc_feature (440)..(441): n is a, c, g, or t
  modified_base (444)..(446): a, c, t, g, unknown or other
  misc_feature (444)..(446): n is a, c, g, or t
  modified_base (448)..(448): a, c, t, g, unknown or other
  misc_feature (448)..(448): n is a, c, g, or t
  modified_base (450)..(450): a, c, t, g, unknown or other
  misc_feature (450)..(450): n is a, c, g, or t
  modified_base (452)..(452): a, c, t, g, unknown or other
  misc_feature (452)..(452): n is a, c, g, or t
  modified_base (455)..(466): a, c, t, g, unknown or other
  misc_feature (455)..(466): n is a, c, g, or t
  modified_base (468)..(473): a, c, t, g, unknown or other
  misc_feature (468)..(473): n is a, c, g, or t
tcagcacgctacgtcacgaccggtgctcgatttagtgagtcagtaagggaaggggctggagtggatttcatatatttagtgctggtgctactaccattgaagtacgcagactctgtgnggggccaattcacctatttccaggacacgccaagaatcagtatatctaacaaatgagtagcctganagacgaggccacggcngtgtattactggtgccggggtccgggagcccagtcggacccaccctacaccgaagctacgtggggaccaagggaccctaggtcgcgtctcctcagcctcaccaagcccgatcggtctcccngcaccnccnccagncactctggggcacntcnncctggctncctgcaggctacttctctctcggactccgtgacgcgggtcgtgacgaagcgactaagtcagcgatacgngcagctnncnngannnancncncgnnnnnnnnnnnncnnnnnnc

SEQ ID NO: 254740 - DNA, 564 bp, Homo sapiens
  misc_feature: GYAE6OF01ADHG8.30.45.E01.1.454.CMB.1.raw
  modified_base (203)..(203): a, c, t, g, unknown or other
  misc_feature (203)..(203): n is a, c, g, or t
  modified_base (210)..(210): a, c, t, g, unknown or other
  misc_feature (210)..(210): n is a, c, g, or t
  modified_base (225)..(225): a, c, t, g, unknown or other
  misc_feature (225)..(225): n is a, c, g, or t
  modified_base (282)..(282): a, c, t, g, unknown or other
  misc_feature (282)..(282): n is a, c, g, or t
  modified_base (439)..(439): a, c, t, g, unknown or other
  misc_feature (439)..(439): n is a, c, g, or t
  modified_base (525)..(525): a, c, t, g, unknown or other
  misc_feature (525)..(525): n is a, c, g, or t
  modified_base (531)..(531): a, c, t, g, unknown or other
  misc_feature (531)..(531): n is a, c, g, or t
  modified_base (533)..(564): a, c, t, g, unknown or other
  misc_feature (533)..(564): n is a, c, g, or t
tcagcacgctacgtcacgaccggtgctcgatttagtgagtcagtaagggaaggggctggagtggatttcatatattagtgctggtgctactaccatgaagtacgcagactctgtgagggccgattcactatttccagggacgacgccaaagaaactcgagtatatctaacaaatgagtagcctgagagagagacacggctgtntatacgngcggcggggcggganccacgtccggaaccaccctacaacaagacctacggtcggggaccgaacgggaacccnggtaccgcccgttcctcctcgacgccctaccaaccgaagggacccctaacgtccggttcccgtttccccccgaggtcccctaaccccgttcctacccgaaagtaccgacctaccttcgggacggggcctaagacgacgaaccgtccggtaccggggntccgccgtacggtaaccgaaggtacccttaacgtcccaaccggtgtccgtgcgtaggacggccgggtacgtggaacgaacggccanagtgcnannnnnnnnnnnnnnnnnnnnnnnnnnnnnnnn

SEQ ID NO: 254741 - DNA, 587 bp, Homo sapiens
  misc_feature: GYAE6OF01C51NQ.30.45.E01.1.454.CMB.1.raw
  modified_base (228)..(228): a, c, t, g, unknown or other
  misc_feature (228)..(228): n is a, c, g, or t
  modified_base (304)..(304): a, c, t, g, unknown or other
  misc_feature (304)..(304): n is a, c, g, or t
  modified_base (552)..(557): a, c, t, g, unknown or other
  misc_feature (552)..(557): n is a, c, g, or t
  modified_base (559)..(587): a, c, t, g, unknown or other
  misc_feature (559)..(587): n is a, c, g, or t
tcagcacgctacgtcacgaccggtgctcgatttagtgagtcagtaagggaaggggctggagtggatttcatatattagtgctggtgctactaccatgaagtacgcagactctgtggaggggccgattcaccatttccagggacgacgccaagaaatcagtatatctaacaaatgagtagcctgagagacgaggacacggctgtgtattactgtggcggggccgggganccacgtccggacccaccctacaccaagactacgtcggggccaacgggacccgtgggtccgccgttcctcctcgacnccctaccaccgaacgggcccctagttccggtccccttcccccgtggaccctacccccttaccctacccgaaacggaccgtacccgacccgttccggggtgggggtaccaaccgcgaccgaccggtccccgtggggccgtcgacccggttacgggtaccgaacggtacctacccgttacccgacggttacgacggtcgcgtagggacgggcgggtcgtgggacgaagggccgaactagtaggcagctgnnnnnngnnnnnnnnnnnnnnnnnnnnnnnnnnnnn

SEQ ID NO: 254742 - DNA, 554 bp, Homo sapiens
  misc_feature: GYAE6OF01BB5Y5.30.45.E01.1.454.CMB.1.raw
  modified_base (522)..(554): a, c, t, g, unknown or other
  misc_feature (522)..(554): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaaagaaatcagtatatctaacaaatgagtagcctgagagacgaggacacggctgtgtattactgtgcggggccggggagccactccggaccaccctacaccaagactacgtcggggaccgacgggaacccctggtccgccgtcctcctcacgccctccaccgaagggccccagtccggtccttcccccgtggccaccctccaccaagacgccaccctcggtcggggaccacgacgccgaccgcccggtgggtcctcggcccggttggtaccgaaacggtaacccgttacccgtttcccgtacggtaccgtccctacgttacgcggtacgggccggggtcgttacgggaccgaaggggccgaccgtaagtacggnnnnnnnnnnnnnnnnnnnnnnnnnnnnnnnnn

SEQ ID NO: 254743 - DNA, 164 bp, Homo sapiens
  misc_feature: GYAE6OF01D97IR.30.45.E01.1.454.CMB.1.raw
  modified_base (149)..(149): a, c, t, g, unknown or other
  misc_feature (149)..(149): n is a, c, g, or t
  modified_base (155)..(164): a, c, t, g, unknown or other
  misc_feature (155)..(164): n is a, c, g, or t
tcagcacgctacgtcacgaccggtgctcgatttagtgagtcagtaagggaaagggaccaaggtggaaatcaaacgaactgtggctgcaccatctgtcttcatcttccccaccctcctctactgctagtctgagcgggctggacaaggcncatagnnnnnnnnnn

SEQ ID NO: 254744 - DNA, 436 bp, Homo sapiens
  misc_feature: GYAE6OF01B0US5.30.45.E01.1.454.CMB.1.raw
  modified_base (424)..(436): a, c, t, g, unknown or other
  misc_feature (424)..(436): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgcccgtctcctcagcctccaccaagggccccatcggtcttccccctggccacccctcctccagagcacctctgggggcacagcagccctgggctgcctggtcaaggactacttcctctctcgactctgagcgggctggcaggcgcatagnnnnnnnnnnnnn

SEQ ID NO: 254745 - DNA, 612 bp, Homo sapiens
  misc_feature: GYAE6OF01CJC1H.30.45.E01.1.454.CMB.1.raw
  modified_base (199)..(199): a, c, t, g, unknown or other
  misc_feature (199)..(199): n is a, c, g, or t
  modified_base (569)..(569): a, c, t, g, unknown or other
  misc_feature (569)..(569): n is a, c, g, or t
  modified_base (579)..(579): a, c, t, g, unknown or other
  misc_feature (579)..(579): n is a, c, g, or t
  modified_base (581)..(585): a, c, t, g, unknown or other
  misc_feature (581)..(585): n is a, c, g, or t
  modified_base (587)..(612): a, c, t, g, unknown or other
  misc_feature (587)..(612): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccattcacctattccgagggacgacgccaagaaatcagtatatctaacaaatgagtagcctgagagacggagacacggntgtgtattacgtgtcggcggggtaccggggcgccacgtaccggaccaccctacacaagacctagcgggcgacggaccgtggtccgccgtctccgtcacgtccctaccgaacccgaacggcccctacgttccgggttacccttcccccggtcggccccttaacccccgtcccgttacccgaaaggtaccgcccgtaaccccgttcgggtacggggaccaccgacggaccctacggcccccggttagggtcctacccggtccgtacgggtaaccgaaaccggttaacccttcccgttacccgaaccggttcggtaccgttcggacgtcgggaggtaccgggtcgtacgggacgacgggactacgaagtacgntgctgctagncnnnnngnnnnnnnnnnnnnnnnnnnnnnnnnn

SEQ ID NO: 254746 - DNA, 340 bp, Homo sapiens
  misc_feature: GYAE6OF01DEA6I.30.45.E01.1.454.CMB.1.raw
  modified_base (96)..(96): a, c, t, g, unknown or other
  misc_feature (96)..(96): n is a, c, g, or t
  modified_base (177)..(177): a, c, t, g, unknown or other
  misc_feature (177)..(177): n is a, c, g, or t
  modified_base (202)..(202): a, c, t, g, unknown or other
  misc_feature (202)..(202): n is a, c, g, or t
  modified_base (224)..(225): a, c, t, g, unknown or other
  misc_feature (224)..(225): n is a, c, g, or t
  modified_base (246)..(247): a, c, t, g, unknown or other
  misc_feature (246)..(247): n is a, c, g, or t
  modified_base (249)..(249): a, c, t, g, unknown or other
  misc_feature (249)..(249): n is a, c, g, or t
  modified_base (255)..(257): a, c, t, g, unknown or other
  misc_feature (255)..(257): n is a, c, g, or t
  modified_base (261)..(340): a, c, t, g, unknown or other
  misc_feature (261)..(340): n is a, c, g, or t
tcagcacgctacgtcacgaccggtgctcgatttagtgagtcagtaagggaaggggctggagtggatttcatatattagtgctggtgctactacatnaagtacgcagactctgtgaggggccattcactatttccgaggacacgaccaaagaaatcagtatatcctaaaaatgaggtncctgagagaccgtagacacggtctntacgtattacggacggccgggnnggacaacgggcagtagtacgnngnatcagnnngccnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 254747 - DNA, 558 bp, Homo sapiens
  misc_feature: GYAE6OF01BMP4T.30.45.E01.1.454.CMB.1.raw
  modified_base (512)..(512): a, c, t, g, unknown or other
  misc_feature (512)..(512): n is a, c, g, or t
  modified_base (519)..(521): a, c, t, g, unknown or other
  misc_feature (519)..(521): n is a, c, g, or t
  modified_base (523)..(525): a, c, t, g, unknown or other
  misc_feature (523)..(525): n is a, c, g, or t
  modified_base (527)..(528): a, c, t, g, unknown or other
  misc_feature (527)..(528): n is a, c, g, or t
  modified_base (530)..(531): a, c, t, g, unknown or other
  misc_feature (530)..(531): n is a, c, g, or t
  modified_base (533)..(558): a, c, t, g, unknown or other
  misc_feature (533)..(558): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtggcggggccggggagccacgtcggacccaccctacaccaagactacgtggggccgacgggaaccctggtccgccgtcctcctcacgccctccaccgacggccccatccggtccttcccccgtggccctacccctcctaccgaagacgccaccctcggtcggggacacgagccgacgccccgtcgggtcgtaccggtccgtcggtacgaacggtacccttaccgttaccccgacggtagccggtcgtcgtaggacgggtccggggtcgttacgggaccgaaccggggcgaaccgtagtacgngccgtannngnnngnngnngnnnnnnnnnnnnnnnnnnnnnnnnnn

SEQ ID NO: 254748 - DNA, 729 bp, Homo sapiens
  misc_feature: GYAE6OF01EJBHM.30.45.E01.1.454.CMB.1.raw
  modified_base (173)..(173): a, c, t, g, unknown or other
  misc_feature (173)..(173): n is a, c, g, or t
  modified_base (686)..(686): a, c, t, g, unknown or other
  misc_feature (686)..(686): n is a, c, g, or t
  modified_base (694)..(694): a, c, t, g, unknown or other
  misc_feature (694)..(694): n is a, c, g, or t
  modified_base (696)..(729): a, c, t, g, unknown or other
  misc_feature (696)..(729): n is a, c, g, or t
tcagcacgctacgtcacgaccggtgctcgatttagtgagtcagtaagggaaaggggctggagtggatttcatatattagtgctggtgctactaccatgaagtacgcagactctgtggagggccgtattcaccgtatttccgagggacgacgccaaagaatcagtatatctaanaatgagtagcctagagagacggagtacgacggtctgtgtacttacgtggtcgggccgggggaccggggtcacccgtacgttaccggaacccctaacccgtaaccgaaccgtaacgaaccgtttacggggaccgggggaccgaaaccggggttaacccgttgggtcccggttcccgtccgttcccgacaccggcccccttaacggaacccggtaaccggggccccctacggttttccccgggtaccccctttccccggtacggacccccttaccccgttccctaaccgaacggtaaccgccccgtaaccgtcggggtcggactaaccgcgaccggtaccgccgggtttacgggccgttcggtcccggtaacgggtaaccggtttaacccggttacccttttaccccgttccgttcccgttaccgttaccgggtaacccttcggggttacgggcccggggttacccggttaggtacccgggacgttaccgggaccgtacgttaagggcctttagnaccggttnannnnnnnnnnnnnnnnnnnnnnnnnnnnnnnnnn

SEQ ID NO: 254749 - DNA, 242 bp, Homo sapiens
  misc_feature: GYAE6OF01B6STX.30.45.E01.1.454.CMB.1.raw
  modified_base (150)..(150): a, c, t, g, unknown or other
  misc_feature (150)..(150): n is a, c, g, or t
  modified_base (184)..(184): a, c, t, g, unknown or other
  misc_feature (184)..(184): n is a, c, g, or t
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (229)..(242): a, c, t, g, unknown or other
  misc_feature (229)..(242): n is a, c, g, or t
tcagcacgctacgtcacgaccggtgctcgatttagtgagtcagtaagggaaggggctgggagtggatttcatatattagtgctggtgctactaccatgaagtacgcagactctgtggaggggccattcactattccgagggcgacgcaanaaatcagtatatctacaaatgagtagcctgaganacgagacacggctgtntactatgnggcgggggacgggagctaccnnnnnnnnnnnnnn

SEQ ID NO: 254750 - DNA, 636 bp, Homo sapiens
  misc_feature: GYAE6OF01BXNXM.30.45.E01.1.454.CMB.1.raw
  modified_base (234)..(234): a, c, t, g, unknown or other
  misc_feature (234)..(234): n is a, c, g, or t
  modified_base (335)..(335): a, c, t, g, unknown or other
  misc_feature (335)..(335): n is a, c, g, or t
  modified_base (594)..(594): a, c, t, g, unknown or other
  misc_feature (594)..(594): n is a, c, g, or t
  modified_base (601)..(601): a, c, t, g, unknown or other
  misc_feature (601)..(601): n is a, c, g, or t
  modified_base (603)..(604): a, c, t, g, unknown or other
  misc_feature (603)..(604): n is a, c, g, or t
  modified_base (606)..(607): a, c, t, g, unknown or other
  misc_feature (606)..(607): n is a, c, g, or t
  modified_base (609)..(612): a, c, t, g, unknown or other
  misc_feature (609)..(612): n is a, c, g, or t
  modified_base (614)..(616): a, c, t, g, unknown or other
  misc_feature (614)..(616): n is a, c, g, or t
  modified_base (618)..(620): a, c, t, g, unknown or other
  misc_feature (618)..(620): n is a, c, g, or t
  modified_base (622)..(624): a, c, t, g, unknown or other
  misc_feature (622)..(624): n is a, c, g, or t
  modified_base (626)..(628): a, c, t, g, unknown or other
  misc_feature (626)..(628): n is a, c, g, or t
  modified_base (633)..(636): a, c, t, g, unknown or other
  misc_feature (633)..(636): n is a, c, g, or t
tcagcacgctacgtcacgaccggtgctcgatttagtgagtcagtaagggaagggggctgggagtggatttcatatattagtgctggtgctactaccatgaagtcgcagactctgtggagggggccattccacctatttccgagggaacgacgccaaaagaaatcgaagtataagtctaaacaatgagtacgcctggagaggacgagggaccacggtcttggtagttacttacgngggtcgggccgggggccggggacaccgtacgtaccggacccaacccctacaaccaaagtcacgtggggaccacgggacctgggtacccgcctcctcctacncgccctacccgacgaaccgggccctacgtccggtccccttccccggtgaccctacccctcctaccgaaggcctacctacccgtcgggtacggggaccacggacgccgtacggtcccgtcggggctccgtcccgggtaggtaaccgtaaacggtccttaaccgggtaccctaaagggtcggtcggtgtacggtacgggtagggtcccggggtaagttcggggaaccggtaaacgggcccgtaacgtagtaaggctagcgnatagctncnngnncnnnnannnannngnnncnnngcaannnn

SEQ ID NO: 254751 - DNA, 612 bp, Homo sapiens
  misc_feature: GYAE6OF01BLF43.30.45.E01.1.454.CMB.1.raw
  modified_base (181)..(181): a, c, t, g, unknown or other
  misc_feature (181)..(181): n is a, c, g, or t
  modified_base (559)..(559): a, c, t, g, unknown or other
  misc_feature (559)..(559): n is a, c, g, or t
  modified_base (564)..(564): a, c, t, g, unknown or other
  misc_feature (564)..(564): n is a, c, g, or t
  modified_base (566)..(568): a, c, t, g, unknown or other
  misc_feature (566)..(568): n is a, c, g, or t
  modified_base (573)..(573): a, c, t, g, unknown or other
  misc_feature (573)..(573): n is a, c, g, or t
  modified_base (576)..(576): a, c, t, g, unknown or other
  misc_feature (576)..(576): n is a, c, g, or t
  modified_base (580)..(580): a, c, t, g, unknown or other
  misc_feature (580)..(580): n is a, c, g, or t
  modified_base (586)..(586): a, c, t, g, unknown or other
  misc_feature (586)..(586): n is a, c, g, or t
  modified_base (588)..(589): a, c, t, g, unknown or other
  misc_feature (588)..(589): n is a, c, g, or t
  modified_base (592)..(592): a, c, t, g, unknown or other
  misc_feature (592)..(592): n is a, c, g, or t
  modified_base (594)..(594): a, c, t, g, unknown or other
  misc_feature (594)..(594): n is a, c, g, or t
  modified_base (596)..(602): a, c, t, g, unknown or other
  misc_feature (596)..(602): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
  modified_base (608)..(611): a, c, t, g, unknown or other
  misc_feature (608)..(611): n is a, c, g, or t
tcagcacgctacgtcacgaccggtgctcgatttagtgagtcagtaagggaaggggctggagtggatttcatatattagtgctggtgctactaccatgaagtacgcagactctgtggaggggccgattcacctatttccagggacgacgaccaagaaatcagtatatctaacaaatgagtanctgagagacgaggacaggctgtgtattactggtggcggggaccggggacgaccacgtcggaacccaccctacaaccaagactacgtaggggccgacggaacccgtggtccgccgtcctcctacacgtccctaccaacccgaacggggacccctacgtccggttacccttaccccccgtacggccccacccccgttaccctaaccgaaacggtaccgacctaacccgttcgggtacgggggaccaaccgacggaccgtaaccgcccggttggggctcggtccgttacggaaccggaacggtactaaccttaccgacgtaagccgtggtcctaggcgggtacggccgtagggacgaaacggcgaacgtataggcagactnagtgnannnacagnganaganacagancnngangnannnnnnnananannnna

SEQ ID NO: 254752 - DNA, 554 bp, Homo sapiens
  misc_feature: GYAE6OF01DNFHS.30.45.E01.1.454.CMB.1.raw
  modified_base (198)..(198): a, c, t, g, unknown or other
  misc_feature (198)..(198): n is a, c, g, or t
  modified_base (228)..(228): a, c, t, g, unknown or other
  misc_feature (228)..(228): n is a, c, g, or t
  modified_base (511)..(511): a, c, t, g, unknown or other
  misc_feature (511)..(511): n is a, c, g, or t
  modified_base (520)..(522): a, c, t, g, unknown or other
  misc_feature (520)..(522): n is a, c, g, or t
  modified_base (524)..(554): a, c, t, g, unknown or other
  misc_feature (524)..(554): n is a, c, g, or t
tcagcacgctacgtcacgaccggtgctcgatttagtgagtcagtaaggggaaggggctggagtggatttcatatattagtgctggtgctactaccatgaagtacgcagactctgtggaggggccatcacatttccgagggacgacgccaagaaatcagtatatctaacaaatgagtagctgagagacgaggacacggntgtgtattactggtggcggggccggggacnccacgtccggacccaccctacaaccaagactacgcggggaccgacgggacccgtggccgccgtcctcctcacgccctacccaccgaacgggcccctatcggtccccttcccccgtggcccacccctcctaccgaacgtacgcctacccgtcggtcgggggaccacgcgaccgacgtcccggcgggtcgtccggccgtcgggtaacaacgggtaccttacctcccgtacggtacgcggtacgtcgtcggacggggtccgggcggtgggacgaacgggcgaaccngtaacggcnnncnnnnnnnnnnnnnnnnnnnnnnnnnnnnnnn

SEQ ID NO: 254753 - DNA, 448 bp, Homo sapiens
  misc_feature: GYAE6OF01BSCXX.30.45.E01.1.454.CMB.1.raw
  modified_base (437)..(448): a, c, t, g, unknown or other
  misc_feature (437)..(448): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccgggagccactcggaccaccctacaccaagactactggggccagggaaccctggtcgcccgtctcctcagccctccaccaagggccccatcggtcttccccctcggccacccctcctccaagacgccaccgtctgggggccacacgcacgcccgtgggctcgctggtcaagctacctccacgtacgcgtgctgacgcgggctggcgaaggcgcgatagnnnnnnnnnnnn

SEQ ID NO: 254754 - DNA, 583 bp, Homo sapiens
  misc_feature: GYAE6OF01DSF89.30.45.E01.1.454.CMB.1.raw
  modified_base (169)..(169): a, c, t, g, unknown or other
  misc_feature (169)..(169): n is a, c, g, or t
  modified_base (180)..(180): a, c, t, g, unknown or other
  misc_feature (180)..(180): n is a, c, g, or t
  modified_base (205)..(205): a, c, t, g, unknown or other
  misc_feature (205)..(205): n is a, c, g, or t
  modified_base (213)..(213): a, c, t, g, unknown or other
  misc_feature (213)..(213): n is a, c, g, or t
  modified_base (509)..(509): a, c, t, g, unknown or other
  misc_feature (509)..(509): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
  modified_base (519)..(519): a, c, t, g, unknown or other
  misc_feature (519)..(519): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (532)..(532): a, c, t, g, unknown or other
  misc_feature (532)..(532): n is a, c, g, or t
  modified_base (537)..(537): a, c, t, g, unknown or other
  misc_feature (537)..(537): n is a, c, g, or t
  modified_base (544)..(544): a, c, t, g, unknown or other
  misc_feature (544)..(544): n is a, c, g, or t
  modified_base (550)..(550): a, c, t, g, unknown or other
  misc_feature (550)..(550): n is a, c, g, or t
  modified_base (556)..(556): a, c, t, g, unknown or other
  misc_feature (556)..(556): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (567)..(568): a, c, t, g, unknown or other
  misc_feature (567)..(568): n is a, c, g, or t
  modified_base (572)..(572): a, c, t, g, unknown or other
  misc_feature (572)..(572): n is a, c, g, or t
  modified_base (576)..(576): a, c, t, g, unknown or other
  misc_feature (576)..(576): n is a, c, g, or t
  modified_base (580)..(580): a, c, t, g, unknown or other
  misc_feature (580)..(580): n is a, c, g, or t
tcagcacgctacgtcacgaccggtgctcgatttagtgagtcagtaagggaaggggctggagtggatttcatatattagtgctggtgctactaccatgaagtacgcagactctgtggaggggccattcaccatttccgagggacacgaccaagaaatcagtatatctaanaaatgagtacncctgagagacgaggacacggctgtntattacgngcgcggggcggagccacgtcgaccaccacaccagactagcgggaccgaggaccgtgtcgcctctctcacgcctccacgacggccactccggtacctccccgtgcccaccctccgtaccgaagacgcctaccgtcggtacggggccaacggtacgaccgaccgcccgtcgggtcgtacggtaccgtcggtaacgaacggtacccttaacgttaccgtaaccggtacgtcggtacgtacgttaggacgggccggggtacgtacggggacggaagggccgaacgtaacgttagacgtancgctancncngacncncgacacncgacncacgcgngactanacgcanagngnacatannacanacanctgngag

SEQ ID NO: 254755 - DNA, 692 bp, Homo sapiens
  misc_feature: GYAE6OF01E3SWL.30.45.E01.1.454.CMB.1.raw
  modified_base (244)..(244): a, c, t, g, unknown or other
  misc_feature (244)..(244): n is a, c, g, or t
  modified_base (649)..(649): a, c, t, g, unknown or other
  misc_feature (649)..(649): n is a, c, g, or t
  modified_base (652)..(652): a, c, t, g, unknown or other
  misc_feature (652)..(652): n is a, c, g, or t
  modified_base (654)..(655): a, c, t, g, unknown or other
  misc_feature (654)..(655): n is a, c, g, or t
  modified_base (658)..(658): a, c, t, g, unknown or other
  misc_feature (658)..(658): n is a, c, g, or t
  modified_base (660)..(662): a, c, t, g, unknown or other
  misc_feature (660)..(662): n is a, c, g, or t
  modified_base (665)..(677): a, c, t, g, unknown or other
  misc_feature (665)..(677): n is a, c, g, or t
  modified_base (679)..(684): a, c, t, g, unknown or other
  misc_feature (679)..(684): n is a, c, g, or t
  modified_base (686)..(690): a, c, t, g, unknown or other
  misc_feature (686)..(690): n is a, c, g, or t
  modified_base (692)..(692): a, c, t, g, unknown or other
  misc_feature (692)..(692): n is a, c, g, or t
tcagcacgctacgtcacgaccggtgctcgatttagtgagtcagtaagggaaggggctggagtggatttcatatattagtgctggtgctacctaccatgaagtacgcagactctgtggaggggccattcaccatttccgaggggacacgaccaaagaaatcagtatatactaacaaatgagtacgcctaggagagacggaggacgacggctgtagtatttactggtcgggccgggggccggggancccaccgtccggacccctaacccctacaaccgaagacctacggcgggggaccaacgggtaaccccgtggtcccgtcccgtcctcccgtccaccgtcccctacccaacccggaccggggcccctaggttccccgggtttccccctttaccccccggcggtcccccacccccgtttccccgaaacccgtaaaggaccccgaccctaccccggttggggtaccgggggaaccaaccggaacggccacccgggtccccggttaggggccccgttcggtaccggttacgggtaacccgtaaacggttaccctttaacccgtttccccgaaacggttcgggtaccggtggtacccgtgggaccggggtccgggacgtaccggggacgaaacgggtccgtaacgacgtggcntcncnncgncnnngcnnnnnnnnnnnnngnnnnnncnnnnngn

SEQ ID NO: 254756 - DNA, 609 bp, Homo sapiens
  misc_feature: GYAE6OF01DBMNY.30.45.E01.1.454.CMB.1.raw
  modified_base (548)..(548): a, c, t, g, unknown or other
  misc_feature (548)..(548): n is a, c, g, or t
  modified_base (566)..(566): a, c, t, g, unknown or other
  misc_feature (566)..(566): n is a, c, g, or t
  modified_base (574)..(574): a, c, t, g, unknown or other
  misc_feature (574)..(574): n is a, c, g, or t
  modified_base (579)..(579): a, c, t, g, unknown or other
  misc_feature (579)..(579): n is a, c, g, or t
  modified_base (583)..(583): a, c, t, g, unknown or other
  misc_feature (583)..(583): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
  modified_base (591)..(593): a, c, t, g, unknown or other
  misc_feature (591)..(593): n is a, c, g, or t
  modified_base (595)..(595): a, c, t, g, unknown or other
  misc_feature (595)..(595): n is a, c, g, or t
  modified_base (598)..(600): a, c, t, g, unknown or other
  misc_feature (598)..(600): n is a, c, g, or t
  modified_base (602)..(603): a, c, t, g, unknown or other
  misc_feature (602)..(603): n is a, c, g, or t
  modified_base (605)..(605): a, c, t, g, unknown or other
  misc_feature (605)..(605): n is a, c, g, or t
  modified_base (607)..(607): a, c, t, g, unknown or other
  misc_feature (607)..(607): n is a, c, g, or t
  modified_base (609)..(609): a, c, t, g, unknown or other
  misc_feature (609)..(609): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcacatttccagggacacgccaagaatcagtatatctaacaaatgagtagcctgacgaagacgaggacgacggctggtagtattacgtgtaggccggggaccgggtacgcccacgtccggaacccaccctaacaaccgaagtacgtacgtcggggaccgaacgggaacccgtcggtccgaccgtcctcctacgaacgccctaccgaaccgaacggcccctagtaccggtccttccccgtcggaccctacccgtcctacgaacgacgaccgtaccgtacggtcggggacacgacgcgacgcccgtacggctgaccgtaggtacgaacgtaccgtaaccttccgaacggttacgcggttcgtacgtaggtacgggccgggtacgacgggtaaccggaacggcgtaacgaaagtcggatacgcagnctacgagctagatccgancgacgtanctagntacngcnancgnnncngannnanncngngn

SEQ ID NO: 254757 - DNA, 513 bp, Homo sapiens
  misc_feature: GYAE6OF01CICV0.30.45.E01.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (233)..(233): a, c, t, g, unknown or other
  misc_feature (233)..(233): n is a, c, g, or t
  modified_base (493)..(493): a, c, t, g, unknown or other
  misc_feature (493)..(493): n is a, c, g, or t
  modified_base (496)..(513): a, c, t, g, unknown or other
  misc_feature (496)..(513): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccattcaccatttccgagggacacgccaaagaaatcagtatatctaacaaatgagtagcctgaagagacgaggacacggtntgtagtattacnggtggccgggggccggggancctacgcggacccacctacaacaagcctagcggggaccgacggggaaccctgggtccgccgtctcctacgacgccctaccaaccgaacgggcccctaacgttccgggtccctttccccccgtcggccctaccccgtccctaccgaacgacgccaccttcggcggggcacgagctacgccgtggctcgccgtagtcgaaggaccttactccgaacgtcgcggtcgacgtgacggcggcgtacggacgaacggtcgacgaancgnnnnnnnnnnnnnnnnnn

SEQ ID NO: 254758 - DNA, 609 bp, Homo sapiens
  misc_feature: GYAE6OF01B3GOI.30.45.E01.1.454.CMB.1.raw
  modified_base (240)..(240): a, c, t, g, unknown or other
  misc_feature (240)..(240): n is a, c, g, or t
  modified_base (565)..(565): a, c, t, g, unknown or other
  misc_feature (565)..(565): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
  modified_base (576)..(609): a, c, t, g, unknown or other
  misc_feature (576)..(609): n is a, c, g, or t
tcagcacgctacgtcacgaccggtgctcgatttagtgagtcagtaagggaaggggctggagtggatttcatatattagtgctggtgctactaccatgaagtacgcagactctgtggaggggccgattccacctatttccgagggacgacgaccaaagaaatcagtatatactaacaaatgaagtacgctagagagacgaggacacggtctgtagtattacgtggtcggcggggccggganccacgtccggaaccaccctacaaccaagtacctacgtcgggggaccgacgggaacccgtcggtccgcccgtacctccgtccacgtccctaccgaacccgaccgggtccccaagtttccccgggttacccctttccccggccggtaccccctaccccttccctaaaccgaacgtaccgcccgtaacccgtcgggtacggggacctacggaaccgccgtacggtccccggtacgggtcccgtacggccgttacggacgtaacggtaccttaaccgttaccgacgttacggcgtcgacgtcggacggcggtcgaggtacgacggacgngacngnatgcnnnnnnnnnnnnnnnnnnnnnnnnnnnnnnnnnn

SEQ ID NO: 254759 - DNA, 477 bp, Homo sapiens
  misc_feature: GYAE6OF01EGT94.30.45.E01.1.454.CMB.1.raw
  modified_base (243)..(243): a, c, t, g, unknown or other
  misc_feature (243)..(243): n is a, c, g, or t
  modified_base (261)..(261): a, c, t, g, unknown or other
  misc_feature (261)..(261): n is a, c, g, or t
  modified_base (335)..(335): a, c, t, g, unknown or other
  misc_feature (335)..(335): n is a, c, g, or t
  modified_base (375)..(375): a, c, t, g, unknown or other
  misc_feature (375)..(375): n is a, c, g, or t
  modified_base (453)..(453): a, c, t, g, unknown or other
  misc_feature (453)..(453): n is a, c, g, or t
  modified_base (457)..(457): a, c, t, g, unknown or other
  misc_feature (457)..(457): n is a, c, g, or t
  modified_base (460)..(477): a, c, t, g, unknown or other
  misc_feature (460)..(477): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattccaccatttccagggacgacgccaaagaaatcagtatatctaacaaaatgagtagcctgagagacgaggacacggctgtgtattactggtgcggggccgggagccactccggaaccnccctacacaagactacgngggaccgaggaaccctggtccgccgtactccttagcctccaccacgggccatccggtcctcccctggccacccnctccagacgcacctcgtcggggaccacgcgcgacgtccgnggcgtcgacgtcggtacaacgtaccttacctcgaaggtcgtcggtcgcgtcggacgggcggacgtcggacgaacggcnctanagnnnnnnnnnnnnnnnnnn

SEQ ID NO: 254760 - DNA, 505 bp, Homo sapiens
  misc_feature: GYAE6OF01BJALW.30.45.E01.1.454.CMB.1.raw
  modified_base (168)..(168): a, c, t, g, unknown or other
  misc_feature (168)..(168): n is a, c, g, or t
  modified_base (227)..(227): a, c, t, g, unknown or other
  misc_feature (227)..(227): n is a, c, g, or t
  modified_base (478)..(505): a, c, t, g, unknown or other
  misc_feature (478)..(505): n is a, c, g, or t
tcagcacgctacgtcacgaccggtgctcgatttagtgagtcagtaagggaaggggctggagtggatttcatatattagtgctggtgctactaccatgaagtacgcagactctgtggaggggccgattcaccatttccagggacgacgccaagaaatcagtatatctanaaatgagtagcctgagagacgaggacacggctgtgtattactgtggcggggccgggganccacgtccggacccaccctacaccaagactacgtggggccagggaccctggtccgccgtctcctcacgcctccaccgacgggccccagtccggtccttccccgtcggccaccctccctaccaagcgccaccgtcgtggggcacgacggccgcccgtgggctcgccgtggtacgaacggtaccttaccgttacccgacggtacggcgtcgtcgtcggacggcgggccgtgggccgaacgggcgacagtacgnnnnnnnnnnnnnnnnnnnnnnnnnnnn

SEQ ID NO: 254761 - DNA, 767 bp, Homo sapiens
  misc_feature: GYAE6OF01AS0GE.30.45.E01.1.454.CMB.1.raw
  modified_base (166)..(166): a, c, t, g, unknown or other
  misc_feature (166)..(166): n is a, c, g, or t
  modified_base (659)..(659): a, c, t, g, unknown or other
  misc_feature (659)..(659): n is a, c, g, or t
  modified_base (665)..(665): a, c, t, g, unknown or other
  misc_feature (665)..(665): n is a, c, g, or t
  modified_base (671)..(671): a, c, t, g, unknown or other
  misc_feature (671)..(671): n is a, c, g, or t
  modified_base (694)..(694): a, c, t, g, unknown or other
  misc_feature (694)..(694): n is a, c, g, or t
  modified_base (700)..(700): a, c, t, g, unknown or other
  misc_feature (700)..(700): n is a, c, g, or t
  modified_base (726)..(726): a, c, t, g, unknown or other
  misc_feature (726)..(726): n is a, c, g, or t
  modified_base (767)..(767): a, c, t, g, unknown or other
  misc_feature (767)..(767): n is a, c, g, or t
tcagcacgctacgtcacgaccggtgctcgatttagtgagtcagtaagggaaggggcttggagtggatttcatatattagtgctggtgctactaccatgaagtacgcagactctgtggagggccattcacctatttccgagggaccgacgtccaagtaatcagttanatactacaatcgagtagtcctaggaggacgacggaagaccgacggcttgtagttactttacggtggtcggaccgggggtccggggactccgaccggttaccggaaccctaccccgtaaccgaccgtaagtaaccgtacgtacgggggaccgaaccgggtacccgtacgggtccgtaccccgttcctacccttacgaccgtacccttaccccgaaccgggtaaccgggcccctaccgggtttaccccggtttacccgtttacccccccggtgggtaccccctacccccgttaccgttaacccggtaaccggtaaccggtacccctaaccgggttccggggttaccggggacctaccggaccggtaccgtaccgtcccgggtacggggtctacccggtccgtacggttacgaacggttaacctccgtaccgtacggtacggtacgtacggcgtacgtcgggcggttcgacgggtaccgaggtccgagacgtaagngtactnctacgntcgatcgagcgtacgctaggacncggtanaccgtgcgtacacttcgcttaaccgngacgcgtacgtacgtacgactactacgtactacgtctcgtn

SEQ ID NO: 254762 - DNA, 530 bp, Homo sapiens
  misc_feature: GYAE6OF01BXJFX.30.45.E01.1.454.CMB.1.raw
  modified_base (227)..(227): a, c, t, g, unknown or other
  misc_feature (227)..(227): n is a, c, g, or t
  modified_base (372)..(372): a, c, t, g, unknown or other
  misc_feature (372)..(372): n is a, c, g, or t
  modified_base (503)..(503): a, c, t, g, unknown or other
  misc_feature (503)..(503): n is a, c, g, or t
  modified_base (505)..(530): a, c, t, g, unknown or other
  misc_feature (505)..(530): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactggtcgcggggccgggganccactcggacccaccctacaccaagactacgtcggggccgacgggaaccctggtcgccgtctcctcagccctccaccgaacgggccccactcggtccttcccccgtggccacccctccaccaagcgccacctcgtcggggccacncgcacgtcccgtcgggcttcgccgttcgggtacgaacggtacccttaccgttacccgtaacggttacggccggttcgcgttacggacgggccggggtacgttcggggacgtaacgggcgaccgtagtacgncnnnnnnnnnnnnnnnnnnnnnnnnnn

SEQ ID NO: 254763 - DNA, 674 bp, Homo sapiens
  misc_feature: GYAE6OF01BQ5H9.30.45.E01.1.454.CMB.1.raw
  modified_base (611)..(611): a, c, t, g, unknown or other
  misc_feature (611)..(611): n is a, c, g, or t
  modified_base (613)..(613): a, c, t, g, unknown or other
  misc_feature (613)..(613): n is a, c, g, or t
  modified_base (619)..(619): a, c, t, g, unknown or other
  misc_feature (619)..(619): n is a, c, g, or t
  modified_base (621)..(622): a, c, t, g, unknown or other
  misc_feature (621)..(622): n is a, c, g, or t
  modified_base (625)..(625): a, c, t, g, unknown or other
  misc_feature (625)..(625): n is a, c, g, or t
  modified_base (630)..(630): a, c, t, g, unknown or other
  misc_feature (630)..(630): n is a, c, g, or t
  modified_base (641)..(641): a, c, t, g, unknown or other
  misc_feature (641)..(641): n is a, c, g, or t
  modified_base (644)..(644): a, c, t, g, unknown or other
  misc_feature (644)..(644): n is a, c, g, or t
  modified_base (648)..(648): a, c, t, g, unknown or other
  misc_feature (648)..(648): n is a, c, g, or t
  modified_base (652)..(654): a, c, t, g, unknown or other
  misc_feature (652)..(654): n is a, c, g, or t
  modified_base (659)..(662): a, c, t, g, unknown or other
  misc_feature (659)..(662): n is a, c, g, or t
  modified_base (664)..(665): a, c, t, g, unknown or other
  misc_feature (664)..(665): n is a, c, g, or t
  modified_base (668)..(670): a, c, t, g, unknown or other
  misc_feature (668)..(670): n is a, c, g, or t
  modified_base (672)..(674): a, c, t, g, unknown or other
  misc_feature (672)..(674): n is a, c, g, or t
tcagcacgctacgtcacgaccggtgctcgatttagtgagtcagtaagggaaggggctggagtggatttcatatattagtgctggtgctactaccatgaagtacgcagactctgtggaggggccgattccactagtttccagggacgacgccaaagaaatcagtatatctaacaaatgagtagcctgagagacgaggacgacggtctgtgtattacgtggtgggccggggcggggacgtccgacgtaccggaacccaaccctaccgaaccaacgaccgtacggtcggggaccgaacgggaacccgtggtccgccgtcctccgtccgaccgtcccgtccaaccggaaccgggcccctaacgttcccggttcccttcccccgtacgggacccctacccccgtccgtaaccgtaaacgaccggtacccctacccggtttacgggaccgggggacctaaccgacgccgtccggtcccggttcggggtccgtcgtaaccggtcggtaacccgtaaaacggtccccgtttaaccgtacccgtggttaccggccgtacggtcgttacgggaccgggtcggggtaccgtcgggaaaccggcggtcggacgttaacgcggngngtcgcncnncgngtgcncgtgcgcgtgngcncgcngcgnnngcgcnnnncnngcnnncnnn

SEQ ID NO: 254764 - DNA, 530 bp, Homo sapiens
  misc_feature: GYAE6OF01DPRXY.30.45.E01.1.454.CMB.1.raw
  modified_base (208)..(208): a, c, t, g, unknown or other
  misc_feature (208)..(208): n is a, c, g, or t
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
  modified_base (362)..(362): a, c, t, g, unknown or other
  misc_feature (362)..(362): n is a, c, g, or t
  modified_base (447)..(447): a, c, t, g, unknown or other
  misc_feature (447)..(447): n is a, c, g, or t
  modified_base (482)..(482): a, c, t, g, unknown or other
  misc_feature (482)..(482): n is a, c, g, or t
  modified_base (491)..(491): a, c, t, g, unknown or other
  misc_feature (491)..(491): n is a, c, g, or t
  modified_base (495)..(530): a, c, t, g, unknown or other
  misc_feature (495)..(530): n is a, c, g, or t
tcagcacgctacgtcacgaccggtgctcgatttagtgagtcagtaagggaaggggctggagtggatttcatatattagtgctggtgctactaccatgaagtacgcagactctgtggaggggccgattcacctatttcccaggggacgacgccaaaggaaatcagtaatatctaacaaagtgagtagcctgagaggacgaggacacggntgtgtatacgtgnggcggggccggggngccacgtcggaccaccctacacaagactacgtcggggacacgggaccctggtccgccgttctcctcacgtccctacaccgaacggcccagtccggtccctcccgtgccacccctctaccgaagaccncctaccgtcgggtaccgggccagacgcacgtccgttgggcctcggcgtcggtacgaacgtactaccgtcccaggtacgcggtacnccgtaggaccggtggggacgtcggacggaacggtnacgtatganacgnnnnnnnnnnnnnnnnnnnnnnnnnnnnnnnnnnnn

SEQ ID NO: 254765 - DNA, 531 bp, Homo sapiens
  misc_feature: GYAE6OF01E2HM7.30.45.E01.1.454.CMB.1.raw
  modified_base (225)..(225): a, c, t, g, unknown or other
  misc_feature (225)..(225): n is a, c, g, or t
  modified_base (333)..(333): a, c, t, g, unknown or other
  misc_feature (333)..(333): n is a, c, g, or t
  modified_base (488)..(489): a, c, t, g, unknown or other
  misc_feature (488)..(489): n is a, c, g, or t
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
  modified_base (497)..(498): a, c, t, g, unknown or other
  misc_feature (497)..(498): n is a, c, g, or t
  modified_base (500)..(501): a, c, t, g, unknown or other
  misc_feature (500)..(501): n is a, c, g, or t
  modified_base (503)..(507): a, c, t, g, unknown or other
  misc_feature (503)..(507): n is a, c, g, or t
  modified_base (509)..(510): a, c, t, g, unknown or other
  misc_feature (509)..(510): n is a, c, g, or t
  modified_base (512)..(517): a, c, t, g, unknown or other
  misc_feature (512)..(517): n is a, c, g, or t
  modified_base (519)..(520): a, c, t, g, unknown or other
  misc_feature (519)..(520): n is a, c, g, or t
  modified_base (522)..(525): a, c, t, g, unknown or other
  misc_feature (522)..(525): n is a, c, g, or t
  modified_base (527)..(528): a, c, t, g, unknown or other
  misc_feature (527)..(528): n is a, c, g, or t
  modified_base (530)..(531): a, c, t, g, unknown or other
  misc_feature (530)..(531): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccgggganccactcggaccaccctacaccaagactacgtggggccgagggaacccgtggtcgccgtctcctcacgcctccaccgaacgggcccatccggtccttccccctcggccncccctcctccaagcgccacctcgtgggggcacgacgcacggcctggggctcggccgtggtccgaaggacttaccgttcccgtcgtacgtcctaccgtcttggacgtccggggcgttcggtaccgaacggggccgacgtaacgttaagcgagtgcnngcncncgnngnngnnnnngnncnnnnnngnncnnnncnncnn

SEQ ID NO: 254766 - DNA, 555 bp, Homo sapiens
  misc_feature: GYAE6OF01B4FBP.30.45.E01.1.454.CMB.1.raw
  modified_base (231)..(231): a, c, t, g, unknown or other
  misc_feature (231)..(231): n is a, c, g, or t
  modified_base (302)..(302): a, c, t, g, unknown or other
  misc_feature (302)..(302): n is a, c, g, or t
  modified_base (517)..(517): a, c, t, g, unknown or other
  misc_feature (517)..(517): n is a, c, g, or t
  modified_base (522)..(524): a, c, t, g, unknown or other
  misc_feature (522)..(524): n is a, c, g, or t
  modified_base (528)..(555): a, c, t, g, unknown or other
  misc_feature (528)..(555): n is a, c, g, or t
tcagcacgctacgtcacgaccggtgctcgatttagtgagtcagtaaggggaagggggctggagtggatttcatatattagtgctggtgctactaccatgaagtacgcagactctgtggaggggccgattcacctatttccgagggacgacgaccaaagaaatcatatatctaacaatgagtagctgagagacgagacgacgctgtgttatactggtcggcggggccggggnccacgtccgacccaacctaccacaagactacgtcggggccgaacggaccgtggtccgccgtctcctcgacnccctaccaccgaccggacctacgtcccggtccttcccccgtcgcccctacccctccaccgacgacgccaccgtcgggtcggggaccacggacgccgtaccggcccgtacggtcgtcgtaccgtcggtaccgaaaccgtaccttacccgtaccgtacggtcgtccgcgtcgtacgggacggtcccgggagtaccggaacggacggcgacctagagnatcgnnngacnnnnnnnnnnnnnnnnnnnnnnnnnnnn

SEQ ID NO: 254767 - DNA, 531 bp, Homo sapiens
  misc_feature: GYAE6OF01E1FQO.30.45.E01.1.454.CMB.1.raw
  modified_base (228)..(228): a, c, t, g, unknown or other
  misc_feature (228)..(228): n is a, c, g, or t
  modified_base (491)..(494): a, c, t, g, unknown or other
  misc_feature (491)..(494): n is a, c, g, or t
  modified_base (499)..(531): a, c, t, g, unknown or other
  misc_feature (499)..(531): n is a, c, g, or t
tcagcacgctacgtcacgaccggtgctcgattttagtgagtcagtaagggaagggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtggcggggccgggganccacgtcggaccaccctacaccaagactacgtggggaccagggaaccctggtccgccgtctcctcgacgccctaccaccgaacgggcccctaagtccggtacccttcccccgtgggccctacccctcctacccaagacgcctacccgtcggtcgggggaccacgacgcgacgcccgtgggctcggctcgggtacaacggtactaccgtccacggtacgcgtcgcgtgacgggccgggcgcggacgaacgggccagtaagtagnnnntagcnnnnnnnnnnnnnnnnnnnnnnnnnnnnnnnnn

SEQ ID NO: 254768 - DNA, 690 bp, Homo sapiens
  misc_feature: GYAE6OF01BLQKF.30.45.E01.1.454.CMB.1.raw
  modified_base (225)..(225): a, c, t, g, unknown or other
  misc_feature (225)..(225): n is a, c, g, or t
  modified_base (258)..(258): a, c, t, g, unknown or other
  misc_feature (258)..(258): n is a, c, g, or t
  modified_base (610)..(610): a, c, t, g, unknown or other
  misc_feature (610)..(610): n is a, c, g, or t
  modified_base (624)..(624): a, c, t, g, unknown or other
  misc_feature (624)..(624): n is a, c, g, or t
  modified_base (647)..(647): a, c, t, g, unknown or other
  misc_feature (647)..(647): n is a, c, g, or t
tcagcacgctacgtcacgaccggtgctcgatttagtgagtcagtaagggaaggggctggagtggatttcatatattagtgctggtgctactaccatgaagtacgcagactctgtgagggccattcaccatttccgaggacgacgccaagaaatcagtatatctaacaaatgagtacgcctagagagacgagacacggctgtagtattacgtgtggcgggcggganccacgtaccggaccaccctacacaagactacgngggaccgacggaccgtggtccgccgtctcctacacgccctaccgacgaccggacctacgtcggtccgttaccccgtcggacctaccccgttcctaccgaacgacgacccgtaaccgttccggtacgggggacctacgaccgaccgaccggtcccgtacgggtcctcggtccgtagggttaaccaacgggttacccttaaccgtaccgtaacggtacgtaccgtcggtacgtacggaacgggtccgggacgttcgggaaccgtaacgggtaccgtaacccgtaagtaccgacgtagtaccgacgtacgctacggtacacgtactacgagtaccctagtagttacgacgttacncggtaactaccggnttacccgagttacgaccgggtanacgtacgtagaccgttacgacgtaccgagtacctgtaactccg

SEQ ID NO: 254769 - DNA, 521 bp, Homo sapiens
  misc_feature: GYAE6OF01A8LML.30.45.E01.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (225)..(225): a, c, t, g, unknown or other
  misc_feature (225)..(225): n is a, c, g, or t
  modified_base (480)..(481): a, c, t, g, unknown or other
  misc_feature (480)..(481): n is a, c, g, or t
  modified_base (485)..(506): a, c, t, g, unknown or other
  misc_feature (485)..(506): n is a, c, g, or t
  modified_base (508)..(521): a, c, t, g, unknown or other
  misc_feature (508)..(521): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggntgtgtattacnggtggcggggcggganccactccggaccaccctacaccaagactacgtggggccgacgggaccctggtccgccgtctcctcacgcctccaccgacggcccagtccggtccttccccgtcggccacccctccctaccaacgacgccgacccgtcggtcggggaccacgacgcgacgccccgtgggacctcgtccgtcggtacgaacggtaccttaccttcctcgttcctacgtctcgtgacggcgggcgtcggacgacggccgacgagtagnngacnnnnnnnnnnnnnnnnnnnnnngnnnnnnnnnnnnnn

SEQ ID NO: 254770 - DNA, 651 bp, Homo sapiens
  misc_feature: GYAE6OF01BK4NU.30.45.E01.1.454.CMB.1.raw
  modified_base (480)..(480): a, c, t, g, unknown or other
  misc_feature (480)..(480): n is a, c, g, or t
  modified_base (606)..(606): a, c, t, g, unknown or other
  misc_feature (606)..(606): n is a, c, g, or t
  modified_base (610)..(610): a, c, t, g, unknown or other
  misc_feature (610)..(610): n is a, c, g, or t
  modified_base (613)..(613): a, c, t, g, unknown or other
  misc_feature (613)..(613): n is a, c, g, or t
  modified_base (617)..(617): a, c, t, g, unknown or other
  misc_feature (617)..(617): n is a, c, g, or t
  modified_base (621)..(626): a, c, t, g, unknown or other
  misc_feature (621)..(626): n is a, c, g, or t
  modified_base (628)..(631): a, c, t, g, unknown or other
  misc_feature (628)..(631): n is a, c, g, or t
  modified_base (633)..(651): a, c, t, g, unknown or other
  misc_feature (633)..(651): n is a, c, g, or t
tcagcacgctacgtcacgaccggtgctcgatttagtgagtcagtaagggaagggctggagtggattttcatatattacgtgctgttgctaactaccatgaagtacgcagactctgtgagggccgattcaccatttaccaggacgacgccaagaaatcagtatatctaacaaatgagtagcctagagagacgagacacggctgtagttaacttacgtgtgggccgggggaccggggacgcccaacggtccggaacccctaccccgtaaccgaaccaaacgtactacggtcggggacccgaacggggtaaccctcgggtccggcccgtacccttacccgtaccaccgtaccccgtaccccgtaacccggaaaccggggtcccctaggtttaccccgggtccccttttaccccccggacggtcccccaccccgttaccctaaccgacggtaccgacctaccgttacggcggggacaccgtacnccgacgtcccggtgtctccgtacgtcggttaacgaaaccggtcctttaaccgtaacccgtacgtaggtcccgtgtcgacggccgggtaccgtcgtcggaacccgaacggctaaccgagaacggtcngacngcngacntagnnnnnncnnnncnnnnnnnnnnnnnnnnnnn

SEQ ID NO: 254771 - DNA, 156 bp, Homo sapiens
  misc_feature: GYAE6OF02GUJMO.30.45.E01.1.454.CMB.1.raw
  modified_base (131)..(131): a, c, t, g, unknown or other
  misc_feature (131)..(131): n is a, c, g, or t
  modified_base (152)..(156): a, c, t, g, unknown or other
  misc_feature (152)..(156): n is a, c, g, or t
tcagcacgctacgtcacgaccggtgctcgatttagtgagtcagtaagggaagggaccaaggtggaaatcaaacgaactgtggctgcaccgatctgtcttcatcttcccaccctctctactgctagtctgancgggctggcaaggcgcatagnnnnn

SEQ ID NO: 254772 - DNA, 152 bp, Homo sapiens
  misc_feature: GYAE6OF02IINAN.30.45.E01.1.454.CMB.1.raw
  modified_base (152)..(152): a, c, t, g, unknown or other
  misc_feature (152)..(152): n is a, c, g, or t
tcagcacgctacgtcacgaccggtgctcgatttagtgagtcagtaagggaaagggaccaaggtggaatcaaacgaactgtggctgcaccatctgtcttcatcttcccaccctcctctactgctagtctgagcgggctggcaaggcgcatagn

SEQ ID NO: 254773 - DNA, 425 bp, Homo sapiens
  misc_feature: GYAE6OF02H8ZPR.30.45.E01.1.454.CMB.1.raw
  modified_base (421)..(425): a, c, t, g, unknown or other
  misc_feature (421)..(425): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcccccaccaagggcccatcggtcttccccctggcaccctcctccaagagcacctctggggcacagcagccctgggctgcctggtcaaggactacttccacgtagcgtgctgagcgggctggcaaggcgcatagnnnnn

SEQ ID NO: 254774 - DNA, 181 bp, Homo sapiens
  misc_feature: GYAE6OF02GXGSN.30.45.E01.1.454.CMB.1.raw
  modified_base (155)..(181): a, c, t, g, unknown or other
  misc_feature (155)..(181): n is a, c, g, or t
tcagcacgctacgtcacgaccggtgctcgatttagtgagtcagtaagggaaagggaccgaaggtggaaatcaaacgaactgtggctgcaccatctgtcttcatcttcccaccctcctctactgctagtctgagcgggctggcaaggcgcgatagnnnnnnnnnnnnnnnnnnnnnnnnnnn

SEQ ID NO: 254775 - DNA, 151 bp, Homo sapiens
  misc_feature: GYAE6OF02GNDTF.30.45.E01.1.454.CMB.1.raw
  modified_base (151)..(151): a, c, t, g, unknown or other
  misc_feature (151)..(151): n is a, c, g, or t
tcagcacgctacgtcacgaccggtgctcgatttagtgagtcagtaagggaagggaccaaggtggaatcaaacgaactgtggctgcaccatctgtcttcatcttcccgccatctgaacgtagcgtgctgagcgggctggcaaggcgcatagn

SEQ ID NO: 254776 - DNA, 152 bp, Homo sapiens
  misc_feature: GYAE6OF02G3Z5L.30.45.E01.1.454.CMB.1.raw
  modified_base (152)..(152): a, c, t, g, unknown or other
  misc_feature (152)..(152): n is a, c, g, or t
tcagcacgctacgtcacgaccggtgctcgatttagtgagtcagtaagggaaagggaccaaggtggaatcaaacgaactgtggctgcaccatctgtcttcatcttcccgccatctgaacgtagcgtgctgagcgggctggcaaggcgcatagn

SEQ ID NO: 254777 - DNA, 422 bp, Homo sapiens
  misc_feature: GYAE6OF02HVP9C.30.45.E01.1.454.CMB.1.raw
  modified_base (420)..(422): a, c, t, g, unknown or other
  misc_feature (420)..(422): n is a, c, g, or t
tcagcacgctacgtcacgaccggtgctcgatttagtgagtcagtaagggaagggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccactcggaccaccctacaccaagactactggggccagggaaccctggtcgccgtctcctcagcctccaccaagggcccatcggtcttccccctggcaccctcctccaagagcacctccgagagcacagcggccctgggctgcctggtcaaggactacttccacgtagcgtgctgagcgggctggcaaggcgcatagnnn

SEQ ID NO: 254778 - DNA, 458 bp, Homo sapiens
  misc_feature: GYAE6OF02H1YM7.30.45.E01.1.454.CMB.1.raw
  modified_base (346)..(346): a, c, t, g, unknown or other
  misc_feature (346)..(346): n is a, c, g, or t
  modified_base (432)..(458): a, c, t, g, unknown or other
  misc_feature (432)..(458): n is a, c, g, or t
tcagcacgctacgtcacgaccggtgctcgatttagtgagtcagtaagggaaaggggtcgtggagtggatttcatatattaggtgctggtgctactaccatgaagtaccgcagactcttgtgaggggccgattcaccatttccagggacgacgccaagaaatcagtatatctacaaatgagtagcctgagagacgaggacacggctgtgtattactgtgcgggccggggagccactcggaccacccctacaccaagtactactgggggccagggaacccctggtcgccgtctcctcagccctccaccaagggcccatcggtcttccccctggcaccctcctccaagngcacctctggggcacagcagccctgggctgcctggtcaaggactacttcctctctcgactctgagcgggctggcaaggcgcatagnnnnnnnnnnnnnnnnnnnnnnnnnnn

SEQ ID NO: 254779 - DNA, 155 bp, Homo sapiens
  misc_feature: GYAE6OF02FT5YT.30.45.E01.1.454.CMB.1.raw
  modified_base (153)..(155): a, c, t, g, unknown or other
  misc_feature (153)..(155): n is a, c, g, or t
tcagcacgctacgtcacgaccggtgctcgatttagtgagtcagtaagggaagggaccaagggtggaaatcaaacgaactgtggctgcaccatctgtcttcatcttcccgccatctgatatacgatcgctgagcgggctggcaaggcgcatagnnn

SEQ ID NO: 254780 - DNA, 156 bp, Homo sapiens
  misc_feature: GYAE6OF02H1Z22.30.45.E01.1.454.CMB.1.raw
  modified_base (153)..(156): a, c, t, g, unknown or other
  misc_feature (153)..(156): n is a, c, g, or t
tcagcacgctacgtcacgaccggtgctcgatttagtgagtcagtaagggaaagggaccaaggtggaaatcaaacgaactgtggctgcaccatctgtcttcatcttcccgccatctgatatacgatcgctgagcgggctggcaaggcgcatagnnnn

SEQ ID NO: 254781 - DNA, 426 bp, Homo sapiens; identical to SEQ ID NO: 254581
  misc_feature: GYAE6OF02GTHMD.30.45.E01.1.454.CMB.1.raw
  modified_base (422)..(426): a, c, t, g, unknown or other
  misc_feature (422)..(426): n is a, c, g, or t

SEQ ID NO: 254782 - DNA, 153 bp, Homo sapiens; identical to SEQ ID NO: 254506
  misc_feature: GYAE6OF02FWV99.30.45.E01.1.454.CMB.1.raw
  modified_base (153)..(153): a, c, t, g, unknown or other
  misc_feature (153)..(153): n is a, c, g, or t

SEQ ID NO: 254783 - DNA, 152 bp, Homo sapiens; identical to SEQ ID NO: 254776
  misc_feature: GYAE6OF02IR7RK.30.45.E01.1.454.CMB.1.raw
  modified_base (152)..(152): a, c, t, g, unknown or other
  misc_feature (152)..(152): n is a, c, g, or t

SEQ ID NO: 254784 - DNA, 499 bp, Homo sapiens
  misc_feature: GYAE6OF02H4E73.30.45.E01.1.454.CMB.1.raw
  modified_base (335)..(335): a, c, t, g, unknown or other
  misc_feature (335)..(335): n is a, c, g, or t
  modified_base (448)..(448): a, c, t, g, unknown or other
  misc_feature (448)..(448): n is a, c, g, or t
  modified_base (463)..(499): a, c, t, g, unknown or other
  misc_feature (463)..(499): n is a, c, g, or t
tcagcacgctacgtcacgaccggtgctcgatttagtgagtcagtaagggaaggggacgtggagtggatttcatatattagtcgctggtgctactaccatgaagtacgacagactctgtgagggccgattcacgatttccagggcgtacgccaagaaatcagtatagtctacaaaatgacgtagcctgaagagacgaggacacggcgtgtgtaattactgtagcgggccgggggagccagtcgggacctacccctacgaccaaaggactaactgggggccgaggggaaacccctggttcgcccgtcgtccctcagcctccaccaaagggccccgancgggtcttcccccgtcgggccaacccgtccttccaagagcaccgtctggggcaccagcagcccgtggctcgcctggtacaaggactacctcacgtaggctcgctgagccgggntggcaggcgcatagnnnnnnnnnnnnnnnnnnnnnnnnnnnnnnnnnnnnn

SEQ ID NO: 254785 - DNA, 424 bp, Homo sapiens
  misc_feature: GYAE6OF02GV4S4.30.45.E01.1.454.CMB.1.raw
  modified_base (421)..(424): a, c, t, g, unknown or other
  misc_feature (421)..(424): n is a, c, g, or t
tcagcacgctacgtcacgaccggtgctcgatttagtgagtcagtaagggaagggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnn

SEQ ID NO: 254786 - DNA, 427 bp, Homo sapiens
  misc_feature: GYAE6OF02H9TUO.30.45.E01.1.454.CMB.1.raw
  modified_base (421)..(427): a, c, t, g, unknown or other
  misc_feature (421)..(427): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtatactgtgcgggccggggagccactcggaccaccctacaccaagactactgggggccagggaaccctggtcgccgtctcctcagcctccaccaagggccccatcggtcttccccctggcaccctcctccaagagcactctgggggcacagcagccctgggctgcctggtcaaggctacttccacgtagcgtgctgagcgggctggcaaggcgcatagnnnnnnn

SEQ ID NO: 254787 - DNA, 425 bp, Homo sapiens
  misc_feature: GYAE6OF02IYEX9.30.45.E01.1.454.CMB.1.raw
  modified_base (421)..(425): a, c, t, g, unknown or other
  misc_feature (421)..(425): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccactcggaccaccctacaccaagactactggggccagggaaccctggtcgccgtctcctcagcctccaccaagggcccatcggtcttccccctggcaccctcctccaagacgcacctctggggcacagcagccctgggctgcctggtcaaggactacttcctctctcgacctgagcgggctggcaaggcgcatagnnnnn

SEQ ID NO: 254788 - DNA, 426 bp, Homo sapiens
  misc_feature: GYAE6OF02GD529.30.45.E01.1.454.CMB.1.raw
  modified_base (421)..(426): a, c, t, g, unknown or other
  misc_feature (421)..(426): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnn

SEQ ID NO: 254789 - DNA, 422 bp, Homo sapiens
  misc_feature: GYAE6OF02F5LC2.30.45.E01.1.454.CMB.1.raw
  modified_base (420)..(422): a, c, t, g, unknown or other
  misc_feature (420)..(422): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccactcggaccaccctacaccaagactactggggccagggaaccctggtcgccgtctcctcagcctccaccaagggcccatcggtcttccccctggcaccctcctccaagagcacctctggggcacagcagccctgggctgcctggtcaaggactacttccacgtagcgtgctgagcgggctggcaaggcgcatagnnn

SEQ ID NO: 254790 - DNA, 425 bp, Homo sapiens
  misc_feature: GYAE6OF02HNVUQ.30.45.E01.1.454.CMB.1.raw
  modified_base (421)..(425): a, c, t, g, unknown or other
  misc_feature (421)..(425): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggctacttcctctctcgactctgagcgggctggcaaggcgcatagnnnnn

SEQ ID NO: 254791 - DNA, 153 bp, Homo sapiens; identical to SEQ ID NO: 254506
  misc_feature: GYAE6OF02GJCZJ.30.45.E01.1.454.CMB.1.raw
  modified_base (153)..(153): a, c, t, g, unknown or other
  misc_feature (153)..(153): n is a, c, g, or t

SEQ ID NO: 254792 - DNA, 438 bp, Homo sapiens
  misc_feature: GYAE6OF02IV6WE.30.45.E01.1.454.CMB.1.raw
  modified_base (243)..(243): a, c, t, g, unknown or other
  misc_feature (243)..(243): n is a, c, g, or t
  modified_base (425)..(425): a, c, t, g, unknown or other
  misc_feature (425)..(425): n is a, c, g, or t
  modified_base (431)..(438): a, c, t, g, unknown or other
  misc_feature (431)..(438): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccacgtcgggaccaccctanaccaagactactggggccagggaaccctggtcgccgtctcctcagcctccaccaagggcccatcggtcttccccctggccaccctcctcccaagacgcaccctcgtgggggcacaggcagcccctgggctgcctggtccaaggctacttccacgtagcgtgctgacgcgggctggcaaggcncatagnnnnnnnn

SEQ ID NO: 254793 - DNA, 426 bp, Homo sapiens
  misc_feature: GYAE6OF02F5NJ7.30.45.E01.1.454.CMB.1.raw
  modified_base (421)..(426): a, c, t, g, unknown or other
  misc_feature (421)..(426): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtccttcccctggcaccctcctccaagagcacctcgtggggcacagcagccctgggctgcctggtcaaggactacttccacgtagcgtgctgagcggctggcaaggcgcatagnnnnnn

SEQ ID NO: 254794 - DNA, 428 bp, Homo sapiens; identical to SEQ ID NO: 254563
  misc_feature: GYAE6OF02GK5IP.30.45.E01.1.454.CMB.1.raw
  modified_base (422)..(428): a, c, t, g, unknown or other
  misc_feature (422)..(428): n is a, c, g, or t

SEQ ID NO: 254795 - DNA, 424 bp, Homo sapiens
  misc_feature: GYAE6OF02GY3EP.30.45.E01.1.454.CMB.1.raw
  modified_base (422)..(424): a, c, t, g, unknown or other
  misc_feature (422)..(424): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnn

SEQ ID NO: 254796 - DNA, 458 bp, Homo sapiens
  misc_feature: GYAE6OF02IIMRI.30.45.E01.1.454.CMB.1.raw
  modified_base (436)..(437): a, c, t, g, unknown or other
  misc_feature (436)..(437): n is a, c, g, or t
  modified_base (439)..(458): a, c, t, g, unknown or other
  misc_feature (439)..(458): n is a, c, g, or t
tcagcacgctacgtcacgaccggtgctcgatttagtgagtcagtaagggaaagggggctggagtggatttcatatattagtgctggtgcctactaccatgaagtacgcagactctgtgaggggccgattcaccatttccagggacgacgccaagaaatcagtatatctacaaatgagtagcctgagagacgaggacgacggctgtgtattacctgtgcgggcccggggagcccactcggaccaccctacaccaagactactggggccagggaaccctggtcgacccgtctcctcacgccctccaccaacgggccccaatcggtcttccccctggccaccctcctccaagagccacctctggggcacagcagccctgggctgcctggtcaagggctactcctcgtagcactctgagcgggctggcaaggcgcatagnntnnnnnnnnnnnnnnnnnnnn

SEQ ID NO: 254797 - DNA, 151 bp, Homo sapiens
  misc_feature: GYAE6OF02J06ZG.30.45.E01.1.454.CMB.1.raw
tcagcacgctacgtcacgaccggtgctcgatttagtgagtcagtaagggaaagggaccaaggtggaatcaaacgaactgtggctgcaccatctgtcttcatcttcccaccctcctctactgctagtctgagcgggctggcaaggcgcatag

SEQ ID NO: 254798 - DNA, 153 bp, Homo sapiens; identical to SEQ ID NO: 254506
  misc_feature: GYAE6OF02F0C28.30.45.E01.1.454.CMB.1.raw
  modified_base (153)..(153): a, c, t, g, unknown or other
  misc_feature (153)..(153): n is a, c, g, or t

SEQ ID NO: 254799 - DNA, 431 bp, Homo sapiens
  misc_feature: GYAE6OF02IV5X8.30.45.E01.1.454.CMB.1.raw
  modified_base (425)..(431): a, c, t, g, unknown or other
  misc_feature (425)..(431): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccactcggaccaccctacaccaagactactggggccagggaaccctggtcgccgtctcctcagcctccaccaagggcccatcggtcttccccctggccaccctcctccaagacgcaccctctgggggcacagcagccctgggctgcctggtcaaggactacttcctctctcgactctgagcgggctggcaaggcgcatagnnnnnnn

SEQ ID NO: 254800 - DNA, 430 bp, Homo sapiens
  misc_feature: GYAE6OF02GFM1Y.30.45.E01.1.454.CMB.1.raw
  modified_base (424)..(430): a, c, t, g, unknown or other
  misc_feature (424)..(430): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccacgtcggaccaccctacgaccaagactactggggccagggaaccctggtcgccgtctcctcagcctccaccaagggcccatcggtcttcccccctggcaccctcctccaagagcacctctgggggcacagcagccctgggctgcctggtcaaggactacttccacgtagcgtgctgagcgggctggcaaggcgcatagnnnnnnn

SEQ ID NO: 254801 - DNA, 427 bp, Homo sapiens; identical to SEQ ID NO: 254557
  misc_feature: GYAE6OF02IS50Z.30.45.E01.1.454.CMB.1.raw
  modified_base (422)..(427): a, c, t, g, unknown or other
  misc_feature (422)..(427): n is a, c, g, or t

SEQ ID NO: 254802 - DNA, 427 bp, Homo sapiens
  misc_feature: GYAE6OF02F2UVD.30.45.E01.1.454.CMB.1.raw
  modified_base (421)..(427): a, c, t, g, unknown or other
  misc_feature (421)..(427): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnnn

SEQ ID NO: 254803 - DNA, 236 bp, Homo sapiens
  misc_feature: GYAE6OF02FGUMB.30.45.E01.1.454.CMB.1.raw
  modified_base (233)..(236): a, c, t, g, unknown or other
  misc_feature (233)..(236): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgagcgggctggcaaggcgcatagnnnn

SEQ ID NO: 254804 - DNA, 427 bp, Homo sapiens
  misc_feature: GYAE6OF02F52BU.30.45.E01.1.454.CMB.1.raw
  modified_base (422)..(427): a, c, t, g, unknown or other
  misc_feature (422)..(427): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttcctctctcgactctgagcgggctggcaaggcgcatagnnnnnn

SEQ ID NO: 254805 - DNA, 429 bp, Homo sapiens
  misc_feature: GYAE6OF02JIFWV.30.45.E01.1.454.CMB.1.raw
  modified_base (422)..(429): a, c, t, g, unknown or other
  misc_feature (422)..(429): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccacgactactggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnnnn

SEQ ID NO: 254806 - DNA, 212 bp, Homo sapiens
  misc_feature: GYAE6OF02IXJ23.30.45.E01.1.454.CMB.1.raw
  modified_base (150)..(212): a, c, t, g, unknown or other
  misc_feature (150)..(212): n is a, c, g, or t
tcagcacgctacgtcacgaccggtgctcgatttagtgagtcagtaagggaaagggaccaaggtggaaatcaaacgaactgtggctgcaccatctgtcttcatcttcccacctctctactgctagtctgagcggctggcaaggcgcatagnnnnnnnnnnnnnnnnnnnnnnnnnnnnnnnnnnnnnnnnnnnnnnnnnnnnnnnnnnnnnnn

SEQ ID NO: 254807 - DNA, 429 bp, Homo sapiens
  misc_feature: GYAE6OF02GQSFD.30.45.E01.1.454.CMB.1.raw
  modified_base (424)..(429): a, c, t, g, unknown or other
  misc_feature (424)..(429): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccacgactactggggccagggaaccctggtcgccgtctcctcagcctccaccaagggcccatcggtcttccccctggccaccctcctccaagagcacctctgggggcacagcacgccctgggctgcctggtcaaggactacttccacgtagcgtgctgagcgggctggcaaggcgcatagnnnnnn

SEQ ID NO: 254808 - DNA, 429 bp, Homo sapiens
  misc_feature: GYAE6OF02GXDW2.30.45.E01.1.454.CMB.1.raw
  modified_base (422)..(429): a, c, t, g, unknown or other
  misc_feature (422)..(429): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnnnn

SEQ ID NO: 254809 - DNA, 571 bp, Homo sapiens
  misc_feature: GYAE6OF02JBEBI.30.45.E01.1.454.CMB.1.raw
  modified_base (236)..(236): a, c, t, g, unknown or other
  misc_feature (236)..(236): n is a, c, g, or t
  modified_base (499)..(499): a, c, t, g, unknown or other
  misc_feature (499)..(499): n is a, c, g, or t
  modified_base (502)..(502): a, c, t, g, unknown or other
  misc_feature (502)..(502): n is a, c, g, or t
  modified_base (510)..(510): a, c, t, g, unknown or other
  misc_feature (510)..(510): n is a, c, g, or t
  modified_base (514)..(514): a, c, t, g, unknown or other
  misc_feature (514)..(514): n is a, c, g, or t
  modified_base (542)..(542): a, c, t, g, unknown or other
  misc_feature (542)..(542): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (554)..(554): a, c, t, g, unknown or other
  misc_feature (554)..(554): n is a, c, g, or t
  modified_base (556)..(556): a, c, t, g, unknown or other
  misc_feature (556)..(556): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
  modified_base (564)..(565): a, c, t, g, unknown or other
  misc_feature (564)..(565): n is a, c, g, or t
  modified_base (569)..(570): a, c, t, g, unknown or other
  misc_feature (569)..(570): n is a, c, g, or t
tcagcacgctacgtcacgaccggtgctcgatttagtgagtcagtaagggaaagggggcgtggagtggatttcatagtattagtgctggtgctactaccagtcgaagtacgcagactcgtgtcgaggggccgattcaccgatttccagggcgacgccaagaaatcagtatatctacaaatcgagtagcctgacgacgacgaggacacggctgtgtagttactgtgcgggccgggganccactcggaccacccgtacaccaagactactggggccaggaacctggtacgccggtctcctcagcctccgaaccaacggcccactcggtcttcccctcggcacccgtcctccaacgtacgcctacctacgtggggggtccactacgccgtacgcccgttcgggggcctggcccttcgggtcgaaacgggactaccgtttcccaaccgttagccgtacgccttggaagccggggcttcgggcgaaacgggcggcgacgtaaggntgnctactcgncacncgtctctcagcgtcgcgagacgagcgcnacacgangngcncncncncncnnctcnnc

SEQ ID NO: 254810 - DNA, 429 bp, Homo sapiens
  misc_feature: GYAE6OF02GCSDE.30.45.E01.1.454.CMB.1.raw
  modified_base (421)..(429): a, c, t, g, unknown or other
  misc_feature (421)..(429): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactactcctctctcgactctgagcgggctggcaggcgcatagnnnnnnnnn

SEQ ID NO: 254811 - DNA, 424 bp, Homo sapiens
  misc_feature: GYAE6OF02H3IDX.30.45.E01.1.454.CMB.1.raw
  modified_base (414)..(414): a, c, t, g, unknown or other
  misc_feature (414)..(414): n is a, c, g, or t
  modified_base (420)..(424): a, c, t, g, unknown or other
  misc_feature (420)..(424): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaacccctggtcgccgtctcctcagcctccaccaagggcccatccggtctccccctggcaccctcctccagagcacctctggggcacagcagccctgggctgcctggtcaaggctacttccacgtagcgtgctgagcgggctggcaaggcncatagnnnnn

SEQ ID NO: 254812 - DNA, 426 bp, Homo sapiens
  misc_feature: GYAE6OF02FWCV3.30.45.E01.1.454.CMB.1.raw
  modified_base (423)..(426): a, c, t, g, unknown or other
  misc_feature (423)..(426): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttcctctctcgactctgagcgggctggcaaggcgcatagnnnn

SEQ ID NO: 254813 - DNA, 455 bp, Homo sapiens
  misc_feature: GYAE6OF02IBC8Y.30.45.E01.1.454.CMB.1.raw
  modified_base (214)..(214): a, c, t, g, unknown or other
  misc_feature (214)..(214): n is a, c, g, or t
  modified_base (230)..(230): a, c, t, g, unknown or other
  misc_feature (230)..(230): n is a, c, g, or t
  modified_base (248)..(248): a, c, t, g, unknown or other
  misc_feature (248)..(248): n is a, c, g, or t
  modified_base (277)..(277): a, c, t, g, unknown or other
  misc_feature (277)..(277): n is a, c, g, or t
  modified_base (309)..(309): a, c, t, g, unknown or other
  misc_feature (309)..(309): n is a, c, g, or t
  modified_base (422)..(455): a, c, t, g, unknown or other
  misc_feature (422)..(455): n is a, c, g, or t
tcagcacgctacgtcacgaccggtgctcgatttagtgagtcagtaagggaagggggtcgtggagtggatttcatatattagtgctggtgctacctaccatgaagtacgcagactctgtgaggggccgattcaccatttccagggacgacgccaagaaatcagtatatctacaaatgagtagcctgagagacgagggacacggctgtgtattacngtgcgggccggggganccatcggaccacccctanaccaagactactggggaccagggaacccnggtcgccgtctcctcagctccacaaggcccancggtctcccctgcaccctctccaagagcacctctggggcacagcagccctgggctgcctggtcaaggctacttccacgtagcgtgctgagcgggctgggcaaggtcgcatagnnnnnnnnnnnnnnnnnnnnnnnnnnnnnnnnnn

SEQ ID NO: 254814 - DNA, 425 bp, Homo sapiens
  misc_feature: GYAE6OF02H5T1O.30.45.E01.1.454.CMB.1.raw
  modified_base (420)..(425): a, c, t, g, unknown or other
  misc_feature (420)..(425): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttcccctggcaccctcctccaagagcacctctgggggcacagcagccctgggctgcctggtcaaggactacttccacgtagcgtgctgagcgggctggcaaggcgcatgnnnnnn

SEQ ID NO: 254815 - DNA, 427 bp, Homo sapiens
  misc_feature: GYAE6OF02G1VWH.30.45.E01.1.454.CMB.1.raw
  modified_base (423)..(427): a, c, t, g, unknown or other
  misc_feature (423)..(427): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttcctctctcgactctgagcgggctggcaaggcgcatagnnnnn

SEQ ID NO: 254816 - DNA, 153 bp, Homo sapiens
  misc_feature: GYAE6OF02FIMM5.30.45.E01.1.454.CMB.1.raw
  modified_base (152)..(153): a, c, t, g, unknown or other
  misc_feature (152)..(153): n is a, c, g, or t
tcagcacgctacgtcacgaccggtgctcgatttagtgagtcagtaagggaagggaccaaggtggaaatcaaacgaactgtggctgcaccatctgtcttcatcttcccgccatctgatatacgatcgctgagcgggctggcaaggcgcatagnn

SEQ ID NO: 254817 - DNA, 427 bp, Homo sapiens; identical to SEQ ID NO: 254557
  misc_feature: GYAE6OF02ITOZW.30.45.E01.1.454.CMB.1.raw
  modified_base (422)..(427): a, c, t, g, unknown or other
  misc_feature (422)..(427): n is a, c, g, or t

SEQ ID NO: 254818 - DNA, 247 bp, Homo sapiens
  misc_feature: GYAE6OF02HEZ8G.30.45.E01.1.454.CMB.1.raw
  modified_base (236)..(247): a, c, t, g, unknown or other
  misc_feature (236)..(247): n is a, c, g, or t
tcagcacgctacgtcacgaccggtgctcgatttagtgagtcagtaagggaaggggcgtggagtggatttcatatattagtgctggtgctactaccatgaagtacgcagactctgtgagggccgattcaccatttccagggacgacgccaagaaatcagtatatctacaaatgagtagcctgagagtacgaggacacgggactgtgtattactgagcgggctggcaaggcgcatagnnnnnnnnnnnn

SEQ ID NO: 254819 - DNA, 425 bp, Homo sapiens
  misc_feature: GYAE6OF02H17FZ.30.45.E01.1.454.CMB.1.raw
  modified_base (421)..(425): a, c, t, g, unknown or other
  misc_feature (421)..(425): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctggggcacagcagcccttggctgcctggtcaaggactacttccacgtagcgtgctgagcgggctggcaaggcgcatagnnnnn

SEQ ID NO: 254820 - DNA, 428 bp, Homo sapiens
  misc_feature: GYAE6OF02GVWYY.30.45.E01.1.454.CMB.1.raw
  modified_base (421)..(428): a, c, t, g, unknown or other
  misc_feature (421)..(428): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccacgtcggaccaccctacaccaagactactggggccagggaaccctggtcgccgtctcctcagcctccacaagggcccatcggtcttccccctggcaccctcctccaagagcacctctgggggcacagcagccctgggctgcctggtcaaggactacttccacgtagcgtgctgagcgggctggcaaggcgcatagnnnnnnnn

SEQ ID NO: 254821 - DNA, 427 bp, Homo sapiens; identical to SEQ ID NO: 254557
  misc_feature: GYAE6OF02G1MRW.30.45.E01.1.454.CMB.1.raw
  modified_base (422)..(427): a, c, t, g, unknown or other
  misc_feature (422)..(427): n is a, c, g, or t

SEQ ID NO: 254822 - DNA, 426 bp, Homo sapiens
  misc_feature: GYAE6OF02GLC8G.30.45.E01.1.454.CMB.1.raw
  modified_base (421)..(426): a, c, t, g, unknown or other
  misc_feature (421)..(426): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagtctccaccaagggcccatcggtcttccccctggcaccctcctccaagagcacctctgggggcacagcagccctgggctgcctggtcaaggctacttccacgtagcgtgctgagcgggctggcaaggcgcatagnnnnnn

SEQ ID NO: 254823 - DNA, 426 bp, Homo sapiens
  misc_feature: GYAE6OF02F0CI1.30.45.E01.1.454.CMB.1.raw
  modified_base (424)..(426): a, c, t, g, unknown or other
  misc_feature (424)..(426): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggccaccctcctccaagacgcacctctgggggcacagcagccctgggctgcctggtcaaggactacttccacgtagcgtgctgagcgggctggcaaggcgcatagnnn

SEQ ID NO: 254824 - DNA, 158 bp, Homo sapiens
  misc_feature: GYAE6OF02GBSX4.30.45.E01.1.454.CMB.1.raw
  modified_base (153)..(158): a, c, t, g, unknown or other
  misc_feature (153)..(158): n is a, c, g, or t
tcagcacgctacgtcacgaccggtgctcgatttagtgagtcagtaagggaaagggaccaaggtggaaatcaaacgaactgtggctgcaccatctgtcttcatcttcccgccatctgatatacgatcgctgagcgggctggcaaggcgcatagnnnnnn

SEQ ID NO: 254825 - DNA, 428 bp, Homo sapiens
  misc_feature: GYAE6OF02JBSML.30.45.E01.1.454.CMB.1.raw
  modified_base (420)..(428): a, c, t, g, unknown or other
  misc_feature (420)..(428): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaggactacttccacgtagcgtgctgagcgggctggcaaggcgcatagnnnnnnnnn

SEQ ID NO: 254826 - DNA, 430 bp, Homo sapiens
  misc_feature: GYAE6OF02G7H11.30.45.E01.1.454.CMB.1.raw
  modified_base (427)..(430): a, c, t, g, unknown or other
  misc_feature (427)..(430): n is a, c, g, or t
tcagcacgctacgtcacgaccggtgctcgatttagtgagtcagtaagggaaggggcgtggtaggtggagttcgatataattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnn

SEQ ID NO: 254827 - DNA, 430 bp, Homo sapiens
  misc_feature: GYAE6OF02GTE2Q.30.45.E01.1.454.CMB.1.raw
  modified_base (422)..(430): a, c, t, g, unknown or other
  misc_feature (422)..(430): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccacactacaccaagactactggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnnnnn

SEQ ID NO: 254828 - DNA, 430 bp, Homo sapiens
  misc_feature: GYAE6OF02I43DA.30.45.E01.1.454.CMB.1.raw
  modified_base (421)..(430): a, c, t, g, unknown or other
  misc_feature (421)..(430): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactattggggccagggaaccctggtcgccgtctcctcagcctccaccaagggcccatcggtcttccccctggcaccctcctccaagagcacctctggggcacagcagccctgggctgcctggtcaaggactacttccacgtagcgtgctgagcgggctggcaaggcgcatagnnnnnnnnnn

SEQ ID NO: 254829 - DNA, 430 bp, Homo sapiens
  misc_feature: GYAE6OF02FT62M.30.45.E01.1.454.CMB.1.raw
  modified_base (424)..(430): a, c, t, g, unknown or other
  misc_feature (424)..(430): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacacaaagactactgggggccagggaaccctggtcgccgtctcctcagcctccaccaagggcccatcggtcttccccctggcaccctcctccaagacgcacctctgggggcacagcagccctgggctgcctggtcaaggactacttcctctctcgactctgagcgggctggcaaggcgcatagnnnnnnn

SEQ ID NO: 254830 - DNA, 426 bp, Homo sapiens
  misc_feature: GYAE6OF02HWHVJ.30.45.E01.1.454.CMB.1.raw
  modified_base (421)..(426): a, c, t, g, unknown or other
  misc_feature (421)..(426): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttcctctctcgactctgagcgggctggcaaggcgcatagnnnnnn

SEQ ID NO: 254831 - DNA, 437 bp, Homo sapiens
  misc_feature: GYAE6OF02ID5P2.30.45.E01.1.454.CMB.1.raw
  modified_base (424)..(437): a, c, t, g, unknown or other
  misc_feature (424)..(437): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatccggtcttccccctggcaccctcctccaagagcacctctgggggcacagcagccctgggctgcctggtcaaggactacttccacgtagcgtgctgagcgggctggcaaggcgcatagnnnnnnnnnnnnnn

SEQ ID NO: 254832 - DNA, 431 bp, Homo sapiens; identical to SEQ ID NO: 254561
  misc_feature: GYAE6OF02GFTIE.30.45.E01.1.454.CMB.1.raw
  modified_base (423)..(431): a, c, t, g, unknown or other
  misc_feature (423)..(431): n is a, c, g, or t

SEQ ID NO: 254833 - DNA, 426 bp, Homo sapiens
  misc_feature: GYAE6OF02GJRHA.30.45.E01.1.454.CMB.1.raw
  modified_base (421)..(426): a, c, t, g, unknown or other
  misc_feature (421)..(426): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccactcggaccaccctacaccaagactactggggccagggaaccctggtcgccgtctcctcagcctccaccaagggcccatcggtcttccccctggccaccctcctccaagagcacctctgggggcacagcagccctgggctgcctggtcaaggactactccacgtagcgtgctgagcgggctggcaaggcgcatagnnnnnn

SEQ ID NO: 254834 - DNA, 428 bp, Homo sapiens
  misc_feature: GYAE6OF02GQTLV.30.45.E01.1.454.CMB.1.raw
  modified_base (423)..(428): a, c, t, g, unknown or other
  misc_feature (423)..(428): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggggagccactcggaccaccctacaccaagactactggggcaagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnn

SEQ ID NO: 254835 - DNA, 155 bp, Homo sapiens
  misc_feature: GYAE6OF02IENF1.30.45.E01.1.454.CMB.1.raw
  modified_base (153)..(155): a, c, t, g, unknown or other
  misc_feature (153)..(155): n is a, c, g, or t
tcagcacgctacgtcacgaccggtgctcgatttagtgagtcagtaagggaaagggaccaaggtggaaatcaaacgaactgtggctgcaccatctgtcttcatcttcccgccatatgatatacgatcgctgagcgggctggcaaggcgcatagnnn

SEQ ID NO: 254836 - DNA, 428 bp, Homo sapiens
  misc_feature: GYAE6OF02FMQRK.30.45.E01.1.454.CMB.1.raw
  modified_base (423)..(428): a, c, t, g, unknown or other
  misc_feature (423)..(428): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggccaccctcctccaagagcacctctgggggcacagcagccctgggctgcctggtcaaggactacttccacgtagcgtgctgagcgggctggcaaggcgcatagnnnnnn

SEQ ID NO: 254837 - DNA, 439 bp, Homo sapiens
  misc_feature: GYAE6OF02G433L.30.45.E01.1.454.CMB.1.raw
  modified_base (433)..(439): a, c, t, g, unknown or other
  misc_feature (433)..(439): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggggagccactcggaccacccctacaccaagactactgggggcccagggaacccctggtcgccgtctcctcagcctccaccaagggcccatcggtcttccccctggccaccctcctccaagacgcacctctcgggggcacacgcacgccctgggctgcctggtcaaggactacttccacgtagcgtgctgagcgggctgggcaaggcgcatagnnnnnnn

SEQ ID NO: 254838 - DNA, 430 bp, Homo sapiens
  misc_feature: GYAE6OF02HM72W.30.45.E01.1.454.CMB.1.raw
  modified_base (424)..(430): a, c, t, g, unknown or other
  misc_feature (424)..(430): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttcccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagacgcacctctgggggcacagcagccctgggctgcctggtcaaggactacttccacgtagcgtgctgagcgggctggcaaggcgcatagnnnnnnn

SEQ ID NO: 254839 - DNA, 430 bp, Homo sapiens
  misc_feature: GYAE6OF02I0MX7.30.45.E01.1.454.CMB.1.raw
  modified_base (423)..(430): a, c, t, g, unknown or other
  misc_feature (423)..(430): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaacgagcacctctgggggcacagcagccctgggctgcctggtcaaggactacttccacgtagcgtgctgagcgggctggcaaggcgcatagnnnnnnnn

SEQ ID NO: 254840 - DNA, 478 bp, Homo sapiens
  misc_feature: GYAE6OF02IK86L.30.45.E01.1.454.CMB.1.raw
  modified_base (450)..(478): a, c, t, g, unknown or other
  misc_feature (450)..(478): n is a, c, g, or t
tcagcacgctacgtcacgaccggtgctcgattttagtgagtcagtaagggaagggggcctaggagtcggattttcgatatacttagtgctggtgctactaccatgaagtacgcagactctgtgaggggtcccgattcaccatttccagggacgacgccaagaaatcagtatatctacaaatgagtagccgtgagagacgaggacacggctggtgtattactgtgcgggccggggagccacgtcggaccaccctacaccaagactactgggccagggaaaccctggtcgccgtctcctcagcctccaccaacgggcccaagtcggtcttcccccgtgggcgacccgtcctccaacgagtcacctctgggggcacgagcacgccctgggctggccgtggtcaaggactaactccacgtagcgtcgctagagcgggctggcaaggcacatagnnnnnnnnnnnnnnnnnnnnnnnnnnnnn

SEQ ID NO: 254841 - DNA, 433 bp, Homo sapiens
  misc_feature: GYAE6OF02FV3X8.30.45.E01.1.454.CMB.1.raw
  modified_base (421)..(433): a, c, t, g, unknown or other
  misc_feature (421)..(433): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccactcggaccacctacaccaagactactgggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnnnnnnnnn

SEQ ID NO: 254842 - DNA, 426 bp, Homo sapiens; identical to SEQ ID NO: 254581
  misc_feature: GYAE6OF02F70A7.30.45.E01.1.454.CMB.1.raw
  modified_base (422)..(426): a, c, t, g, unknown or other
  misc_feature (422)..(426): n is a, c, g, or t

SEQ ID NO: 254843 - DNA, 429 bp, Homo sapiens
  misc_feature: GYAE6OF02HQ7EN.30.45.E01.1.454.CMB.1.raw
  modified_base (423)..(429): a, c, t, g, unknown or other
  misc_feature (423)..(429): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactgggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnnn

SEQ ID NO: 254844 - DNA, 428 bp, Homo sapiens
  misc_feature: GYAE6OF02JDJW5.30.45.E01.1.454.CMB.1.raw
  modified_base (423)..(428): a, c, t, g, unknown or other
  misc_feature (423)..(428): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctgggcaaggcgcatagnnnnnn

SEQ ID NO: 254845 - DNA, 426 bp, Homo sapiens; identical to SEQ ID NO: 254581
  misc_feature: GYAE6OF02HDWX4.30.45.E01.1.454.CMB.1.raw
  modified_base (422)..(426): a, c, t, g, unknown or other
  misc_feature (422)..(426): n is a, c, g, or t

SEQ ID NO: 254846 - DNA, 427 bp, Homo sapiens; identical to SEQ ID NO: 254557
  misc_feature: GYAE6OF02FJFNP.30.45.E01.1.454.CMB.1.raw
  modified_base (422)..(427): a, c, t, g, unknown or other
  misc_feature (422)..(427): n is a, c, g, or t

SEQ ID NO: 254847 - DNA, 435 bp, Homo sapiens
  misc_feature: GYAE6OF02H7JK8.30.45.E01.1.454.CMB.1.raw
  modified_base (427)..(435): a, c, t, g, unknown or other
  misc_feature (427)..(435): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccactcggaccaccctacaccaagactactggggccagggaaccctggtcgccgtctcctcagcctccaccaagggcccatcggtcttccccctcggccaccctcctccaagacgccacctctgggggcacgagcacgccctgggctgcctggtcgaaggctacttccacgtagcgtgctgagcgggctggcaaggcgcatagnnnnnnnnn

SEQ ID NO: 254848 - DNA, 429 bp, Homo sapiens
  misc_feature: GYAE6OF02G354J.30.45.E01.1.454.CMB.1.raw
  modified_base (424)..(429): a, c, t, g, unknown or other
  misc_feature (424)..(429): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggccaccctcctccaacgagcacctctgggggcacagcagccctgggctgcctggtcaaggactacttccacgtagcgtgctgagcgggctggcaaggcgcatagnnnnnn

SEQ ID NO: 254849 - DNA, 436 bp, Homo sapiens
  misc_feature: GYAE6OF02IP8LP.30.45.E01.1.454.CMB.1.raw
  modified_base (424)..(436): a, c, t, g, unknown or other
  misc_feature (424)..(436): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccacgtcggaccaccctacaccaagactactggggccagggaaccctggtcgccgtctcctcagcctccaccaggcccatcggtcttccccctggccaccctcctccaagacgccacctctcggggcacagcacgccctgggctcgcctggtcaaggactacttcctctctcgactctgagcgggctggcaggcgcatagnnnnnnnnnnnnn

SEQ ID NO: 254850 - DNA, 427 bp, Homo sapiens
  misc_feature: GYAE6OF02JFPYU.30.45.E01.1.454.CMB.1.raw
  modified_base (422)..(427): a, c, t, g, unknown or other
  misc_feature (422)..(427): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatacgnnnnnn

SEQ ID NO: 254851 - DNA, 427 bp, Homo sapiens
  misc_feature: GYAE6OF02G4PEU.30.45.E01.1.454.CMB.1.raw
  modified_base (421)..(427): a, c, t, g, unknown or other
  misc_feature (421)..(427): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaggactacttcctctctcgactctgagcgggctggcaaggcgcatagnnnnnnn

SEQ ID NO: 254852 - DNA, 425 bp, Homo sapiens; identical to SEQ ID NO: 254496
  misc_feature: GYAE6OF02G6Y8Y.30.45.E01.1.454.CMB.1.raw
  modified_base (422)..(425): a, c, t, g, unknown or other
  misc_feature (422)..(425): n is a, c, g, or t

SEQ ID NO: 254853 - DNA, 428 bp, Homo sapiens
  misc_feature: GYAE6OF02F9KO1.30.45.E01.1.454.CMB.1.raw
  modified_base (424)..(428): a, c, t, g, unknown or other
  misc_feature (424)..(428): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttcccccctggccaccctcctccaagagcacctctgggggcacagcagccctgggctgcctggtcaaggactacttccacgtagcgtgctgagcggggctggcaaggcgcatgnnnnn

SEQ ID NO: 254854 - DNA, 435 bp, Homo sapiens
  misc_feature: GYAE6OF02IWO08.30.45.E01.1.454.CMB.1.raw
  modified_base (335)..(335): a, c, t, g, unknown or other
  misc_feature (335)..(335): n is a, c, g, or t
  modified_base (427)..(435): a, c, t, g, unknown or other
  misc_feature (427)..(435): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagngcacctctgggggcacagcagcccctgggctcgcctggtcaaggactacttccctcgtagcactctgagcgggctgggcaaggcgcagtagnnnnnnnnn

SEQ ID NO: 254855 - DNA, 429 bp, Homo sapiens
  misc_feature: GYAE6OF02IUZ62.30.45.E01.1.454.CMB.1.raw
  modified_base (425)..(429): a, c, t, g, unknown or other
  misc_feature (425)..(429): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactgggggccagggaaccctggtcgccgtctcctcagcctccaccaagggcccatcggtcttccccctggccaccctcctccaagagcaccctctcgggggcaccagcagccctgggctgcctggtcaaggactacttcctctctcgactctgagcggctggcaggcgcatagnnnnn

SEQ ID NO: 254856 - DNA, 427 bp, Homo sapiens
  misc_feature: GYAE6OF02HAAA6.30.45.E01.1.454.CMB.1.raw
  modified_base (421)..(427): a, c, t, g, unknown or other
  misc_feature (421)..(427): n is a, c, g, or t
tcagcacgctacgtcacgaccggtgctcgatttagtgagtcagtaagggaaggggctggagtggatttcatatattagtgctggtgctattaccatgaagtacgcagactctgtgaggggccgattcaccatttccagggacgacgccaagaaatcagtatatctacaaatgagtagcctgagagacgaggacacggctgtgtattactgtgcgggccgggagccactcggaccaccctacaccaagactactggggccagggaaccctggtcgccgtctcctcagcctccaccaagggcccatcggtcttccccctggccaccctcctccaagagcacctctggggcacagcagccctgggctgcctggtcaaggactacttccacgtagcgtgctgagcgggctggcaaggcgcatagnnnnnnn

SEQ ID NO: 254857 - DNA, 153 bp, Homo sapiens; identical to SEQ ID NO: 254586
  misc_feature: GYAE6OF02HN13J.30.45.E01.1.454.CMB.1.raw
  modified_base (153)..(153): a, c, t, g, unknown or other
  misc_feature (153)..(153): n is a, c, g, or t

SEQ ID NO: 254858 - DNA, 425 bp, Homo sapiens
  misc_feature: GYAE6OF02HNEFI.30.45.E01.1.454.CMB.1.raw
  modified_base (421)..(425): a, c, t, g, unknown or other
  misc_feature (421)..(425): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctggggcacagcagccctgggctgcctggtcaaggactacttccacgtagcgtgctgagcgggctggcaaggcgcatagnnnnn

SEQ ID NO: 254859 - DNA, 153 bp, Homo sapiens
  misc_feature: GYAE6OF02H5NNI.30.45.E01.1.454.CMB.1.raw
  modified_base (153)..(153): a, c, t, g, unknown or other
  misc_feature (153)..(153): n is a, c, g, or t
tcagcacgctacgtcacgaccggtgctcgatttagtgagtcagtaagggaaagggaccaaggtggaaatcaaacgaactgtggctgcaccatctgtcttcatcttcccaccctcctctactgctagtctgagcgggctggcaaggcgcatagn

SEQ ID NO: 254860 - DNA, 435 bp, Homo sapiens
  misc_feature: GYAE6OF02J21U9.30.45.E01.1.454.CMB.1.raw
  modified_base (426)..(435): a, c, t, g, unknown or other
  misc_feature (426)..(435): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggacccaccctacaccaagacctacgtgggggccgagggaacccctggtcgccggtctcctcagcctccaccagggccccatcggcttccccctggcaccctcctccaagagcacctctgggggcacagcagccctggctgcctggtcaaggctacttccacgtagcgtgctgagcgggctggcaaggcgcatagnnnnnnnnnn

SEQ ID NO: 254861 - DNA, 448 bp, Homo sapiens
  misc_feature: GYAE6OF02IM6OK.30.45.E01.1.454.CMB.1.raw
  modified_base (227)..(227): a, c, t, g, unknown or other
  misc_feature (227)..(227): n is a, c, g, or t
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
  modified_base (421)..(421): a, c, t, g, unknown or other
  misc_feature (421)..(421): n is a, c, g, or t
  modified_base (427)..(428): a, c, t, g, unknown or other
  misc_feature (427)..(428): n is a, c, g, or t
  modified_base (430)..(432): a, c, t, g, unknown or other
  misc_feature (430)..(432): n is a, c, g, or t
  modified_base (434)..(448): a, c, t, g, unknown or other
  misc_feature (434)..(448): n is a, c, g, or t
tcagcacgctacgtcacgaccggtgctcgatttagtgagtcagtaaggggaagggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtaattactgtgcgggccgggganccactcggaccaccctacaccaagactactggggccagggaaccctggtcgccgtctcctcagcctccaccaagggcccatcggtcttcccccgtggcaccctcctccaagagcacctctcgggggcacagcagccctgggctcgcctggtcaaggactactccacgtagcgtgctgngcgggntggcaaggcncatagnncnnngnnnnnnnnnnnnnnn

SEQ ID NO: 254862 - DNA, 428 bp, Homo sapiens
  misc_feature: GYAE6OF02G3ATZ.30.45.E01.1.454.CMB.1.raw
  modified_base (423)..(428): a, c, t, g, unknown or other
  misc_feature (423)..(428): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaacccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnn

SEQ ID NO: 254863 - DNA, 528 bp, Homo sapiens
  misc_feature: GYAE6OF02I8QYW.30.45.E01.1.454.CMB.1.raw
  modified_base (228)..(228): a, c, t, g, unknown or other
  misc_feature (228)..(228): n is a, c, g, or t
  modified_base (492)..(528): a, c, t, g, unknown or other
  misc_feature (492)..(528): n is a, c, g, or t
tcagcacgctacgtcacgaccggtgctcgatttagtgagtcagtaagggaaggggcgtggaggtggatttcatatattagtgctggtgctactaccattgaagtacgcagactctgtgaggggccgattcaccatttccagggacgacgccaagaaatcagtatatctacaaatgagtagcctgagagacgaggacacggctgtgtaattactgtgcgggccgggganccactcggaccacctacaccaagactactgggggccagggaaccctggtcgccgtctacctcacgcctcccaccaagggccccatccgggtcttcccccctggcctaacccctccgtaccaacggacgcacccgttctcggggggaccacgagccaacggttccccgtaggggcctgccccgttgggtaccaaagggacctacgttccaacggttacgcgttacgctggacgcggggtcctagggcaagggcgcgaataggtcnnnnnnnnnnnnnnnnnnnnnnnnnnnnnnnnnnnnn

SEQ ID NO: 254864 - DNA, 722 bp, Homo sapiens
  misc_feature: GYAE6OF02GHWQD.30.45.E01.1.454.CMB.1.raw
  modified_base (684)..(684): a, c, t, g, unknown or other
  misc_feature (684)..(684): n is a, c, g, or t
  modified_base (687)..(687): a, c, t, g, unknown or other
  misc_feature (687)..(687): n is a, c, g, or t
  modified_base (689)..(689): a, c, t, g, unknown or other
  misc_feature (689)..(689): n is a, c, g, or t
  modified_base (691)..(722): a, c, t, g, unknown or other
  misc_feature (691)..(722): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgtatcactacttcgaggacgacgacaaagaatcagtatatactaaacaagtgagtacgctagagagacggagacgacgctgtagttattacgtggtcgggccgggggaccggggacgacccgtaccggtacccggaaccccctaacccctaaccaaacccgaaacgtaaccttacgggtccgggggaccggaaccggggtaaccccggtcgggtcccggcccgttcccttccctcgaccgtcccctaccccgaaaccggaacccgggacccctacggttcccggtttccccccttccccccggcggtaccccctacccccttccccgtaaccgaaacggaccgaccctacccgttcggggtccggggaccaaccgacgaccgacccggtcccgggtacggggtccgttccggtccggtttacgggtaaccggtaaacgggtaaccctttaacccttacccggtaaacgggttacgggtccgggttacggtcggttaggggaaccgggggtcccggggtacgggtacgggaaccgggaaacggggccgtaacgtaaggtacgncgngncnnnnnnnnnnnnnnnnnnnnnnnnnnnnnnnn

SEQ ID NO: 254865 - DNA, 438 bp, Homo sapiens
  misc_feature: GYAE6OF02HHB8T.30.45.E01.1.454.CMB.1.raw
  modified_base (423)..(423): a, c, t, g, unknown or other
  misc_feature (423)..(423): n is a, c, g, or t
  modified_base (429)..(438): a, c, t, g, unknown or other
  misc_feature (429)..(438): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccacgtcggaccaccctacaccaagactactggggccagggaaccctggtcgccgtctcctcagcctccaccagggcccatcggtcttccccctggcacccgtcctccaagacgcaccctcgtgggggcacagcacgcccctgggctcgcctggtcaaggactacttccacgtagcgtgctgagcgggctgggcaaggcncatagnnnnnnnnnn

SEQ ID NO: 254866 - DNA, 435 bp, Homo sapiens
  misc_feature: GYAE6OF02HQZSN.30.45.E01.1.454.CMB.1.raw
  modified_base (426)..(435): a, c, t, g, unknown or other
  misc_feature (426)..(435): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcaccctctgggggcacagcagccctgggctgcctggtcaaggactacttcctctcctcgactctgagcgggctggcaaggcgcatacgnnnnnnnnnn

SEQ ID NO: 254867 - DNA, 444 bp, Homo sapiens
  misc_feature: GYAE6OF02I7T3Z.30.45.E01.1.454.CMB.1.raw
  modified_base (433)..(444): a, c, t, g, unknown or other
  misc_feature (433)..(444): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccaggggacgacgccaagaaatcagtatatctaacaaatgagtagcctgagagacgaggacacggctgtgtattactgtgcggggccgggagccactcggaccaccctacaccaagactacgtggggccgagggaaccctggtcgccgtctcctcagcctccaccaagggcccatcggtcttccccctggcacccctcctccaagagcaccctctgggggcacagcagccctgggcctgccgtggtcaaggactacttccacgtagcgtgcgtgaggcgggctggcgaaggcgcatagnnnnnnnnnnnn

SEQ ID NO: 254868 - DNA, 434 bp, Homo sapiens
  misc_feature: GYAE6OF02HSBM1.30.45.E01.1.454.CMB.1.raw
  modified_base (402)..(402): a, c, t, g, unknown or other
  misc_feature (402)..(402): n is a, c, g, or t
  modified_base (428)..(434): a, c, t, g, unknown or other
  misc_feature (428)..(434): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccagactactggggccagggaaccctggtcgccgtctcctcagcctccaccaagggccccatccggtccttccccctggccaccctcctccaagacgccacctcgtcgggggcacagcagccctgggctgcctggtcaaggactacttccacgtagcgngctgagcgggctggcaggcgcatagnnnnnnn

SEQ ID NO: 254869 - DNA, 525 bp, Homo sapiens
  misc_feature: GYAE6OF02JOZSN.30.45.E01.1.454.CMB.1.raw
  modified_base (319)..(319): a, c, t, g, unknown or other
  misc_feature (319)..(319): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
  modified_base (492)..(525): a, c, t, g, unknown or other
  misc_feature (492)..(525): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccacgtcggaccaccctacaccaagactacgtggggccgaggaaccctggtcgccgtctcctcagcctccaccaagggcccactcggtctcccccnggccaccctcctccaagacgccacctcgtcgggggccacgacgccgacgccccgtggggcctcgcccgtcggtacgaacggaccttacctttccctacctccgtccgtaaccttccgttaggacggccggggcgttcgggacggtaacgggcggccgaacgtacggtancncnnnnnnnnnnnnnnnnnnnnnnnnnnnnnnnnnn

SEQ ID NO: 254870 - DNA, 432 bp, Homo sapiens
  misc_feature: GYAE6OF02GKJ82.30.45.E01.1.454.CMB.1.raw
  modified_base (424)..(432): a, c, t, g, unknown or other
  misc_feature (424)..(432): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggccccatcggtcttccccctggccaccctcctccaagagcacctctgggggcacagcagccctgggctgcctggtcaaggactacttccacgtagcgtgctgagcgggctggcaaggcgcatagnnnnnnnnn

SEQ ID NO: 254871 - DNA, 428 bp, Homo sapiens; identical to SEQ ID NO: 254844
  misc_feature: GYAE6OF02GI1XK.30.45.E01.1.454.CMB.1.raw
  modified_base (423)..(428): a, c, t, g, unknown or other
  misc_feature (423)..(428): n is a, c, g, or t

SEQ ID NO: 254872 - DNA, 435 bp, Homo sapiens
  misc_feature: GYAE6OF02ITIXX.30.45.E01.1.454.CMB.1.raw
  modified_base (428)..(435): a, c, t, g, unknown or other
  misc_feature (428)..(435): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagccctccaccaagggcccatcgggtcttccccctggccaccctcctccaagagcaccctctgggggcacagcagccctggggctgcctggtcaaggactacttcctctctcgactctgagcgggctggcaaggcgcatagnnnnnnnn

SEQ ID NO: 254873 - DNA, 154 bp, Homo sapiens; identical to SEQ ID NO: 254651
  misc_feature: GYAE6OF02HLFV8.30.45.E01.1.454.CMB.1.raw
  modified_base (153)..(154): a, c, t, g, unknown or other
  misc_feature (153)..(154): n is a, c, g, or t

SEQ ID NO: 254874 - DNA, 442 bp, Homo sapiens
  misc_feature: GYAE6OF02FXQ5G.30.45.E01.1.454.CMB.1.raw
  modified_base (425)..(442): a, c, t, g, unknown or other
  misc_feature (425)..(442): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactgggggccagggaaccctggtcgccggtctcctcagcctccaccaagggcccatcggtcttccccctggccaccctcctccaagagcacctctgggggcacagcagccctgggctgcctggtcaaggactacttccacgtagcgtgctgagcgggctgggcaaggcgcatgnnnnnnnnnnnnnnnnnn

SEQ ID NO: 254875 - DNA, 432 bp, Homo sapiens
  misc_feature: GYAE6OF02HD18J.30.45.E01.1.454.CMB.1.raw
  modified_base (426)..(432): a, c, t, g, unknown or other
  misc_feature (426)..(432): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccaatcggtcttccccctggcacccctcctccaagacgcacctctcgggggcacagcagccctgggctgcctggtcaaggactacttccacgtagcgtgctgagcgggctggcaaggcgcatagnnnnnnn

SEQ ID NO: 254876 - DNA, 427 bp, Homo sapiens
  misc_feature: GYAE6OF02IFKTP.30.45.E01.1.454.CMB.1.raw
  modified_base (422)..(427): a, c, t, g, unknown or other
  misc_feature (422)..(427): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctgtcgccgtctcctcagcctccaccaagggcccatcggtcttccccctggcaccctcctccaagagcacctctgggggcacagcacgccctgggctcgcctggtcaaggactacttccacgtagcgtgctgagcgggctggcaggcgcatgnnnnnn

SEQ ID NO: 254877 - DNA, 464 bp, Homo sapiens
  misc_feature: GYAE6OF02HF967.30.45.E01.1.454.CMB.1.raw
  modified_base (430)..(430): a, c, t, g, unknown or other
  misc_feature (430)..(430): n is a, c, g, or t
  modified_base (433)..(433): a, c, t, g, unknown or other
  misc_feature (433)..(433): n is a, c, g, or t
  modified_base (435)..(436): a, c, t, g, unknown or other
  misc_feature (435)..(436): n is a, c, g, or t
  modified_base (439)..(439): a, c, t, g, unknown or other
  misc_feature (439)..(439): n is a, c, g, or t
  modified_base (441)..(441): a, c, t, g, unknown or other
  misc_feature (441)..(441): n is a, c, g, or t
  modified_base (443)..(443): a, c, t, g, unknown or other
  misc_feature (443)..(443): n is a, c, g, or t
  modified_base (445)..(446): a, c, t, g, unknown or other
  misc_feature (445)..(446): n is a, c, g, or t
  modified_base (449)..(449): a, c, t, g, unknown or other
  misc_feature (449)..(449): n is a, c, g, or t
  modified_base (451)..(464): a, c, t, g, unknown or other
  misc_feature (451)..(464): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgagggcacggctgtgtattactgtgcggggccggggagccactcggaccaccctacaccaagactactggggccagggaaccctggtcgccgtctcctcagcctccaccaagggcccatcggtcttcccccctggccaccctcctccaacgagccacctctgggggcacagcagccctgggctgcctggtcaaggactacttcctctctcgactctgagcgggctggcaacggcgcagtacgncgncnntcngngngnngcngnnnnnnnnnnnnnn

SEQ ID NO: 254878 - DNA, 429 bp, Homo sapiens; identical to SEQ ID NO: 254843
  misc_feature: GYAE6OF02HZBQY.30.45.E01.1.454.CMB.1.raw
  modified_base (423)..(429): a, c, t, g, unknown or other
  misc_feature (423)..(429): n is a, c, g, or t

SEQ ID NO: 254879 - DNA, 435 bp, Homo sapiens
  misc_feature: GYAE6OF02JZZHK.30.45.E01.1.454.CMB.1.raw
  modified_base (202)..(202): a, c, t, g, unknown or other
  misc_feature (202)..(202): n is a, c, g, or t
  modified_base (426)..(435): a, c, t, g, unknown or other
  misc_feature (426)..(435): n is a, c, g, or t
tcagcacgctacgtcacgaccggtgctcgatttagtgagtcagtaagggaaggggcgtggagtggatttcatatattagtgctggtgctactaccatgaagtacgcagactctgtgaggggccgattcaccatttccagggacgacgccaagaaatcagtatatctacaaatgagtagcctgagagacgaggacacggctgngtattactgtgcgggccggggagccactcgggaccaccctacaccaagactactggggccagggaaccctggtcgccgtctcctcagcctccaccaagggcccatcggtcttcccccctggccaccctcctccaagacgcacctctggggcacacgcagccctgggctgacctggtcaaggctacttccacgtagccgtgctgagcgggctggcagcgcatagnnnnnnnnnn

SEQ ID NO: 254880 - DNA, 440 bp, Homo sapiens
  misc_feature: GYAE6OF02G9MDK.30.45.E01.1.454.CMB.1.raw
  modified_base (429)..(440): a, c, t, g, unknown or other
  misc_feature (429)..(440): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactggtgcgggccgggggagccactcggaccaccctacaccaagactactggggccagggaaccctggtcgccgtctcctcagcctccaccaagggcccatcggtcttccccctggccaccctcctccaagagcacctctgggggcacagcacgcccgtgggctgccgtggtcaacggactactccacgtagcgtgctgacgcgggctggcaggcgcatagcnnnnnnnnnnnn

SEQ ID NO: 254881 - DNA, 427 bp, Homo sapiens
  misc_feature: GYAE6OF02I4HJU.30.45.E01.1.454.CMB.1.raw
  modified_base (423)..(427): a, c, t, g, unknown or other
  misc_feature (423)..(427): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactacgtggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnn

SEQ ID NO: 254882 - DNA, 430 bp, Homo sapiens
  misc_feature: GYAE6OF02FFC90.30.45.E01.1.454.CMB.1.raw
  modified_base (224)..(224): a, c, t, g, unknown or other
  misc_feature (224)..(224): n is a, c, g, or t
  modified_base (424)..(430): a, c, t, g, unknown or other
  misc_feature (424)..(430): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggganccactcggaccaccctacaccaagacctactgggggccagggaaccctggtcgccgtctcctcagcctccaccagggcccatcggtcttccccctggcaccctcctccaagacgcacctctcgggggcacagcagccctgggctcgcctggtcaaggactacttccacgtagcgtgctgagcggctggcaggcgcatagnnnnnnn

SEQ ID NO: 254883 - DNA, 435 bp, Homo sapiens
  misc_feature: GYAE6OF02HGBRM.30.45.E01.1.454.CMB.1.raw
  modified_base (426)..(435): a, c, t, g, unknown or other
  misc_feature (426)..(435): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtccttccccctggccaccctcctccaagacgcaccctctgggggcacagcagccctgggctgcctggtcaaggactactccacgtacgcgtgctgagcgggctggcaaggcgcatagnnnnnnnnnn

SEQ ID NO: 254884 - DNA, 426 bp, Homo sapiens
  misc_feature: GYAE6OF02II2DP.30.45.E01.1.454.CMB.1.raw
  modified_base (422)..(426): a, c, t, g, unknown or other
  misc_feature (422)..(426): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaaggcccatcggtcttccccctggccaccctcctccaagagcaccctctgggggcacagcagccctgggctgcctggtcaaggactacttcctctctcgactctgagcgggctggcaggcgcatagnnnnn

SEQ ID NO: 254885 - DNA, 172 bp, Homo sapiens
  misc_feature: GYAE6OF02G8UO7.30.45.E01.1.454.CMB.1.raw
  modified_base (152)..(172): a, c, t, g, unknown or other
  misc_feature (152)..(172): n is a, c, g, or t
tcagcacgctacgtcacgaccggtgctcgatttagtgagtcagtaagggaaagggaccaaggtggaaatcaaacgaactgtggctgcaccatctgtcttcatcttcccaccctctctactgctagtctgagcgggctggcaaggcgcatagnnnnnnnnnnnnnnnnnnnnn

SEQ ID NO: 254886 - DNA, 428 bp, Homo sapiens
  misc_feature: GYAE6OF02IK15P.30.45.E01.1.454.CMB.1.raw
  modified_base (423)..(428): a, c, t, g, unknown or other
  misc_feature (423)..(428): n is a, c, g, or t
tcagcacgctacgtcacgaccggtgctcgatttagtgagtcagtaagggaaggggctggagtggatttcatatattagtgctggtgctactaccatgaagtacacagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtccttccccctggccaccctccctccaagagcacctctgggggcacagcagccctggctgcctggtcaaggctacttccacgtagcgtgctgagcgggctggcaaggcgcatagnnnnnn

SEQ ID NO: 254887 - DNA, 428 bp, Homo sapiens
  misc_feature: GYAE6OF02IDAER.30.45.E01.1.454.CMB.1.raw
  modified_base (415)..(415): a, c, t, g, unknown or other
  misc_feature (415)..(415): n is a, c, g, or t
  modified_base (421)..(428): a, c, t, g, unknown or other
  misc_feature (421)..(428): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactgggccagggaaccctggtcgccgtctcctcagcctccaccaagggcccatcggtcttccccctggcaccctcctccaagagcacctctggggcacagcagccctgggctgcctggtcaaggactacttcctctctcgactctgagcgggctggcaaggcncatagnnnnnnnn

SEQ ID NO: 254888 - DNA, 442 bp, Homo sapiens
  misc_feature: GYAE6OF02ISWD5.30.45.E01.1.454.CMB.1.raw
  modified_base (428)..(429): a, c, t, g, unknown or other
  misc_feature (428)..(429): n is a, c, g, or t
  modified_base (431)..(442): a, c, t, g, unknown or other
  misc_feature (431)..(442): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagacgcaccctctcgggggcacagcagccctgggctgcctggtcaagggactacttcctctctcgactctgagcgggctggcaaggcgacataggnngnnnnnnnnnnnn

SEQ ID NO: 254889 - DNA, 440 bp, Homo sapiens
  misc_feature: GYAE6OF02HV5FR.30.45.E01.1.454.CMB.1.raw
  modified_base (430)..(440): a, c, t, g, unknown or other
  misc_feature (430)..(440): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaaagaaatcagtatatctaacaaatgagtagcctgagagacgaggacacggctgtgtattactgtgcgggccgggagccactcggaccaccctacacaaagactactggggccagggaaccctggtcgccgtctcctcagcctccaccaaggcccatcggtccttccccctggccaccctcctccaagacgccacctcgtggggcacagcacgccctgggctcgcctggtcaaggactacttccacgtagcgtgctgagcgggctggcgaaggcacagtagnnnnnnnnnnn

SEQ ID NO: 254890 - DNA, 506 bp, Homo sapiens
  misc_feature: GYAE6OF02I7DTZ.30.45.E01.1.454.CMB.1.raw
  modified_base (470)..(506): a, c, t, g, unknown or other
  misc_feature (470)..(506): n is a, c, g, or t
tcagcacgctacgtcacgaccggtgctcgatttagtgagtcagtaagggaaggggctggaggtgggatttcatatattagtgctggtgctactaccatgaagtacgcagactctcgtgaggggccgattcaccatttccagggacgacgccaagaaatcagtatatctacaaatgagtagcctgagagacgaggaccacggctgtgtattactgtgcgggccgggagccacgtcggacccaccctacacccaagacctaactggggccagggaaccctggtcgccgtctcctcagccctccaccgaacgggccccatcggtccttccccctgggccaccctccctccaacgagccaccctcgtcgggggcactagcacgccccgtgggctcgccgtcggtcaaaggtactacttcccgacgtacgcgtagcctaggacggcgggctcgggaccaaagggcgacagtacgnnnnnnnnnnnnnnnnnnnnnnnnnnnnnnnnnnnnn

SEQ ID NO: 254891 - DNA, 426 bp, Homo sapiens
  misc_feature: GYAE6OF02F6471.30.45.E01.1.454.CMB.1.raw
  modified_base (422)..(426): a, c, t, g, unknown or other
  misc_feature (422)..(426): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggccaccctcctccaagagcacctctgggggcacagcagccctgggctgcctggtcaaggactacttccacgtagcgtgctgagcgggctggcaggcgcatagnnnnn

SEQ ID NO: 254892 - DNA, 428 bp, Homo sapiens
  misc_feature: GYAE6OF02GYSUO.30.45.E01.1.454.CMB.1.raw
  modified_base (423)..(428): a, c, t, g, unknown or other
  misc_feature (423)..(428): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactgggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnn

SEQ ID NO: 254893 - DNA, 201 bp, Homo sapiens
  misc_feature: GYAE6OF02GIKVR.30.45.E01.1.454.CMB.1.raw
  modified_base (161)..(201): a, c, t, g, unknown or other
  misc_feature (161)..(201): n is a, c, g, or t
tcagcacgctacgtcacgaccggtgctcgatttagtgagtcagtaaggggaaagggaccggaaggtggaaatcaaacgaactgtggctgcaccatctgtcttcatcttcccggccatctgaacgtagcgtgcctgagcgggctgggcaaggcgcagtacgnnnnnnnnnnnnnnnnnnnnnnnnnnnnnnnnnnnnnnnnn

SEQ ID NO: 254894 - DNA, 427 bp, Homo sapiens
  misc_feature: GYAE6OF02GFLTX.30.45.E01.1.454.CMB.1.raw
  modified_base (423)..(427): a, c, t, g, unknown or other
  misc_feature (423)..(427): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccactcggaccaccctacaccaagactactggggccagggaaccctggtcgccgtctcctcagcctccaccaagggcccatcggtcttccccctggcaccctcctccaacgagcacctctgggggcacagcacgccctgggctgcctggtcaaggactacttccacgtagcgtgctgagcgggctggcaaggcgcatagnnnnn

SEQ ID NO: 254895 - DNA, 446 bp, Homo sapiens
  misc_feature: GYAE6OF02GXHVP.30.45.E01.1.454.CMB.1.raw
  modified_base (423)..(423): a, c, t, g, unknown or other
  misc_feature (423)..(423): n is a, c, g, or t
  modified_base (425)..(446): a, c, t, g, unknown or other
  misc_feature (425)..(446): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagacgcacctctcgggggcacgagcagccctgggctgcctggtcaaggactacttccacgtagcgtgctgagcggctggcaggcgcatagngnnnnnnnnnnnnnnnnnnnnnn

SEQ ID NO: 254896 - DNA, 520 bp, Homo sapiens
  misc_feature: GYAE6OF02HIU0G.30.45.E01.1.454.CMB.1.raw
  modified_base (481)..(481): a, c, t, g, unknown or other
  misc_feature (481)..(481): n is a, c, g, or t
  modified_base (483)..(520): a, c, t, g, unknown or other
  misc_feature (483)..(520): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggcgggagccactcggaccaccctacaccaagactactggggccagggaacccctggtcgccgtctcctcagcctccaccaagggcccatcggtccttcccccctggccacccctccctccaagacgccaccctcgtcgggggccacacgcacgcccgtggggcctcgccgttggtcgaaacgggtaccttaacctttcccaaccggtacgcgttacgtccgtggacggccggggccgtgggacccgaaagggccgctaagtacggngnnnnnnnnnnnnnnnnnnnnnnnnnnnnnnnnnnnnnn

SEQ ID NO: 254897 - DNA, 741 bp, Homo sapiens
  misc_feature: GYAE6OF02FZMFJ.30.45.E01.1.454.CMB.1.raw
  modified_base (625)..(625): a, c, t, g, unknown or other
  misc_feature (625)..(625): n is a, c, g, or t
tcagcacgctacgtcacgaccggtgctcgatttagtgagtcagtaagggaaggggtcgtcggaagtggactttccagtatattacgtgctggtgctacctaccatgaagtacgcagactctgtgacggggtcccgagttcaccatttccaggggacgacgcctaagaaactcacgtatatctaacaagtgagtagcctgagagacgaggacacggctggtgtattactggtgccgggcgggagccgactcggaccacctactaccaagactactggggccagggaacccgtggtcgaccgtcgtccctgagccgtccaccgaacgggcccatccgggtaccttcccccgtgggacctaccccgtcccgtacccgaaaggacgtccgaacccgttaccgttcggggggggaccaacgaacggtaccaaacgggccccgttaagggggtccttccggtcccgtttacgggtacccgaaacggggaaccctttaccgttaccccgtaaccggttaacggtcccggttaacgggcccttacgggtaaacggtcccggggggtaaccgttcggggaacccgtaaacggggcccgggtaactaaaccggttaagggacaggacgacgtacnctacgtactagcgcgcgtcgtacggtagtactagtacgtcgtagtagtacgtacgtacgtcgtcggtacgtacgtacgtacgtacgtacgcgtacgacgtaccgtccgtacgaccg

SEQ ID NO: 254898 - DNA, 450 bp, Homo sapiens
  misc_feature: GYAE6OF02ISQXC.30.45.E01.1.454.CMB.1.raw
  modified_base (224)..(224): a, c, t, g, unknown or other
  misc_feature (224)..(224): n is a, c, g, or t
  modified_base (284)..(284): a, c, t, g, unknown or other
  misc_feature (284)..(284): n is a, c, g, or t
  modified_base (435)..(450): a, c, t, g, unknown or other
  misc_feature (435)..(450): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggganccactcggaccaccctacaccaagactactggggccagggaaccctggtcgccgtctccncacgcctccaccaagggcccagtcggtccttccccctggccacccctcctccaacgagccacccgtcgtgggggccacgagcagccctgggctgcctggtcaaggctacttccacgtagcgtgctgaggcgggctggcaaggcgcagtagnnnnnnnnnnnnnnnn

SEQ ID NO: 254899 - DNA, 438 bp, Homo sapiens
  misc_feature: GYAE6OF02JAO2M.30.45.E01.1.454.CMB.1.raw
  modified_base (212)..(212): a, c, t, g, unknown or other
  misc_feature (212)..(212): n is a, c, g, or t
  modified_base (222)..(222): a, c, t, g, unknown or other
  misc_feature (222)..(222): n is a, c, g, or t
  modified_base (247)..(247): a, c, t, g, unknown or other
  misc_feature (247)..(247): n is a, c, g, or t
  modified_base (337)..(337): a, c, t, g, unknown or other
  misc_feature (337)..(337): n is a, c, g, or t
  modified_base (419)..(438): a, c, t, g, unknown or other
  misc_feature (419)..(438): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgngcgggccggngccagtcggacacctagacagctangggccaggaaccctggtcgccgtctcctcagcctccaccaagggcccatcggtcttccccctggccaccctcctccaagacgccacctcncggggcacagcacgccctgggctgctcggcaagggactacttcctctcgtagactctgacgcggctggccaggcacgatcgnnnnnnnnnnnnnnnnnnnn

SEQ ID NO: 254900 - DNA, 435 bp, Homo sapiens
  misc_feature: GYAE6OF02IKSM0.30.45.E01.1.454.CMB.1.raw
  modified_base (425)..(435): a, c, t, g, unknown or other
  misc_feature (425)..(435): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactacgtggggccagggaaccctggtcgccgtctcctcagcctccaccaagggcccatcggtcttccccctggcaccctcctccaagagcacctctgggggcacagcacgccctgggctgcctggtcaaggactacttcctctctcgactctgagcgggctggcaggcgcatacgnnnnnnnnnnn

SEQ ID NO: 254901 - DNA, 461 bp, Homo sapiens
  misc_feature: GYAE6OF02JFZC3.30.45.E01.1.454.CMB.1.raw
  modified_base (430)..(430): a, c, t, g, unknown or other
  misc_feature (430)..(430): n is a, c, g, or t
  modified_base (439)..(439): a, c, t, g, unknown or other
  misc_feature (439)..(439): n is a, c, g, or t
  modified_base (445)..(461): a, c, t, g, unknown or other
  misc_feature (445)..(461): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggggagccactcggaccaccctacaccaagactactggggccagggaaccctggtcgccgtctcctcagccctccaccaagggcccatcggtccttcccccctcgggccacccctcctcccaacgacgccaccctctcggggggccacgacgccaggcccctggggctgccctggtccaagggactacttcctctctcgactctgagcggntggcaggcncatagnnnnnnnnnnnnnnnnn

SEQ ID NO: 254902 - DNA, 163 bp, Homo sapiens
  misc_feature: GYAE6OF02FTTHI.30.45.E01.1.454.CMB.1.raw
  modified_base (152)..(163): a, c, t, g, unknown or other
  misc_feature (152)..(163): n is a, c, g, or t
tcagcacgctacgtcacgaccggtgctcgatttagtgagtcagtaagggaagggaccaaggtggaaatcaaacgaactgtggctgcaccatctgtcttcatcttcccgccatctgatatacgatcgctgagcgggctggcaaggcgcatagnnnnnnnnnnnn

SEQ ID NO: 254903 - DNA, 439 bp, Homo sapiens
  misc_feature: GYAE6OF02FL461.30.45.E01.1.454.CMB.1.raw
  modified_base (424)..(424): a, c, t, g, unknown or other
  misc_feature (424)..(424): n is a, c, g, or t
  modified_base (429)..(439): a, c, t, g, unknown or other
  misc_feature (429)..(439): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcacgcctccaccaagggcccatcggtcttccccctggccaccctccctccaagacgcacctctgggggcacagcagcccgtgggctgccgtggtcaaggactaacgttccacgtagcgtgctgagcgggctggcaaggcncatgnnnnnnnnnnn

SEQ ID NO: 254904 - DNA, 439 bp, Homo sapiens
  misc_feature: GYAE6OF02ISNES.30.45.E01.1.454.CMB.1.raw
  modified_base (429)..(439): a, c, t, g, unknown or other
  misc_feature (429)..(439): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactgggccagggaaccctggtcgccgtctcctcagcctccaccaagggcccatcggtcttccccctggccaccctcctccaacgagcaccctctcgggggcacgagcacgccctgggctcgcctggtcaaggactacttcctcgtagcactctgacgcgggctggcaaggcgcatagnnnnnnnnnnn

SEQ ID NO: 254905 - DNA, 440 bp, Homo sapiens
  misc_feature: GYAE6OF02IMQ9N.30.45.E01.1.454.CMB.1.raw
  modified_base (355)..(355): a, c, t, g, unknown or other
  misc_feature (355)..(355): n is a, c, g, or t
  modified_base (426)..(440): a, c, t, g, unknown or other
  misc_feature (426)..(440): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccacgtcggaccaccctacaccaagactactggggccagggaaccctggtcgccgtctcctcagccctccaccaagggcccatcggtcttccccctggcaccctcctccaagagcaccctctgggggcacngcagccctgggctgccgtggtcaaggactactcacgtagcgtgctgagcgggctgcgaaggcgcagtacgnnnnnnnnnnnnnnn

SEQ ID NO: 254906 - DNA, 430 bp, Homo sapiens
  misc_feature: GYAE6OF02HP6ED.30.45.E01.1.454.CMB.1.raw
  modified_base (424)..(430): a, c, t, g, unknown or other
  misc_feature (424)..(430): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccacgactactggggccagggaacccctggtcgcccggtctcctcagcctccaccaagggccccatcggtcttccccctggcaccctcctccaagagcacctctgggggcacagcagccctgggctgcctggtcaaggctacttccacgtagcgtgctgagcgggctggcaggcgcatagnnnnnnn

SEQ ID NO: 254907 - DNA, 448 bp, Homo sapiens
  misc_feature: GYAE6OF02HVU95.30.45.E01.1.454.CMB.1.raw
  modified_base (434)..(448): a, c, t, g, unknown or other
  misc_feature (434)..(448): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactacgtggggccgacgggaaccctggtcgccgtctccctcacgcctccaccaacgggcccatccggtcttccccctggccaccctcctccagacgcacctcgtcggggcacacgcacgccctggctgcctggcaaggactactccacgtagcgtcgctgacgcgggcgtggcgaaggcgcatagnnnnnnnnnnnnnnn

SEQ ID NO: 254908 - DNA, 214 bp, Homo sapiens
  misc_feature: GYAE6OF02FR59T.30.45.E01.1.454.CMB.1.raw
  modified_base (152)..(214): a, c, t, g, unknown or other
  misc_feature (152)..(214): n is a, c, g, or t
tcagcacgctacgtcacgaccggtgctcgatttagtgagtcagtaagggaaagggaccaaggtggaaatcaaacgaactgtggctgcaccatctgtcttcatcttcccacctcctctactgctagtctgagcgggctggcaaggcgcatagnnnnnnnnnnnnnnnnnnnnnnnnnnnnnnnnnnnnnnnnnnnnnnnnnnnnnnnnnnnnnnn

SEQ ID NO: 254909 - DNA, 433 bp, Homo sapiens
  misc_feature: GYAE6OF02G3SZC.30.45.E01.1.454.CMB.1.raw
  modified_base (336)..(336): a, c, t, g, unknown or other
  misc_feature (336)..(336): n is a, c, g, or t
  modified_base (424)..(433): a, c, t, g, unknown or other
  misc_feature (424)..(433): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggccaccctcctccaagngcacctctggggcacagcacgccctgggctgcctggtcaaggctacttccacgtagcgtgctgacgcgggctgggcaaggcgcatagnnnnnnnnnn

SEQ ID NO: 254910 - DNA, 436 bp, Homo sapiens
  misc_feature: GYAE6OF02HG7FI.30.45.E01.1.454.CMB.1.raw
  modified_base (426)..(436): a, c, t, g, unknown or other
  misc_feature (426)..(436): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccactcggaccaccctacaccaagactactggggccagggaaccctggtcgccgtctcctcagcctccaccaagggcccatcggtcttccccctggccaccctcctccaagagcacctcgtggggcacagcacgccctggggctgcctggtcaaggactacttccacgtagcgtgctgagcgggctggcgaaggcgcatacgnnnnnnnnnnn

SEQ ID NO: 254911 - DNA, 437 bp, Homo sapiens
  misc_feature: GYAE6OF02JC891.30.45.E01.1.454.CMB.1.raw
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (429)..(437): a, c, t, g, unknown or other
  misc_feature (429)..(437): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccactcggaccaccctacaccaagactactggggccagggaaccctggtcgccgtctcctcagcctccaccaagggcccatcggtaccttccccctggccacccgtcctcccaagacgccacctcgtgggggcacacgcagccctgggctcgcctggtcaaggactacttccacgtagcgtgctgagcggatggcaggcncanagnnnnnnnnn

SEQ ID NO: 254912 - DNA, 453 bp, Homo sapiens
  misc_feature: GYAE6OF02G82AX.30.45.E01.1.454.CMB.1.raw
  modified_base (438)..(453): a, c, t, g, unknown or other
  misc_feature (438)..(453): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagacctacgtggggccagggaaccctggtcgccgtctcctcagccctccaccaacgggcccatcggtccttccccctggccaccctcctccaagcgcacctcgtcgggggcacagcacgcccgtgggctcgcctggtcaaggactacttcccacgtacgtcgtgcgtgaggcgggctggcaggcgcagtagnnnnnnnnnnnnnnnn

SEQ ID NO: 254913 - DNA, 456 bp, Homo sapiens
  misc_feature: GYAE6OF02FFTM9.30.45.E01.1.454.CMB.1.raw
  modified_base (225)..(225): a, c, t, g, unknown or other
  misc_feature (225)..(225): n is a, c, g, or t
  modified_base (423)..(424): a, c, t, g, unknown or other
  misc_feature (423)..(424): n is a, c, g, or t
  modified_base (426)..(456): a, c, t, g, unknown or other
  misc_feature (426)..(456): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggganccactcggaccaccctacaccaagactactgggggccagggaaccctggtcgccgtctcctcacgcctccaccaagggccccatcggtcttccccctggcaccctcctccaagagcacctctgggggcacagcagccctgggctgcctggcaaggctacttcctctctcgctctgagcgggctggcaaggcgcatagnncnnnnnnnnnnnnnnnnnnnnnnnnnnnnnnn

SEQ ID NO: 254914 - DNA, 448 bp, Homo sapiens
  misc_feature: GYAE6OF02FSC0U.30.45.E01.1.454.CMB.1.raw
  modified_base (356)..(356): a, c, t, g, unknown or other
  misc_feature (356)..(356): n is a, c, g, or t
  modified_base (430)..(448): a, c, t, g, unknown or other
  misc_feature (430)..(448): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactgggggccagggaaccctggtcgccgtctcctcagcctccaccaagggcccatcggtccttccccctggccaccctcctccaagacgcacctctgggggcacngcagcccgtgggctgcctggtcaaggactactccacgtagcgtgctggacgcgggctggcgaaggcgcagtagnnnnnnnnnnnnnnnnnnn

SEQ ID NO: 254915 - DNA, 463 bp, Homo sapiens
  misc_feature: GYAE6OF02HXAZY.30.45.E01.1.454.CMB.1.raw
  modified_base (436)..(436): a, c, t, g, unknown or other
  misc_feature (436)..(436): n is a, c, g, or t
  modified_base (443)..(463): a, c, t, g, unknown or other
  misc_feature (443)..(463): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggcggggagccactcggacaccctacaccaagactactggggccagggaaccctggtcgcccgtctcctcacgccctccacccgaacgggcccagtccggtccttccccctggccaccctcctccaacgacgccacctcgtgggggcacgagcacgcccgtggctcgcctggtcaacggtactacttcctctctcgactctgacgcgggctggactagggcncagtagnnnnnnnnnnnnnnnnnnnnn

SEQ ID NO: 254916 - DNA, 445 bp, Homo sapiens
  misc_feature: GYAE6OF02HTPXP.30.45.E01.1.454.CMB.1.raw
  modified_base (335)..(335): a, c, t, g, unknown or other
  misc_feature (335)..(335): n is a, c, g, or t
  modified_base (432)..(445): a, c, t, g, unknown or other
  misc_feature (432)..(445): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaaggcccatcggtcttccccctggccaccctcctccaagngccacctcgtgggggcacagcagccccgtgggctgcctggtcaaggactacttcctctctcgactctggagcgggctcgggcaagggcgcagtacgnnnnnnnnnnnnnn

SEQ ID NO: 254917 - DNA, 431 bp, Homo sapiens
  misc_feature: GYAE6OF02I4NEB.30.45.E01.1.454.CMB.1.raw
  modified_base (337)..(337): a, c, t, g, unknown or other
  misc_feature (337)..(337): n is a, c, g, or t
  modified_base (425)..(431): a, c, t, g, unknown or other
  misc_feature (425)..(431): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgtggggccggggagccactcggaccaccctacaccaagactactggggccagggaaccctggtcgccgtctcctcagcctccaccaagggcccatcggtcttccccctggccaccctcctccaagngcacctctgggggcacagcacgccctgggctgcctggtcaaggactacttccacgtagcgtgctgagcgggctggcaaggcgcatagnnnnnnn

SEQ ID NO: 254918 - DNA, 430 bp, Homo sapiens
  misc_feature: GYAE6OF02HAWSS.30.45.E01.1.454.CMB.1.raw
  modified_base (426)..(430): a, c, t, g, unknown or other
  misc_feature (426)..(430): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacacccacgactactggggccagggaaccctggtcgccgtctcctcagcctccaccaagggcccatcggtcttccccctcggcaccctcctccaagagcacctctgggggcacagcacgccctgggctgcctggtcaaggactacttccacgtagcgtgctgacgcgggctggcaaggcgcatagnnnnn

SEQ ID NO: 254919 - DNA, 429 bp, Homo sapiens
  misc_feature: GYAE6OF02IN3EC.30.45.E01.1.454.CMB.1.raw
  modified_base (348)..(348): a, c, t, g, unknown or other
  misc_feature (348)..(348): n is a, c, g, or t
  modified_base (356)..(356): a, c, t, g, unknown or other
  misc_feature (356)..(356): n is a, c, g, or t
  modified_base (403)..(403): a, c, t, g, unknown or other
  misc_feature (403)..(403): n is a, c, g, or t
  modified_base (419)..(429): a, c, t, g, unknown or other
  misc_feature (419)..(429): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccacgtcggaccaccctacaccaagactactggggccagggaaccctggtcgccgtctcctcagcctccacaggcccatcgtcttccccctggccaccctcctccaagagcacctctggggcacngcagcccnggctgcctggtcaaggtctacgtccacgtagcgtgctgaggcggcgnggcaaggcgacatagnnnnnnnnnnn

SEQ ID NO: 254920 - DNA, 430 bp, Homo sapiens
  misc_feature: GYAE6OF02HOBHU.30.45.E01.1.454.CMB.1.raw
  modified_base (306)..(306): a, c, t, g, unknown or other
  misc_feature (306)..(306): n is a, c, g, or t
  modified_base (423)..(430): a, c, t, g, unknown or other
  misc_feature (423)..(430): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccancggtcttccccctggcaccctcctccaagagcacctctgggggcacagcagccctgggctgcctggtcaaggactacttccacgtagcgtgctgagcgggctggcaaggcgcatagnnnnnnnn

SEQ ID NO: 254921 - DNA, 532 bp, Homo sapiens
  misc_feature: GYAE6OF02J2WSS.30.45.E01.1.454.CMB.1.raw
  modified_base (266)..(266): a, c, t, g, unknown or other
  misc_feature (266)..(266): n is a, c, g, or t
  modified_base (519)..(532): a, c, t, g, unknown or other
  misc_feature (519)..(532): n is a, c, g, or t
tcagcacgctacgtcacgaccggtgctcgatttagtgagtcagtaagggaaggggcgtggagtggatttcatatattagtgctggtgctactaccatgaagtacgcagactctgtgagggccgattcacatttccagggacgacgccaagaaatcagtatatctaacaaatgagtagcctgagagacgaggacacggctggtgtaattacgtgtggccgggaccggggacgccacgtccggacccaccctacaccaagacctacgnggggccgacggaccctcggtccgccgtcctctccacgcctcccaccgaacgggcccacgtccggtcccttccccctaggccacccctcctacccgacgacgccaacctccggtcggggaccacgacgtcaccggtcccgtcggggcctcggtcccgtagggtaccgaaagggtacccttacccgttacccgaccggttacgccggtcgtcgtcggacggccgggcgttacgggcgaacgggccgactacgagnnnnnnnnnnnnnn

SEQ ID NO: 254922 - DNA, 454 bp, Homo sapiens
  misc_feature: GYAE6OF02I9IP0.30.45.E01.1.454.CMB.1.raw
  modified_base (223)..(223): a, c, t, g, unknown or other
  misc_feature (223)..(223): n is a, c, g, or t
  modified_base (428)..(428): a, c, t, g, unknown or other
  misc_feature (428)..(428): n is a, c, g, or t
  modified_base (435)..(454): a, c, t, g, unknown or other
  misc_feature (435)..(454): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggganccacgtccggacccaccctacaccaagactacgtcgggccagggaaccctggtcgccgtcctcctcagccctccaccgaacgggcccatcggtccttccccctggccaccctcctcaagagcacctgtggggcacagcagccctgggctcgcctggtcaaggactacttccgagtacgcgtgctgacggcgggctgggcaaggcncatacgnnnnnnnnnnnnnnnnnnnn

SEQ ID NO: 254923 - DNA, 441 bp, Homo sapiens
  misc_feature: GYAE6OF02GJFYI.30.45.E01.1.454.CMB.1.raw
  modified_base (427)..(441): a, c, t, g, unknown or other
  misc_feature (427)..(441): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccaggggaaccctggtcgccgtctcctcagcctccaccaagggcccatcggtcttccccctggcaccctcctccaagacgcaccctctgggggcacagcagccctgggctgcctggtcaaggactacttcctctctcgactctgagcgggctggcaaggcgcatacgnnnnnnnnnnnnnnn

SEQ ID NO: 254924 - DNA, 450 bp, Homo sapiens
  misc_feature: GYAE6OF02INZHL.30.45.E01.1.454.CMB.1.raw
  modified_base (341)..(341): a, c, t, g, unknown or other
  misc_feature (341)..(341): n is a, c, g, or t
  modified_base (392)..(392): a, c, t, g, unknown or other
  misc_feature (392)..(392): n is a, c, g, or t
  modified_base (415)..(415): a, c, t, g, unknown or other
  misc_feature (415)..(415): n is a, c, g, or t
  modified_base (437)..(450): a, c, t, g, unknown or other
  misc_feature (437)..(450): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccactcggaccaccctacaccaagactacgtcggggccagggaaccctggtcgccgtctcctcagccctccaccaagggcccatcggtccttccccctggcacccctcctcccaagngccacctcgtcgggggcacacgcacgccctggggctcgcctggtcaaggtnttacttccacgtagcgtgctggngcgggctggacaggcgcatagnnnnnnnnnnnnnn

SEQ ID NO: 254925 - DNA, 467 bp, Homo sapiens
  misc_feature: GYAE6OF02J0RL5.30.45.E01.1.454.CMB.1.raw
  modified_base (339)..(339): a, c, t, g, unknown or other
  misc_feature (339)..(339): n is a, c, g, or t
  modified_base (440)..(467): a, c, t, g, unknown or other
  misc_feature (440)..(467): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccacgtcggaccaccctacaccaagactactggggccagggaaccctggtcgccgtctcctcagcctccaccaagggcccatcggtccttccccctggcaccccgtcctccaagngccaccgtcgtgggggcacaggccacgcccgtgggctcgcctggtcaaggactacttccctctctcgactctgacgcgggctggacgaggcgacaatgcgnnnnnnnnnnnnnnnnnnnnnnnnnnnn

SEQ ID NO: 254926 - DNA, 442 bp, Homo sapiens
  misc_feature: GYAE6OF02IH8W2.30.45.E01.1.454.CMB.1.raw
  modified_base (223)..(223): a, c, t, g, unknown or other
  misc_feature (223)..(223): n is a, c, g, or t
  modified_base (425)..(427): a, c, t, g, unknown or other
  misc_feature (425)..(427): n is a, c, g, or t
  modified_base (429)..(442): a, c, t, g, unknown or other
  misc_feature (429)..(442): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggcgggganccactcggaccaccctacaccaagactacgtggggccagggaaccctggtcgccgtctcctcagcctccaccagggcccatcggtcttccccctggccaccctcctccaagcgcacctctgggggcacagcacgcccgtgggctgcctggtcaaggactacttccacgtagcgtgctgagcgggctggacaaggcgcatagnnngnnnnnnnnnnnnnn

SEQ ID NO: 254927 - DNA, 435 bp, Homo sapiens
  misc_feature: GYAE6OF02IMVG9.30.45.E01.1.454.CMB.1.raw
  modified_base (323)..(323): a, c, t, g, unknown or other
  misc_feature (323)..(323): n is a, c, g, or t
  modified_base (425)..(435): a, c, t, g, unknown or other
  misc_feature (425)..(435): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaacccctggtcgccgtctcctcagcctccaccaaggcccatcggtcttccccctggccnccctcctccaagcgcaccctcgtggggcacagcacgccctgggctgcctggtcaaggactactccacgtacgcgtgctgagcggcgtggcgaggcgcatagnnnnnnnnnnn

SEQ ID NO: 254928 - DNA, 440 bp, Homo sapiens
  misc_feature: GYAE6OF02I4AU9.30.45.E01.1.454.CMB.1.raw
  modified_base (429)..(440): a, c, t, g, unknown or other
  misc_feature (429)..(440): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactacgtggggccagggaaccctggtcgccgtctcctcagcctccaccagggcccatcggtccttccccctggccaccctcctccaagacgccaccctcgtgggggcacagcacgccctgggctgcctggtcaaggactactccacgtagcgtgctgagcgggctggcaaggccgcatagnnnnnnnnnnnn

SEQ ID NO: 254929 - DNA, 442 bp, Homo sapiens
  misc_feature: GYAE6OF02JFDG9.30.45.E01.1.454.CMB.1.raw
  modified_base (430)..(442): a, c, t, g, unknown or other
  misc_feature (430)..(442): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgcattactgtgcgggccggggagccactcggaccaccctacaccaagactactggggccagggaaccctggtcgccgtctcctcagcctccaccaagggcccatcggtcttcccccctggccaccctcctccaacgagcacctctcggggggcacagcagccctgggctgcctggtcaaggactacttccacggagcgtgctgagcgggctgggcaaggcgcgatacgnnnnnnnnnnnnn

SEQ ID NO: 254930 - DNA, 488 bp, Homo sapiens
  misc_feature: GYAE6OF02F16ZL.30.45.E01.1.454.CMB.1.raw
  modified_base (451)..(451): a, c, t, g, unknown or other
  misc_feature (451)..(451): n is a, c, g, or t
  modified_base (453)..(453): a, c, t, g, unknown or other
  misc_feature (453)..(453): n is a, c, g, or t
  modified_base (456)..(488): a, c, t, g, unknown or other
  misc_feature (456)..(488): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagacctacgtgggggccgagggaacccctggtcgcccgtctcctcacgcctccaccaagggccccatccggtccttccccctgggccacccctccctccaacgacgccaccctcgtgggggcacacgcacgccctggggctcgcctggtcaacggactacttccacgtagcgtgcgtgagcgggctgggcaagggcgacagtagnancgnnnnnnnnnnnnnnnnnnnnnnnnnnnnnnnnn

SEQ ID NO: 254931 - DNA, 549 bp, Homo sapiens
  misc_feature: GYAE6OF02H91JX.30.45.E01.1.454.CMB.1.raw
  modified_base (264)..(264): a, c, t, g, unknown or other
  misc_feature (264)..(264): n is a, c, g, or t
  modified_base (518)..(520): a, c, t, g, unknown or other
  misc_feature (518)..(520): n is a, c, g, or t
  modified_base (522)..(549): a, c, t, g, unknown or other
  misc_feature (522)..(549): n is a, c, g, or t
tcagcacgctacgtcacgaccggtgctcgatttagtgagtcagtaagggaaggggctggagtggatttcatatattagtgctggtgctactaccatgaagtacgcagactctgtggaggggccgattccactatttccagggacgaccgccaaagaaatcagtatatctaacaaatgagtagcctgagagacgagacacggctgtgtattactgtgcggggccggggacgccacgtccggacccaccctacaacaagactacgnggggccgacgggaacccgtggtcgccgtccgtcctcacgccctaccaccgaacgggcccatccggttccttcccccgtcggccacccctcctccaacgcgcctaccgtcgtcggggccacgcgccacgccccgtggggtacctcggtcccgtgggtacaaacgggtaaccttacctttacccgaccggttaagtccggtcgtcgtagggacgggcgggggtcgtacgggacgaaacgggccgactaagtacggnnngnnnnnnnnnnnnnnnnnnnnnnnnnnnn

SEQ ID NO: 254932 - DNA, 433 bp, Homo sapiens
  misc_feature: GYAE6OF02G356Z.30.45.E01.1.454.CMB.1.raw
  modified_base (357)..(357): a, c, t, g, unknown or other
  misc_feature (357)..(357): n is a, c, g, or t
  modified_base (428)..(433): a, c, t, g, unknown or other
  misc_feature (428)..(433): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttcccccctggccacccctcctccaagagccaccctctgggggcacngcacgccctgggctgcctggtcaaggactacttccacgtagcgtgctgaggcgggctggcaggcgcatagnnnnnn

SEQ ID NO: 254933 - DNA, 552 bp, Homo sapiens
  misc_feature: GYAE6OF02J3OOP.30.45.E01.1.454.CMB.1.raw
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (236)..(236): a, c, t, g, unknown or other
  misc_feature (236)..(236): n is a, c, g, or t
  modified_base (477)..(477): a, c, t, g, unknown or other
  misc_feature (477)..(477): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
  modified_base (520)..(552): a, c, t, g, unknown or other
  misc_feature (520)..(552): n is a, c, g, or t
tcagcacgctacgtcacgaccggtgctcgatttagtgagtcagtaagggaaggggctggagtggatttcatatattagtgctggtgctactaccatgaagtacgcagactctgtggacggggccattccacctattccgagggacgacgccaaagaatcagtatatctaagaatgagtacgctagagagacggagtacgacgntgtagtattacgngggtggccggggacgggacncctacgtccggaacccacctaacactacgacctacggtcggggacccgacggacccgtcggccgtcccgtcgtcctccgaccgtcccctaccgaaccgaccggcccacggttcccgtcccttcccgcgcccgaccctcctacgaacgcacccgtaccgtcggtcgggaccacgctacgccgtccccgtggacgtcgaccggtgaaccgaacggtcctacgttacccacgggttagcgtcgngtcgggacggcggtcgcggacgaacgggcgtacgagcngnctnnnnnnnnnnnnnnnnnnnnnnnnnnnnnnnnn

SEQ ID NO: 254934 - DNA, 239 bp, Homo sapiens
  misc_feature: GYAE6OF02G08ZS.30.45.E01.1.454.CMB.1.raw
  modified_base (233)..(239): a, c, t, g, unknown or other
  misc_feature (233)..(239): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgagcgggctggcaaggcgcatagnnnnnnn

SEQ ID NO: 254935 - DNA, 552 bp, Homo sapiens
  misc_feature: GYAE6OF02HJVFB.30.45.E01.1.454.CMB.1.raw
  modified_base (509)..(509): a, c, t, g, unknown or other
  misc_feature (509)..(509): n is a, c, g, or t
  modified_base (515)..(515): a, c, t, g, unknown or other
  misc_feature (515)..(515): n is a, c, g, or t
  modified_base (518)..(518): a, c, t, g, unknown or other
  misc_feature (518)..(518): n is a, c, g, or t
  modified_base (520)..(552): a, c, t, g, unknown or other
  misc_feature (520)..(552): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaaagaaatcagtatatctacaaatgagtagcctgagagacgaggacacggctgtgtattactgtgcgggccggggagccactcggaccaccctacaccaagactactggggccagggaacccctggtcgccgtctcctcagcctccaccaagggccccatcggtcttcccccctggccacccctcctcccaagacgccaccctcgtcggggggccaccgacgcgacgccccgtggggcctcggcccgttgggtccaaaggggaccttaaccttccccgaacggttacgccggtcggaccttgggaacggccgggggtaccgttcgggggacccgtaaacggggccggacgtaacgtaaggngtcagngcngnnnnnnnnnnnnnnnnnnnnnnnnnnnnnnnnn

SEQ ID NO: 254936 - DNA, 453 bp, Homo sapiens
  misc_feature: GYAE6OF02HHYHK.30.45.E01.1.454.CMB.1.raw
  modified_base (441)..(453): a, c, t, g, unknown or other
  misc_feature (441)..(453): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccacccctacacccaagactactgggggccagggaaccctggtcgccggtctcctcagcctccaccaagggccccatcggtcttccccctggccaccctcctccaacgagcacctctcgggggcacacgcgacgccccgtgggctcgccgtggtcgaacggactacttaccctctctcgactctgacgcgggctggcaggcgcatgnnnnnnnnnnnnn

SEQ ID NO: 254937 - DNA, 533 bp, Homo sapiens
  misc_feature: GYAE6OF02JZG18.30.45.E01.1.454.CMB.1.raw
  modified_base (251)..(251): a, c, t, g, unknown or other
  misc_feature (251)..(251): n is a, c, g, or t
  modified_base (318)..(318): a, c, t, g, unknown or other
  misc_feature (318)..(318): n is a, c, g, or t
  modified_base (343)..(343): a, c, t, g, unknown or other
  misc_feature (343)..(343): n is a, c, g, or t
  modified_base (500)..(500): a, c, t, g, unknown or other
  misc_feature (500)..(500): n is a, c, g, or t
  modified_base (502)..(533): a, c, t, g, unknown or other
  misc_feature (502)..(533): n is a, c, g, or t
tcagcacgctacgtcacgaccggtgctcgatttagtgagtcagtaagggaaggggcgtggagtggatttcatatattagtgctggtgctactaccatgaagtacgcagactctgtgaggggccgattcaccatttccagggcgacgccaagaaatcagtatatctacaaatgagtagcctgagagacggaggacacggctgtgtattactgtgcggggccggggagccatcggaccacctacacagactangggccagggacctggtcgccgtcgtacctcacgcctccaccgaaggcccatccggtccgttcccccncggccaccccgtcctccaacggacncacctcgcggggacacaggccacgcccgtggggcctacggccgtgggtaccgaaacgggtaccttaaacccgtttcccgaaacgggtacgtccggttgccgttcggaacggtaccggggccgttacgggaccgaaacggggcgtacccgaagtacgngnnnnnnnnnnnnnnnnnnnnnnnnnnnnnnnn

SEQ ID NO: 254938 - DNA, 240 bp, Homo sapiens
  misc_feature: GYAE6OF02H0YIF.30.45.E01.1.454.CMB.1.raw
  modified_base (234)..(240): a, c, t, g, unknown or other
  misc_feature (234)..(240): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgagcgggctggcaagggcgcatagnnnnnnn

SEQ ID NO: 254939 - DNA, 430 bp, Homo sapiens
  misc_feature: GYAE6OF02F1JYJ.30.45.E01.1.454.CMB.1.raw
  modified_base (422)..(430): a, c, t, g, unknown or other
  misc_feature (422)..(430): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccactcggaccaccctacaccaagactactggggccagggaaccctggtcgccgtctcctcagcctccaccaagggcccatcggtcttccccctggcaccctcctccaagacgcacctctgggggcacagcagccctgggctgcctggtcaaggactacttccacgtagcgtgctgagcgggctggcaggcgcatacgnnnnnnnnn

SEQ ID NO: 254940 - DNA, 431 bp, Homo sapiens
  misc_feature: GYAE6OF02H70VL.30.45.E01.1.454.CMB.1.raw
  modified_base (411)..(411): a, c, t, g, unknown or other
  misc_feature (411)..(411): n is a, c, g, or t
  modified_base (421)..(421): a, c, t, g, unknown or other
  misc_feature (421)..(421): n is a, c, g, or t
  modified_base (423)..(423): a, c, t, g, unknown or other
  misc_feature (423)..(423): n is a, c, g, or t
  modified_base (426)..(431): a, c, t, g, unknown or other
  misc_feature (426)..(431): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccagggcccatcggtcttccccctcggcaccctcctccaagacgccacctcgtgggggcacagcagcccgtgggctgcctggtcaacggactacttccacgtagcgtgctgagcggcnggcgaggcgnanagnnnnnn

SEQ ID NO: 254941 - DNA, 465 bp, Homo sapiens
  misc_feature: GYAE6OF02GWDWW.30.45.E01.1.454.CMB.1.raw
  modified_base (443)..(465): a, c, t, g, unknown or other
  misc_feature (443)..(465): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactacgtggggccagggaaccctggtcgccgtctcctcacgcctccaccaacgggcccatcggtcttcccccctggccacccctcctccaagacgccacctcgtcgggggccacagccacgcccctgggctcgcctggtccgaaggacctacttccacgtagcgtcgctgagcgggcgtggcaaggcgcagtagnnnnnnnnnnnnnnnnnnnnnnn

SEQ ID NO: 254942 - DNA, 464 bp, Homo sapiens
  misc_feature: GYAE6OF02FIDCM.30.45.E01.1.454.CMB.1.raw
  modified_base (446)..(464): a, c, t, g, unknown or other
  misc_feature (446)..(464): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagacctactgggggcccagggaaccctggtcgccgtctcctcagccctccaccaacgggcccatccggtccttccccccgtggccacccctccctcccaagacgccacctcgtcgggggcacgagcacgccccgtgggctcgcctggtcaaggactacttccacgtagcgtgctgagcgggctggacgaggcgcagtagnnnnnnnnnnnnnnnnnnn

SEQ ID NO: 254943 - DNA, 438 bp, Homo sapiens
  misc_feature: GYAE6OF02HYPEC.30.45.E01.1.454.CMB.1.raw
  modified_base (359)..(359): a, c, t, g, unknown or other
  misc_feature (359)..(359): n is a, c, g, or t
  modified_base (429)..(438): a, c, t, g, unknown or other
  misc_feature (429)..(438): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggggagccactcggaccaccctacaccaagactactggggccaggggaacccctggtcgccgtctcctcagcctccaccaagggcccaatccggtcttcccccctggccaccctcctccaagacgcacctctggggcacngcagccctgggctgcctggtcaaggactacttccacgtacgcgtgctgagcgggctggcaggcgcatagnnnnnnnnnn

SEQ ID NO: 254944 - DNA, 431 bp, Homo sapiens
  misc_feature: GYAE6OF02H2BCF.30.45.E01.1.454.CMB.1.raw
  modified_base (423)..(431): a, c, t, g, unknown or other
  misc_feature (423)..(431): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggggagccactcggaccaccctacaccaagactactggggccagggaaccctggtcgccgtctcctcagcctccaccaggcccatcggtcttcccctggcaccctcctccaagagccacctctgggggcacagcagccctgggctgcctggtcaaggactacgttcctctctcgactctgacgcgggctggcagggcgcatagnnnnnnnnn

SEQ ID NO: 254945 - DNA, 432 bp, Homo sapiens
  misc_feature: GYAE6OF02FKC7V.30.45.E01.1.454.CMB.1.raw
  modified_base (422)..(432): a, c, t, g, unknown or other
  misc_feature (422)..(432): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnnnnnnn

SEQ ID NO: 254946 - DNA, 422 bp, Homo sapiens
  misc_feature: GYAE6OF02HOHBN.30.45.E01.1.454.CMB.1.raw
  modified_base (418)..(422): a, c, t, g, unknown or other
  misc_feature (418)..(422): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacacgccaagaaatcagtatatctacaaatgatagcctgagagacgaggacacggctgtgtattactgtgcgggccggggagccactcggaccaccctacaccaagctactggggccagggaaccctggtcgccgtctcctcagcctccaccaaggcccatcggtcttccccctggcaccctcctccaagacgtcactctggggcacagcagccctgggctgcctggtcaaggctaacttccacgtagcgtgctgagcgggctggcaaggcgcatagnnnnn

SEQ ID NO: 254947 - DNA, 488 bp, Homo sapiens
  misc_feature: GYAE6OF02H2P7U.30.45.E01.1.454.CMB.1.raw
  modified_base (352)..(352): a, c, t, g, unknown or other
  misc_feature (352)..(352): n is a, c, g, or t
  modified_base (452)..(453): a, c, t, g, unknown or other
  misc_feature (452)..(453): n is a, c, g, or t
  modified_base (456)..(488): a, c, t, g, unknown or other
  misc_feature (456)..(488): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggggagccacgtcggacccacccctacaccaagactacgtggggccagggaaccctggtcgccgtctcctcacgcctccaccaacgggccccatccggtccttcccccgtggccacccctcctcccacgacnccacctcgtcgggggccacgacgcacgcccgtgggcctgccgtggtcaaggtctaccttcctactctcgactctgacgcggctggcaaggcgacatagcnncgnnnnnnnnnnnnnnnnnnnnnnnnnnnnnnnnn

SEQ ID NO: 254948 - DNA, 532 bp, Homo sapiens
  misc_feature: GYAE6OF02GM2U2.30.45.E01.1.454.CMB.1.raw
  modified_base (223)..(223): a, c, t, g, unknown or other
  misc_feature (223)..(223): n is a, c, g, or t
  modified_base (486)..(486): a, c, t, g, unknown or other
  misc_feature (486)..(486): n is a, c, g, or t
  modified_base (493)..(496): a, c, t, g, unknown or other
  misc_feature (493)..(496): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (503)..(505): a, c, t, g, unknown or other
  misc_feature (503)..(505): n is a, c, g, or t
  modified_base (507)..(517): a, c, t, g, unknown or other
  misc_feature (507)..(517): n is a, c, g, or t
  modified_base (519)..(532): a, c, t, g, unknown or other
  misc_feature (519)..(532): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacacgccaagaaatcagtatatctacaaatgagtagcctgagagacgaggacacggctgtgtattactgtgcgggccgggganccacgtcggacccaccctacaccaagactacgtggggccagggaaccctggtccgccgtcctcctcacgccctccaccgaacgggcccactccgggtccttcccccgtggccctaccctccctaccagacgccacctcggtacggggccacgacgccgacgcccggtggctcgcctcgggtacaacggacctacgttcccaacggtacgtcggtcgcgtaggacggtccgggcgtacgggacgaacgggccgacgtaactagngtcgcgnnnngncncgnnngnnnnnnnnnnncnnnnnnnnnnnnnn

SEQ ID NO: 254949 - DNA, 500 bp, Homo sapiens
  misc_feature: GYAE6OF02IDB2F.30.45.E01.1.454.CMB.1.raw
  modified_base (473)..(500): a, c, t, g, unknown or other
  misc_feature (473)..(500): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccacgtcggaccaccctacaccaagactacgtggggccgacgggaaccctgggtcgccgtcctcctcacgcctccaccaagggcccatccggtccttccccctcggccacccctccctccaacgacgccacctcgtcgggggcacgacgcacgcccgtagggcctcgcctggtacgaacggacctaccttcccgaacgtacgcgtacgtctggacggcgggcgtcgggaacgagggccgacgagtacgnnnnnnnnnnnnnnnnnnnnnnnnnnnn

SEQ ID NO: 254950 - DNA, 467 bp, Homo sapiens
  misc_feature: GYAE6OF02H2GLU.30.45.E01.1.454.CMB.1.raw
  modified_base (172)..(172): a, c, t, g, unknown or other
  misc_feature (172)..(172): n is a, c, g, or t
  modified_base (214)..(214): a, c, t, g, unknown or other
  misc_feature (214)..(214): n is a, c, g, or t
  modified_base (248)..(248): a, c, t, g, unknown or other
  misc_feature (248)..(248): n is a, c, g, or t
  modified_base (260)..(260): a, c, t, g, unknown or other
  misc_feature (260)..(260): n is a, c, g, or t
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
  modified_base (444)..(467): a, c, t, g, unknown or other
  misc_feature (444)..(467): n is a, c, g, or t
tcagcacgctacgtcacgaccggtgctcgatttagtgagtcagtaagggaaggggcgtggagtggatttcatatatttagtggctggtgctactaccatgaagtacgcagactctgtgaggggccgattcaccatttccagggacgacgccaaagaaatcagtatatctaanaaatgagtagcctgagagacgaggacacggctgtgtattacncgtgcgggccggggagccactcggaccaccctanaccaagctacgnggggccacggaacccgtggtcgccgtctcctcagcctccacaaggccccatcggtcttccccctggccaccctcctccaagacgcaccctcgtcgggggcacgagcacgcccgtgggctcgccgtgtcaaggactacttccacgttagcgtagctgagngggtcnggcaaggcgacagtagcgnnnnnnnnnnnnnnnnnnnnnnnn

SEQ ID NO: 254951 - DNA, 457 bp, Homo sapiens
  misc_feature: GYAE6OF02FQZEZ.30.45.E01.1.454.CMB.1.raw
  modified_base (283)..(283): a, c, t, g, unknown or other
  misc_feature (283)..(283): n is a, c, g, or t
  modified_base (326)..(326): a, c, t, g, unknown or other
  misc_feature (326)..(326): n is a, c, g, or t
  modified_base (433)..(434): a, c, t, g, unknown or other
  misc_feature (433)..(434): n is a, c, g, or t
  modified_base (436)..(457): a, c, t, g, unknown or other
  misc_feature (436)..(457): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccactcggacccaccctacaccaagactactgggggccagggaaccctggtcgccgtcncctcagccctccaccaacgggcccatcggtcttccccctggcnccctcctccaagacgcacctctgggggcacagccagcccgtgggctgcctggtcaaggactacttccacgtacgcgtgctgagccgggctggcaagggcgacatagnngnnnnnnnnnnnnnnnnnnnnnn

SEQ ID NO: 254952 - DNA, 496 bp, Homo sapiens
  misc_feature: GYAE6OF02JA1VU.30.45.E01.1.454.CMB.1.raw
  modified_base (467)..(496): a, c, t, g, unknown or other
  misc_feature (467)..(496): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcacgcctccaccaacgggcccactcggtccttccccctcgggccacccctcctccaagacgccacctcgtgggggcacgagcgacgccccgtggggctcgccgtggtacgaacggacctaccgttcccgtacggcggtacgcgtggacggcgggcgtcgggacgaagggccgcgagtagcgnnnnnnnnnnnnnnnnnnnnnnnnnnnnnn

SEQ ID NO: 254953 - DNA, 513 bp, Homo sapiens
  misc_feature: GYAE6OF02IGRKQ.30.45.E01.1.454.CMB.1.raw
  modified_base (479)..(479): a, c, t, g, unknown or other
  misc_feature (479)..(479): n is a, c, g, or t
  modified_base (481)..(513): a, c, t, g, unknown or other
  misc_feature (481)..(513): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactccggaccacccctacaccaagactacgtggggccgagggaacccctggtccgccgtcctcctcacgccctcccaaccgaacgggccccacgtccggttcctttccccccgtcgggccaacccccgtccctaccaacgacgccaccctccgtgggggccacgacgcacgcccgtgggctcgccgtggcaagtactaccttccgacgtacgcgtcgcgtggcggcgggctcgggacgaggtcgcagtgacgngnnnnnnnnnnnnnnnnnnnnnnnnnnnnnnnnn

SEQ ID NO: 254954 - DNA, 240 bp, Homo sapiens
  misc_feature: GYAE6OF02IHNQ2.30.45.E01.1.454.CMB.1.raw
  modified_base (234)..(240): a, c, t, g, unknown or other
  misc_feature (234)..(240): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgagcgggctggacaggcgcagtagnnnnnnn

SEQ ID NO: 254955 - DNA, 442 bp, Homo sapiens
  misc_feature: GYAE6OF02FYWZ3.30.45.E01.1.454.CMB.1.raw
  modified_base (223)..(223): a, c, t, g, unknown or other
  misc_feature (223)..(223): n is a, c, g, or t
  modified_base (432)..(442): a, c, t, g, unknown or other
  misc_feature (432)..(442): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggcgggganccactcggaccaccctacaccaagactacgtggggccgagggaaccctggtcgccgtctcctcagcctccaccagggcccatcggtcttccccctggccaccctcctccaagacgccacctcgtgggggccacgcgcacgcccgtcgggctcgcctggtacaacggactactccacgtagcgtgctgagcgggctggcaggcgcatagnnnnnnnnnnn

SEQ ID NO: 254956 - DNA, 485 bp, Homo sapiens
  misc_feature: GYAE6OF02ID215.30.45.E01.1.454.CMB.1.raw
  modified_base (364)..(364): a, c, t, g, unknown or other
  misc_feature (364)..(364): n is a, c, g, or t
  modified_base (457)..(458): a, c, t, g, unknown or other
  misc_feature (457)..(458): n is a, c, g, or t
  modified_base (460)..(485): a, c, t, g, unknown or other
  misc_feature (460)..(485): n is a, c, g, or t
tcagcacgctacgtcacgaccggtgctcgatttagtgagtcagtaagggaagggactggagtggatttcatatattagtgctggtgctactaccatgaagtacgcagactctgtgaggggccgattcaccattttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagccctccaccagggcccatcggtccttccccctggccaccctccctccaacgacgccaccctcgtcgggggcaccgngccacgcccgtggggcctcgccttcggtcaaacgggactactccaccgtagccgtgcctgcggcgggccgtgggcgaagggccgcgaacgtgnngnnnnnnnnnnnnnnnnnnnnnnnnnn

SEQ ID NO: 254957 - DNA, 534 bp, Homo sapiens
  misc_feature: GYAE6OF02GVYF2.30.45.E01.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (499)..(534): a, c, t, g, unknown or other
  misc_feature (499)..(534): n is a, c, g, or t
tcagcacgctacgtcacgaccggtgctcgatttagtgagtcagtaaggggaaagggggctggagtggatttcatatattagtgctggtgctactaccatgaagtacgcagactctgtgaggggccattcaccatttccagggacgacgccaagaaatcagtatatctacaaatgagtagctgagagacgaggacacggntgtgtattactgtgcggggccgggganccactcggaccaccctanaaccaagacctacgtcggggaccagggaacctggtcgccgtctcctcagccctcatcaaacggggccctagtccggtccttcccccgtaggccctacccctcctaccgaacgacgccaaccctcggtgggggaccagtacgacacggtccccgtagggctcggacccgtggtaaccgaaaggtacccttaaccttccgtaaggtcgcctactcgtggacgtcgggacgttacggacggtaaggacacgatacgannnnnnnnnnnnnnnnnnnnnnnnnnnnnnnnnnnn

SEQ ID NO: 254958 - DNA, 541 bp, Homo sapiens
  misc_feature: GYAE6OF02H1YDK.30.45.E01.1.454.CMB.1.raw
  modified_base (284)..(284): a, c, t, g, unknown or other
  misc_feature (284)..(284): n is a, c, g, or t
  modified_base (446)..(446): a, c, t, g, unknown or other
  misc_feature (446)..(446): n is a, c, g, or t
  modified_base (450)..(450): a, c, t, g, unknown or other
  misc_feature (450)..(450): n is a, c, g, or t
  modified_base (457)..(457): a, c, t, g, unknown or other
  misc_feature (457)..(457): n is a, c, g, or t
  modified_base (462)..(462): a, c, t, g, unknown or other
  misc_feature (462)..(462): n is a, c, g, or t
  modified_base (472)..(472): a, c, t, g, unknown or other
  misc_feature (472)..(472): n is a, c, g, or t
  modified_base (480)..(480): a, c, t, g, unknown or other
  misc_feature (480)..(480): n is a, c, g, or t
  modified_base (489)..(489): a, c, t, g, unknown or other
  misc_feature (489)..(489): n is a, c, g, or t
  modified_base (499)..(499): a, c, t, g, unknown or other
  misc_feature (499)..(499): n is a, c, g, or t
  modified_base (522)..(522): a, c, t, g, unknown or other
  misc_feature (522)..(522): n is a, c, g, or t
  modified_base (535)..(535): a, c, t, g, unknown or other
  misc_feature (535)..(535): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccactcggaccaccctacaccaagactactggggccagggaaccctggtcgccgtctccncagcctccaccaagggcccatccggtacttccccgtggcaccctcctccaagagccacctcgtggggcacagcacgcccgtgggctgccgtggtacaaggactacgttccacggtagcctgctgacggcgggctggccgaaagggtccgactagttacgctnagtngactganacgtnacgatgactncggacagngaccgtgcncgagaccgtncgttccgaagacttcggtaaccncgtacacacgtcncgtacg

SEQ ID NO: 254959 - DNA, 438 bp, Homo sapiens
  misc_feature: GYAE6OF02G2TM9.30.45.E01.1.454.CMB.1.raw
  modified_base (322)..(322): a, c, t, g, unknown or other
  misc_feature (322)..(322): n is a, c, g, or t
  modified_base (335)..(335): a, c, t, g, unknown or other
  misc_feature (335)..(335): n is a, c, g, or t
  modified_base (420)..(420): a, c, t, g, unknown or other
  misc_feature (420)..(420): n is a, c, g, or t
  modified_base (425)..(438): a, c, t, g, unknown or other
  misc_feature (425)..(438): n is a, c, g, or t
tcagcacgctacgtcacgaccggtgctcgatttagtgagtcagtaagggaaggggctgggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggacccaccctacaccaagactactggggccagggaaccctggtcgccgtctcctcagcctccaccaaggcccatcggcttccccctggcnccctcctccaagncaccctcgtgggggcacagcacgccctggctcgcctggtcaaggactacttcctcgtagcactctgaggcggctgggcaaggcgnatagnnnnnnnnnnnnnn

SEQ ID NO: 254960 - DNA, 439 bp, Homo sapiens
  misc_feature: GYAE6OF02JA288.30.45.E01.1.454.CMB.1.raw
  modified_base (413)..(414): a, c, t, g, unknown or other
  misc_feature (413)..(414): n is a, c, g, or t
  modified_base (428)..(439): a, c, t, g, unknown or other
  misc_feature (428)..(439): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcacatttccagggacgacgccaagaaatcagtatatctacaaatgagtagcctgagagacgaggacacggctgtgtattactgtgcgggccggggagccactcggaccaccctacaccaagactacgtcggggccagggaaccctggtcgcccgtctcctcagccctccaccaagggcccatcggtcttccccctggcaccccgtcctccaagacgcaccctcgtgggggcacagcagccctgggctgcctggtcaaggactactccacgtagcgtgctgagcgggnnggcaggcgcatagnnnnnnnnnnnn

SEQ ID NO: 254961 - DNA, 457 bp, Homo sapiens
  misc_feature: GYAE6OF02JGESY.30.45.E01.1.454.CMB.1.raw
  modified_base (210)..(210): a, c, t, g, unknown or other
  misc_feature (210)..(210): n is a, c, g, or t
  modified_base (311)..(311): a, c, t, g, unknown or other
  misc_feature (311)..(311): n is a, c, g, or t
  modified_base (345)..(345): a, c, t, g, unknown or other
  misc_feature (345)..(345): n is a, c, g, or t
  modified_base (389)..(389): a, c, t, g, unknown or other
  misc_feature (389)..(389): n is a, c, g, or t
  modified_base (399)..(399): a, c, t, g, unknown or other
  misc_feature (399)..(399): n is a, c, g, or t
  modified_base (420)..(420): a, c, t, g, unknown or other
  misc_feature (420)..(420): n is a, c, g, or t
  modified_base (422)..(457): a, c, t, g, unknown or other
  misc_feature (422)..(457): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtatactgngcgggcggtgccagtcggaccactacgacagactacgtggacaggacctggtcgccgtctcctcacgcctacaccaggcccatcggtctccccgtggaccncccgtctccaagcgcaccctcgtcggggcaacgngcacgcctgggctgctgtaccgaagtctacgtcaccgtagcgtncgtgagcggngtcggacacggcacgagtagngnnnnnnnnnnnnnnnnnnnnnnnnnnnnnnnnnnnn

SEQ ID NO: 254962 - DNA, 439 bp, Homo sapiens
  misc_feature: GYAE6OF02GT8VJ.30.45.E01.1.454.CMB.1.raw
  modified_base (424)..(424): a, c, t, g, unknown or other
  misc_feature (424)..(424): n is a, c, g, or t
  modified_base (430)..(439): a, c, t, g, unknown or other
  misc_feature (430)..(439): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagccctccaccaacgggcccatccggtcttccccctggccaccctcctccaagacgcacctctgggggcacagcacgccctgggctgcctggtacaggactacttccacgtagcgtgctgacgcgggctggcgaaggcncatagnnnnnnnnnn

SEQ ID NO: 254963 - DNA, 437 bp, Homo sapiens
  misc_feature: GYAE6OF02HZ7WE.30.45.E01.1.454.CMB.1.raw
  modified_base (421)..(421): a, c, t, g, unknown or other
  misc_feature (421)..(421): n is a, c, g, or t
  modified_base (423)..(437): a, c, t, g, unknown or other
  misc_feature (423)..(437): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcacatttccagggacgacgccaagaaatcagtatatctacaaatgagtagcctgagagacgaggacacggctgtgtattactgtgcggggccggggagccactcggaccaccctacacaagactactggggccagggaaccctggtcgccgtctcctcagcctcaccaagggcccatcggtcttccccctggcaccctcctccaagagccacctctgggggccacacgcacgcccgtgggctgcctggtcaaggactacttccacgtagcgtgctgagcgggctggcaggcgcangnnnnnnnnnnnnnnn

SEQ ID NO: 254964 - DNA, 499 bp, Homo sapiens
  misc_feature: GYAE6OF02HWKLG.30.45.E01.1.454.CMB.1.raw
  modified_base (461)..(462): a, c, t, g, unknown or other
  misc_feature (461)..(462): n is a, c, g, or t
  modified_base (464)..(499): a, c, t, g, unknown or other
  misc_feature (464)..(499): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccacgtcggaccaaccctacaccaagactactggggccagggaacccctggtacgccgtcctcctcacgcctccaccaaggccccatccggtcttcccccgtggcaccctcctccaacgacgcacctcgtgggggcacgacgcacgccccgtagggcctgccgtggtcgaacgggtactaccttccacgtagcgtcgctgacggcggggctcggacgaagggtccgacgaagtacgcnncnnnnnnnnnnnnnnnnnnnnnnnnnnnnnnnnnnnn

SEQ ID NO: 254965 - DNA, 505 bp, Homo sapiens
  misc_feature: GYAE6OF02FRBPR.30.45.E01.1.454.CMB.1.raw
  modified_base (465)..(466): a, c, t, g, unknown or other
  misc_feature (465)..(466): n is a, c, g, or t
  modified_base (468)..(472): a, c, t, g, unknown or other
  misc_feature (468)..(472): n is a, c, g, or t
  modified_base (474)..(474): a, c, t, g, unknown or other
  misc_feature (474)..(474): n is a, c, g, or t
  modified_base (477)..(477): a, c, t, g, unknown or other
  misc_feature (477)..(477): n is a, c, g, or t
  modified_base (480)..(505): a, c, t, g, unknown or other
  misc_feature (480)..(505): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccacgtcggaccaccctacaccaagactacgtggggccagggaaccctggtcgccgtctcctcagcctcccaccaagggccccagtcggtccttcccccctggcccaccctccctcccaagcgccacctcgtcgggggcacgagccacgccctgggcctcgccgtggtcaagggaccttaccttccctcctccgtccgactcgtgagccggggtctcgggcgaacgggcgaccagtagnngnnnnngncancannnnnnnnnnnnnnnnnnnnnnnnnn

SEQ ID NO: 254966 - DNA, 460 bp, Homo sapiens
  misc_feature: GYAE6OF02GYGUZ.30.45.E01.1.454.CMB.1.raw
  modified_base (441)..(460): a, c, t, g, unknown or other
  misc_feature (441)..(460): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccacgtcggaccaccctacaccaagactacgtggggccagggaaccctggtcgccgtctcctcagccctccaccaacggccccatcggtccttccccctggccaccctccctccaagacgcaccctcgtcgggggcacgagcacgccccgtgggctcgcctcggtcaaggactacttccacgtagcgtgctgagcggcgtggcgaaggcgcatagnnnnnnnnnnnnnnnnnnnn

SEQ ID NO: 254967 - DNA, 501 bp, Homo sapiens
  misc_feature: GYAE6OF02JXBU8.30.45.E01.1.454.CMB.1.raw
  modified_base (444)..(444): a, c, t, g, unknown or other
  misc_feature (444)..(444): n is a, c, g, or t
  modified_base (469)..(501): a, c, t, g, unknown or other
  misc_feature (469)..(501): n is a, c, g, or t
tcagcacgctacgtcacgaccggtgctcgatttagtgagtcagtaagggaaggggctggagtggatttcatatattagtgctgggtgctactaccatgaagtacgcagactctgtgaggggccgattcaccatttccagggaccgacgccaagaaatcagtatatctacaaatgagtagcctgagagacgaggacacggctgtgtattactgtgcgggccggggagccactcggaccacctacaccaagactacgtggggccagggaacctggtacgccggtctccttcagcctccaccaagggcccatcggtacttcccccgtggcaccctcctcccaagcacacctcgtcgggggcctacacgacacgtcccgtcgggctcgccctgggtacgaacggacctaaccgttccctccgtcctccggaacctctggacgccgggngttcggcgtaacgggcgcagtacgnnnnnnnnnnnnnnnnnnnnnnnnnnnnnnnnn

SEQ ID NO: 254968 - DNA, 843 bp, Homo sapiens
  misc_feature: GYAE6OF02IH8NZ.30.45.E01.1.454.CMB.1.raw
  modified_base (160)..(160): a, c, t, g, unknown or other
  misc_feature (160)..(160): n is a, c, g, or t
  modified_base (183)..(183): a, c, t, g, unknown or other
  misc_feature (183)..(183): n is a, c, g, or t
  modified_base (744)..(744): a, c, t, g, unknown or other
  misc_feature (744)..(744): n is a, c, g, or t
  modified_base (755)..(755): a, c, t, g, unknown or other
  misc_feature (755)..(755): n is a, c, g, or t
  modified_base (760)..(760): a, c, t, g, unknown or other
  misc_feature (760)..(760): n is a, c, g, or t
tcagcacgctacgtcacgaccggtgctcgatttagtgagtcagtaagggaaggggcgtggagtggattcatatattagtgctggtgctactaccatgaagtacgcagactctgtgagggccgattcaccgatttccaggacgacgccaagaaatcagtanatctacaaatgagtagcctgagngacgaggacgacggctgtgtacttactgtcgcgggtcgaggacgccacgtcggacccaccgttaacaccgaagaccgtagtacggggacctaacggggaacccttggtccggccgttacgttcccgtcgtaagcccgttacccgaccgtaaaacggggtccccaagttccggttccccgtttacccccggttcggccccgttaaccccgttaccccttaccgaaaaccggtaccggtccgtaacccgttcccggggttaccggggggacctaaaccgttacggacccggtaacggacccccgtttcggggggacgtttacccggccccgggttaacgggtaccgggtaaaacccgggttacggttaaaccccttttccccgggtaaaaccgggggtttcgtaaccccggggttttagggtcccggttaacggtttaaacccgggggccccggggtaaccggggttttcgggggtaacccaaaacgggggtttcccggaaaacgtaaaccggttggtaaacggcgggtaccttaggaattacggacttccgagtttacgccngttaacccggngtacncgtaacgacggttaacgcgttacgcgtcgaagtacgtacgcgtcgtacgtacgtacgtacgacgtacgtacgtagtacgtacg

SEQ ID NO: 254969 - DNA, 446 bp, Homo sapiens
  misc_feature: GYAE6OF02GG94R.30.45.E01.1.454.CMB.1.raw
  modified_base (223)..(223): a, c, t, g, unknown or other
  misc_feature (223)..(223): n is a, c, g, or t
  modified_base (336)..(336): a, c, t, g, unknown or other
  misc_feature (336)..(336): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (403)..(403): a, c, t, g, unknown or other
  misc_feature (403)..(403): n is a, c, g, or t
  modified_base (412)..(412): a, c, t, g, unknown or other
  misc_feature (412)..(412): n is a, c, g, or t
  modified_base (419)..(419): a, c, t, g, unknown or other
  misc_feature (419)..(419): n is a, c, g, or t
  modified_base (421)..(446): a, c, t, g, unknown or other
  misc_feature (421)..(446): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggcgggganccactcggaccacctacaccaagactactggggccagggaaccctggtcgccgtctcctcagcctccaccaacgggcccatcggtcttccccctggccaccctcctccaagcncacctctggggccacagcagcccngggcngcctgtcgaaggactactccacgtagctgctgagcggntggcaggcncatagcngnnnnnnnnnnnnnnnnnnnnnnnnnn

SEQ ID NO: 254970 - DNA, 601 bp, Homo sapiens
  misc_feature: GYAE6OF02I0Z6F.30.45.E01.1.454.CMB.1.raw
  modified_base (538)..(539): a, c, t, g, unknown or other
  misc_feature (538)..(539): n is a, c, g, or t
  modified_base (545)..(547): a, c, t, g, unknown or other
  misc_feature (545)..(547): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
  modified_base (562)..(564): a, c, t, g, unknown or other
  misc_feature (562)..(564): n is a, c, g, or t
  modified_base (567)..(568): a, c, t, g, unknown or other
  misc_feature (567)..(568): n is a, c, g, or t
  modified_base (574)..(574): a, c, t, g, unknown or other
  misc_feature (574)..(574): n is a, c, g, or t
  modified_base (576)..(576): a, c, t, g, unknown or other
  misc_feature (576)..(576): n is a, c, g, or t
  modified_base (580)..(580): a, c, t, g, unknown or other
  misc_feature (580)..(580): n is a, c, g, or t
  modified_base (592)..(592): a, c, t, g, unknown or other
  misc_feature (592)..(592): n is a, c, g, or t
  modified_base (597)..(597): a, c, t, g, unknown or other
  misc_feature (597)..(597): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggaccacggctgtgtattactgtgcgggccgggagccactcggaccaaccctaacgaccaaagactaactcggggaccaacgggaacccgtggacgccgtctcctacgacgcccgtccaaccgaacggcccaagttccggtacttccccctggccaccccgtccctaccaaacgacggccaacccgtcgtacgggggccaacgacgccacgtccccgtacggggctcggcccttagggtaccgtaaaagggaacctttaaccgttaccgtaacggtaacggcgttacggctacgggacggtccgggcggtacggccggaaaagggacggacctaagtaaacggctgcannagagannngagananagacacannnatnnacgagntncacncacgacacacanacganatac

SEQ ID NO: 254971 - DNA, 566 bp, Homo sapiens
  misc_feature: GYAE6OF02FYEJV.30.45.E01.1.454.CMB.1.raw
  modified_base (194)..(194): a, c, t, g, unknown or other
  misc_feature (194)..(194): n is a, c, g, or t
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
  modified_base (408)..(408): a, c, t, g, unknown or other
  misc_feature (408)..(408): n is a, c, g, or t
  modified_base (531)..(531): a, c, t, g, unknown or other
  misc_feature (531)..(531): n is a, c, g, or t
  modified_base (538)..(538): a, c, t, g, unknown or other
  misc_feature (538)..(538): n is a, c, g, or t
  modified_base (543)..(566): a, c, t, g, unknown or other
  misc_feature (543)..(566): n is a, c, g, or t
tcagcacgctacgtcacgaccggtgctcgatttagtgagtcagtaagggaaggggcggtggagtgggagtttcatatattagtgctggtgctactaccactgaagtacgcagactctgtgaggggccgattccaccattccagggacgacgccaaaggaaatcaagtatatctaacaaatgaagtagctgaganacgaggcacggntgtgtattacngtgcggggcgggagccacncggccaaccctnaaccaagacctacgtggggccagggaaccctggtcgcccggctacctcacgcctccaacgaccgggcccaactaccgggtccttcccccgttgggaccccaaccccgttccctcccgaaatcggcctacccttggcggggccacgaagccaagtccccgngggtacctgacccttgggtaccaaagggaccttaacgtttaccccgtaacggtaacgggtcccgggtataccggttcgaacgggcggggcgttcggggaaccggtaacgcggtcaaacggagnggcagtnacgtnnnnnnnnnnnnnnnnnnnnnnnn

SEQ ID NO: 254972 - DNA, 593 bp, Homo sapiens
  misc_feature: GYAE6OF02GT88G.30.45.E01.1.454.CMB.1.raw
  modified_base (495)..(495): a, c, t, g, unknown or other
  misc_feature (495)..(495): n is a, c, g, or t
  modified_base (503)..(503): a, c, t, g, unknown or other
  misc_feature (503)..(503): n is a, c, g, or t
  modified_base (508)..(508): a, c, t, g, unknown or other
  misc_feature (508)..(508): n is a, c, g, or t
  modified_base (518)..(518): a, c, t, g, unknown or other
  misc_feature (518)..(518): n is a, c, g, or t
  modified_base (522)..(522): a, c, t, g, unknown or other
  misc_feature (522)..(522): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccactcggaccaccctacaccaagactactggggccagggaaccctggtcgccgtctcctcagcctccaccaagggcccatcggtccttccccctggccaccctcctccaagacgcacctcgtcggggcacgacgcacgcccgtgggcctcggccgtggtacaacgggacttaaccgttcccgaaccggttaacgtccggttcggccgtggacggccgggtcgtcgggaccaaaggggccgacgtacgtaacgcgtacgcgtagtcgatacnggtactcngtacncgcgcgcgtntcgngtcacgtcgacgcgtacgtcgtacgtacgtacgtacgtacgtacgtacgtaccgtacgtacgtacgtgtcg

SEQ ID NO: 254973 - DNA, 185 bp, Homo sapiens
  misc_feature: GYAE6OF02H3ANC.30.45.E01.1.454.CMB.1.raw
  modified_base (176)..(185): a, c, t, g, unknown or other
  misc_feature (176)..(185): n is a, c, g, or t
tcagcacgctacgtcacgaccggtgctcgatttagtgagtcagtaagggaaggggctggagtggatttcatatatttagtgctggtgctactaccatgaagtacgcagactctgtgaggggccgattcacatttccagggacgacgccaagaaatcagtatatctacaaatgagtnnnnnnnnnn

SEQ ID NO: 254974 - DNA, 474 bp, Homo sapiens
  misc_feature: GYAE6OF02GWXZN.30.45.E01.1.454.CMB.1.raw
  modified_base (455)..(474): a, c, t, g, unknown or other
  misc_feature (455)..(474): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaacccctggtcgccgtctcctcagcctccaccaacgggcccactcggtccttcccccctggccacccctcctccaagacgccaccctctgggggccacgacgcacgccccgtggggcctcgccgtggtaaaacggacctacttcccacgtagcgtgcgtgaggccgggcgtgggcaagggcgcagtagcgnnnnnnnnnnnnnnnnnnnn

SEQ ID NO: 254975 - DNA, 425 bp, Homo sapiens
  misc_feature: GYAE6OF02HIRYW.30.45.E01.1.454.CMB.1.raw
  modified_base (256)..(256): a, c, t, g, unknown or other
  misc_feature (256)..(256): n is a, c, g, or t
  modified_base (353)..(353): a, c, t, g, unknown or other
  misc_feature (353)..(353): n is a, c, g, or t
  modified_base (413)..(425): a, c, t, g, unknown or other
  misc_feature (413)..(425): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaaagactacgngggccagggaaccctggtcgccgtctcctcacgctccaccaagggcccatcggtcttccccctcggccaccctcctccaagagcacctctggggcanacgcacgccctgggctcgctggtcaacggtactacttaccacgtagcgtcgctgacgggnnnnnnnnnnnnn

SEQ ID NO: 254976 - DNA, 531 bp, Homo sapiens
  misc_feature: GYAE6OF02HAMFG.30.45.E01.1.454.CMB.1.raw
  modified_base (506)..(531): a, c, t, g, unknown or other
  misc_feature (506)..(531): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccacgtcgaccaccctacaccaagactacgtcgggccgacgggaacccgtggtccgccgtcctcctcacgccctccaccgaacgggccccacgtccggttcccttccccccgtcgggccctacccctccctcccaacgacgccacccgtcggtcgggggcaccgacgccgacgccccgtcggggctccggccgtacggtacgaacggtaccgtaccttacccgtacgtacggccgtggcgtggacgggccgggtcgtgggaccgaacgggcgcgagtagcgnnnnnnnnnnnnnnnnnnnnnnnnnn

SEQ ID NO: 254977 - DNA, 561 bp, Homo sapiens
  misc_feature: GYAE6OF02F6NQO.30.45.E01.1.454.CMB.1.raw
  modified_base (224)..(224): a, c, t, g, unknown or other
  misc_feature (224)..(224): n is a, c, g, or t
  modified_base (487)..(487): a, c, t, g, unknown or other
  misc_feature (487)..(487): n is a, c, g, or t
  modified_base (491)..(491): a, c, t, g, unknown or other
  misc_feature (491)..(491): n is a, c, g, or t
  modified_base (495)..(495): a, c, t, g, unknown or other
  misc_feature (495)..(495): n is a, c, g, or t
  modified_base (498)..(498): a, c, t, g, unknown or other
  misc_feature (498)..(498): n is a, c, g, or t
  modified_base (504)..(505): a, c, t, g, unknown or other
  misc_feature (504)..(505): n is a, c, g, or t
  modified_base (511)..(511): a, c, t, g, unknown or other
  misc_feature (511)..(511): n is a, c, g, or t
  modified_base (523)..(523): a, c, t, g, unknown or other
  misc_feature (523)..(523): n is a, c, g, or t
  modified_base (527)..(528): a, c, t, g, unknown or other
  misc_feature (527)..(528): n is a, c, g, or t
  modified_base (533)..(533): a, c, t, g, unknown or other
  misc_feature (533)..(533): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (548)..(548): a, c, t, g, unknown or other
  misc_feature (548)..(548): n is a, c, g, or t
  modified_base (556)..(556): a, c, t, g, unknown or other
  misc_feature (556)..(556): n is a, c, g, or t
  modified_base (558)..(558): a, c, t, g, unknown or other
  misc_feature (558)..(558): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgagttcaccatttccagggacgacgccaagaaatcagtatatctacaaatgagtagcctgagagacgaggacacggctgtgtattactgtgcgggccggganccactcggaccaccgtacaccaagacctacgtggggccacgggaacctggtccgccgtctcctcacgccgtccaccgaaggcccatccggtcttccccgtggcctaccctcctaccaacgacgccaccgtccggtcggggccaacgcgccacgtcccgtcgggactcggccgtggtcgaaacggtacctacgttcccaacggtaacgtccgtacgccgtaggacggtcgggctacgggtcaacgggtccgacgtacgttaggntagnacgngcngagcgnnctgcgngcgagcgcgtgngcgnnacgtntactctcgngngcgngtgcgcgngngcg

SEQ ID NO: 254978 - DNA, 489 bp, Homo sapiens
  misc_feature: GYAE6OF02GHYQQ.30.45.E01.1.454.CMB.1.raw
  modified_base (224)..(224): a, c, t, g, unknown or other
  misc_feature (224)..(224): n is a, c, g, or t
  modified_base (449)..(449): a, c, t, g, unknown or other
  misc_feature (449)..(449): n is a, c, g, or t
  modified_base (456)..(458): a, c, t, g, unknown or other
  misc_feature (456)..(458): n is a, c, g, or t
  modified_base (460)..(489): a, c, t, g, unknown or other
  misc_feature (460)..(489): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggganccactcggacccaccctacaccaagactacgtgggggaccaggggaaccctggtcgccggtctcctcagccctccaccaagggcccatcggtcttccccctggcaccctcctccaagtacgcacctcgtcgggggcacagcacgcccgtgggctcgcctggtcgaaggtactaccttccacgtacgcgtcgcgtgcgacgggctgggcaagggcgcagttaggcntcatgannngnnnnnnnnnnnnnnnnnnnnnnnnnnnnnn

SEQ ID NO: 254979 - DNA, 567 bp, Homo sapiens
  misc_feature: GYAE6OF02FFWXJ.30.45.E01.1.454.CMB.1.raw
  modified_base (209)..(209): a, c, t, g, unknown or other
  misc_feature (209)..(209): n is a, c, g, or t
  modified_base (222)..(222): a, c, t, g, unknown or other
  misc_feature (222)..(222): n is a, c, g, or t
  modified_base (484)..(484): a, c, t, g, unknown or other
  misc_feature (484)..(484): n is a, c, g, or t
  modified_base (500)..(501): a, c, t, g, unknown or other
  misc_feature (500)..(501): n is a, c, g, or t
  modified_base (536)..(536): a, c, t, g, unknown or other
  misc_feature (536)..(536): n is a, c, g, or t
  modified_base (548)..(548): a, c, t, g, unknown or other
  misc_feature (548)..(548): n is a, c, g, or t
  modified_base (553)..(553): a, c, t, g, unknown or other
  misc_feature (553)..(553): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (564)..(564): a, c, t, g, unknown or other
  misc_feature (564)..(564): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattacngtgcgggcggganccactcggaccaccgtacaccaagacctacgtggggaccagggaaccctggtcgccgtctcctcagccctccaccaacgggcccagtcggtccttcccctggccaccctcctccagacgcacctcgtggggccacgagccgacgcccgtggggcctcggccgtggtaccaaacggaccgttaaccttcccgacggttacggtaccgtggccgttaggacgcccggggtctcgggtaccgaacgggccggacgtaacgtacgngacgactcgagacgcnncgagagcgcgagacgacgacgcgcgacgacgcacncgacgcacgacnctgcncgcgnancgcngtc

SEQ ID NO: 254980 - DNA, 516 bp, Homo sapiens
  misc_feature: GYAE6OF02IY6F3.30.45.E01.1.454.CMB.1.raw
  modified_base (354)..(354): a, c, t, g, unknown or other
  misc_feature (354)..(354): n is a, c, g, or t
  modified_base (449)..(449): a, c, t, g, unknown or other
  misc_feature (449)..(449): n is a, c, g, or t
  modified_base (467)..(467): a, c, t, g, unknown or other
  misc_feature (467)..(467): n is a, c, g, or t
  modified_base (476)..(479): a, c, t, g, unknown or other
  misc_feature (476)..(479): n is a, c, g, or t
  modified_base (481)..(481): a, c, t, g, unknown or other
  misc_feature (481)..(481): n is a, c, g, or t
  modified_base (483)..(485): a, c, t, g, unknown or other
  misc_feature (483)..(485): n is a, c, g, or t
  modified_base (487)..(487): a, c, t, g, unknown or other
  misc_feature (487)..(487): n is a, c, g, or t
  modified_base (489)..(516): a, c, t, g, unknown or other
  misc_feature (489)..(516): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccgattcacatttccagggacgacgccaagaaatcagtatatctacaaatgagtagcctgagagacgaggacacggctgtgtatactgtgcgggccgggagccactcggaccacctacaccaagactacgcggggccaggaaccctggcgccgctccgtcacgcctcccacgaaggccctaactcggtccttcccccgtggcccaccccgtcctaccaagacgccaccgtcgnggggtacacgcgaccacggcccgtggggacttccgccgtgggtaccaaagggtcctaacgttacccgacggtacgcggtcgacgtcgagccgggngtacgggcgaaggtccgngtaatacgnnnncncnnngncnnnnnnnnnnnnnnnnnnnnnnnnnnnn

SEQ ID NO: 254981 - DNA, 430 bp, Homo sapiens
  misc_feature: GYAE6OF02GFR2M.30.45.E01.1.454.CMB.1.raw
  modified_base (425)..(430): a, c, t, g, unknown or other
  misc_feature (425)..(430): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaacccctggtcgccgtctcctcagcctccaccaacgggcccatcggtcttccccctcggcacccctcctccaagagcacctctgggggcacagcagccctgggctgcctggtcaaggactactccacgtcgcgtgctgagcggcgtggcgaggcgcatagnnnnnn

SEQ ID NO: 254982 - DNA, 546 bp, Homo sapiens
  misc_feature: GYAE6OF02HMA5T.30.45.E01.1.454.CMB.1.raw
  modified_base (511)..(546): a, c, t, g, unknown or other
  misc_feature (511)..(546): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagcccactcggacccaccctacaaccaagactacgtggggccaagggaaccctggtccgcccgtctcctcacgccctcccaccgaacgggccccacgtccggtcccttccccccgtgggccctacccccttccctacccaaacgacgcctaacccgtcgtacgggggccacgaggcccggacccgtgggctcgcccgttgggacaaacgggtacttaccgttccgaccggtagcggtcgtcgtggacggccggggtctagggccgaaggggtccgacgtaagtaggacnnnnnnnnnnnnnnnnnnnnnnnnnnnnnnnnnnnn

SEQ ID NO: 254983 - DNA, 465 bp, Homo sapiens
  misc_feature: GYAE6OF02FV32B.30.45.E01.1.454.CMB.1.raw
  modified_base (225)..(225): a, c, t, g, unknown or other
  misc_feature (225)..(225): n is a, c, g, or t
  modified_base (339)..(339): a, c, t, g, unknown or other
  misc_feature (339)..(339): n is a, c, g, or t
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
  modified_base (427)..(427): a, c, t, g, unknown or other
  misc_feature (427)..(427): n is a, c, g, or t
  modified_base (431)..(465): a, c, t, g, unknown or other
  misc_feature (431)..(465): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccgggganccactccggaccaccctacaccaagacctactggggccagggaacccctgggtcgccgtctcctcagcctccaccagggcccatcggtcttccccctggcaccctcctccaagngcacctcngggggcacngcagccctgggctgcctggtcaaggactacttcacgtagctgctgagcgggctggcaaggccgcagtagcntcgnnnnnnnnnnnnnnnnnnnnnnnnnnnnnnnnnnn

SEQ ID NO: 254984 - DNA, 478 bp, Homo sapiens
  misc_feature: GYAE6OF02F6X7Z.30.45.E01.1.454.CMB.1.raw
  modified_base (225)..(225): a, c, t, g, unknown or other
  misc_feature (225)..(225): n is a, c, g, or t
  modified_base (444)..(445): a, c, t, g, unknown or other
  misc_feature (444)..(445): n is a, c, g, or t
  modified_base (449)..(478): a, c, t, g, unknown or other
  misc_feature (449)..(478): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccgggganccactcggaccaccctacaccaagactacgtggggccagggaaccctggtacgccggtctcctcagccctccaccaacgggcccatcggtccttccccctgggccacccgtcctccaacgtacgccacctcgtgggggccacagcacgcccgtgggctcggcctcggtcaaggactacttccacgtagcgtgctgagcgggctggcaaggcgcagtagnntcgnnnnnnnnnnnnnnnnnnnnnnnnnnnnnn

SEQ ID NO: 254985 - DNA, 503 bp, Homo sapiens
  misc_feature: GYAE6OF02F3Y5O.30.45.E01.1.454.CMB.1.raw
  modified_base (435)..(435): a, c, t, g, unknown or other
  misc_feature (435)..(435): n is a, c, g, or t
  modified_base (460)..(460): a, c, t, g, unknown or other
  misc_feature (460)..(460): n is a, c, g, or t
  modified_base (470)..(503): a, c, t, g, unknown or other
  misc_feature (470)..(503): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccatttcccagggacgacgccaagaaatcagtatatctacaaatgagtagcctgagagacgaggacacggctgtgtattactgtgcgggccggggaccatcggacccaccctacaccaagactacgtgggggccagggaaccctggtcgccgtctcctcagccctccaccaacgggcccatcggtaccttcccccctggccacccctcctcccaagacgccaccctcgtcgggggccacacgccacgccccgtggggctcgcccgttggcaagggaccttaccttacccttctcctcgaaccttcnggtacgcgggactggacgaagggcncgatagcagnnnnnnnnnnnnnnnnnnnnnnnnnnnnnnnnnn

SEQ ID NO: 254986 - DNA, 642 bp, Homo sapiens
  misc_feature: GYAE6OF02H5HG4.30.45.E01.1.454.CMB.1.raw
  modified_base (384)..(384): a, c, t, g, unknown or other
  misc_feature (384)..(384): n is a, c, g, or t
  modified_base (534)..(534): a, c, t, g, unknown or other
  misc_feature (534)..(534): n is a, c, g, or t
  modified_base (548)..(548): a, c, t, g, unknown or other
  misc_feature (548)..(548): n is a, c, g, or t
  modified_base (559)..(559): a, c, t, g, unknown or other
  misc_feature (559)..(559): n is a, c, g, or t
  modified_base (578)..(578): a, c, t, g, unknown or other
  misc_feature (578)..(578): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccattttccagggacgacgccaagaaatcagtatatctaacaaatgagtagcctgagagacgaggacacggctgtgtattactggtgacggggccgggagccacgtcggaccacctacaccaagactacgtcggggccaggggaaccctggtcgccgtctcctcacgcctccaccaagggcccagtcgtaccttcccctggccacccgtcctccaagcgcaccctacggtggggaccacgtacgacgacgccccgnggggtcctcgtaccgtcgggtacgaaacgggtacctttaacttacccgaacgttacgaccgggtttacgtacggtcggttaacgggggcccgggtccggttacggggacttaaaccgggggccgaccgtaaaacgttcgggataccgggngtcgactagacacnctagtcgtcgngacgtctacgtccgtacgngactactacgtactacgtacgtctaccgactacgtacgtacgacgtacacgacgagtacgcgcg

SEQ ID NO: 254987 - DNA, 524 bp, Homo sapiens
  misc_feature: GYAE6OF02JFU2O.30.45.E01.1.454.CMB.1.raw
  modified_base (489)..(490): a, c, t, g, unknown or other
  misc_feature (489)..(490): n is a, c, g, or t
  modified_base (492)..(524): a, c, t, g, unknown or other
  misc_feature (492)..(524): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggcgggagccactcggaccaccctacaccaagactacgtggggaccgagggaaccctggtcgccgtcgtcctcacgcctccaccacgggcccacgtcggtccttcccccgcggccacccctcctccgaacgcgaccaccctcgtcgggggacacgacgccacgcccgtcgggctccgccgtcggtacgaacggtaccttaccgttacccgacggttaccggcgttcgtccgtggacggcgggtccgtcgggacgaacggcgtacgacgttcgagnngnnnnnnnnnnnnnnnnnnnnnnnnnnnnnnnnn

SEQ ID NO: 254988 - DNA, 153 bp, Homo sapiens; identical to SEQ ID NO: 254506
  misc_feature: GYAE6OF02G84HE.30.45.E01.1.454.CMB.1.raw
  modified_base (153)..(153): a, c, t, g, unknown or other
  misc_feature (153)..(153): n is a, c, g, or t

SEQ ID NO: 254989 - DNA, 494 bp, Homo sapiens
  misc_feature: GYAE6OF02GH8G9.30.45.E01.1.454.CMB.1.raw
  modified_base (469)..(494): a, c, t, g, unknown or other
  misc_feature (469)..(494): n is a, c, g, or t
tcagcacgctacgtcacgaccggtgctcgatttagtgagtcagtaagggaaggggctggagtggatttcatatattagtgctggtgctactaccatgaagtacgcagactctgtgagggggccgattcaccatttccaggggacgacgccaagaaatcagtatatctacaaatgagtagcctgagagacgaggacacggctgtgtattactgtgcggggccgggagccacgtcggacccaccctacaccaagactacgtcggggccgacgggaaccctggtcgccgtctcctcagccctccaccaacgggcccatcggtccttccccctggcctaccctccctccaagacgcacctcgtcgggggcacgacgcgacgcccgtgggctcgcccgtggtccgaaaggtacctacttcccgacggtacgcggttgctggacggcgggcgtagggccgaagggccgacagtgnnnnnnnnnnnnnnnnnnnnnnnnnn

SEQ ID NO: 254990 - DNA, 641 bp, Homo sapiens
  misc_feature: GYAE6OF02I9XGN.30.45.E01.1.454.CMB.1.raw
  modified_base (238)..(238): a, c, t, g, unknown or other
  misc_feature (238)..(238): n is a, c, g, or t
  modified_base (258)..(258): a, c, t, g, unknown or other
  misc_feature (258)..(258): n is a, c, g, or t
  modified_base (293)..(293): a, c, t, g, unknown or other
  misc_feature (293)..(293): n is a, c, g, or t
  modified_base (406)..(406): a, c, t, g, unknown or other
  misc_feature (406)..(406): n is a, c, g, or t
  modified_base (413)..(413): a, c, t, g, unknown or other
  misc_feature (413)..(413): n is a, c, g, or t
  modified_base (517)..(517): a, c, t, g, unknown or other
  misc_feature (517)..(517): n is a, c, g, or t
  modified_base (526)..(526): a, c, t, g, unknown or other
  misc_feature (526)..(526): n is a, c, g, or t
tcagcacgctacgtcacgaccggtgctcgatttagtgagtcagtaagggaaaggggctggagtggatttcatatattagtgctggtgctactaccgatgaagtacgctagactctgtggaggggccgattcaccatttccagggacgacgccaagaaatcagtatagtactaacaaaacgtgattagcctagacgaagacgtaggacacggctgtgtaatactgtcgcggggcggganccacgtcggacccaccgtanaccaagctacggtggggccacgggaaaccctggcnccggtactcccgtactcggcctccaccgtaacgggcctatccgggtccttaccccgtggcctaccctcgtaccgaagtacgacaccttcggtcggggcacgacgtcggtccgngggtacncggtcctagggtacaaacggtccttaaccgtttccgtcttaccgcgtaccttactaccggacggtcggcgtacgggagtacgggcgtacgtaacgttgaaccgngtcgacganacgtctaagcatcgtggcgtacacgcgtacgtagaacgagcaagacgtacgtacgacgtacgtacgtacgtacgtacgtacgtacggtccggtcgtacgtaccgtacgtcgtacg

SEQ ID NO: 254991 - DNA, 522 bp, Homo sapiens
  misc_feature: GYAE6OF02I9NHM.30.45.E01.1.454.CMB.1.raw
  modified_base (499)..(499): a, c, t, g, unknown or other
  misc_feature (499)..(499): n is a, c, g, or t
  modified_base (502)..(522): a, c, t, g, unknown or other
  misc_feature (502)..(522): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactccggacccaccctacaccaagactactcggggccacgggaaccctggtcgcccgtctccctcacgccctccaccgaacgggccccacgtccggttcccttccccccgtcgggcccaccccctccctacccaacgacgcctaccctccggtcgggggaccacgacgccgacgccccgtggggcctcgcccgtcgggtacgaacggtacctaccttccacggtacggtccgtcgcgtggacggcgggcgtcgggaccgaagggccgacanagnnnnnnnnnnnnnnnnnnnnn

SEQ ID NO: 254992 - DNA, 511 bp, Homo sapiens
  misc_feature: GYAE6OF02FJJNG.30.45.E01.1.454.CMB.1.raw
  modified_base (223)..(223): a, c, t, g, unknown or other
  misc_feature (223)..(223): n is a, c, g, or t
  modified_base (236)..(236): a, c, t, g, unknown or other
  misc_feature (236)..(236): n is a, c, g, or t
  modified_base (469)..(469): a, c, t, g, unknown or other
  misc_feature (469)..(469): n is a, c, g, or t
  modified_base (474)..(475): a, c, t, g, unknown or other
  misc_feature (474)..(475): n is a, c, g, or t
  modified_base (477)..(489): a, c, t, g, unknown or other
  misc_feature (477)..(489): n is a, c, g, or t
  modified_base (491)..(494): a, c, t, g, unknown or other
  misc_feature (491)..(494): n is a, c, g, or t
  modified_base (496)..(511): a, c, t, g, unknown or other
  misc_feature (496)..(511): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccattcaccatttccagggacacgccaagaaatcagtatatctacaaatgagtagcctgagagacgaggacacggctgtgtattactgtgccggggccggganccacctcggaccnccctacaccaagtcctacgtggggaccgacgggaaccctcggtcgcccgtctccctcacgcctccaccaacgggcccagtaccggtccttccccctaggcccacccgtccctccaagacgccaccgtctcgggggccaacgacgcgtacgcccgtgggcctcgcctggacacggacctaaccgtcccacgtagcgtgtctggacgcggacgtcggacgaacggccacgatagnagtcnngnnnnnnnnnnnnncnnnncnnnnnnnnnnnnnnnn

SEQ ID NO: 254993 - DNA, 461 bp, Homo sapiens
  misc_feature: GYAE6OF02GZ2TU.30.45.E01.1.454.CMB.1.raw
  modified_base (368)..(368): a, c, t, g, unknown or other
  misc_feature (368)..(368): n is a, c, g, or t
  modified_base (434)..(461): a, c, t, g, unknown or other
  misc_feature (434)..(461): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactgggggccagggaacccctggtcgccgtctcctcagcctccaccaagggccccaatcggtcttcccccctggccaccctcctccaagacgcacctctgggggcacgagcagcccngggctgctggcaaggactacgtccagtagcgtgcctgacgcgggctgggcaaaggcgcaagtagannnnnnnnnnnnnnnnnnnnnnnnnnnn

SEQ ID NO: 254994 - DNA, 533 bp, Homo sapiens
  misc_feature: GYAE6OF02IEI8C.30.45.E01.1.454.CMB.1.raw
  modified_base (493)..(493): a, c, t, g, unknown or other
  misc_feature (493)..(493): n is a, c, g, or t
  modified_base (500)..(500): a, c, t, g, unknown or other
  misc_feature (500)..(500): n is a, c, g, or t
  modified_base (502)..(533): a, c, t, g, unknown or other
  misc_feature (502)..(533): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactacgtggggccagggaaccctggtccgccgtcctccgtcagccctccgaaccaacggggccccagtcccggggttaccttcccccccgtgggacccctacccctccctcccaaacgacgccacccttcgtcgggggccacgagcacgccccgtgggctgccgtggtcaacggtactacttcccgacgtcgtcgtcgcgttggacggccgggctcgggacgaaagggccgacgagtaggctancgctgcngnnnnnnnnnnnnnnnnnnnnnnnnnnnnnnnn

SEQ ID NO: 254995 - DNA, 441 bp, Homo sapiens
  misc_feature: GYAE6OF02G7BD8.30.45.E01.1.454.CMB.1.raw
  modified_base (224)..(224): a, c, t, g, unknown or other
  misc_feature (224)..(224): n is a, c, g, or t
  modified_base (412)..(412): a, c, t, g, unknown or other
  misc_feature (412)..(412): n is a, c, g, or t
  modified_base (421)..(421): a, c, t, g, unknown or other
  misc_feature (421)..(421): n is a, c, g, or t
  modified_base (427)..(441): a, c, t, g, unknown or other
  misc_feature (427)..(441): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggganccactcggaccacccctacaccaagactacgtggggccagggaaccctggtcgccgtctcctcagcctccaccaaggcccatcggtcttcccccgtggccacccctcctccaacgagcacctctcgggggcacagcacgccctgggctgcctggtcaacggctactccacgtagcgtgctgagcgggntggcaggcncatagnnnnnnnnnnnnnnn

SEQ ID NO: 254996 - DNA, 657 bp, Homo sapiens
  misc_feature: GYAE6OF02FQ3QC.30.45.E01.1.454.CMB.1.raw
  modified_base (231)..(231): a, c, t, g, unknown or other
  misc_feature (231)..(231): n is a, c, g, or t
  modified_base (619)..(620): a, c, t, g, unknown or other
  misc_feature (619)..(620): n is a, c, g, or t
  modified_base (622)..(624): a, c, t, g, unknown or other
  misc_feature (622)..(624): n is a, c, g, or t
  modified_base (626)..(626): a, c, t, g, unknown or other
  misc_feature (626)..(626): n is a, c, g, or t
  modified_base (629)..(631): a, c, t, g, unknown or other
  misc_feature (629)..(631): n is a, c, g, or t
  modified_base (633)..(643): a, c, t, g, unknown or other
  misc_feature (633)..(643): n is a, c, g, or t
  modified_base (645)..(657): a, c, t, g, unknown or other
  misc_feature (645)..(657): n is a, c, g, or t
tcagcacgctacgtcacgaccggtgctcgatttagtgagtcagtaagggaaagggggctggagtggatttcatatattagtgctgggtgctactaccatgaagtacgcagactctgtgacggggccgattcacctatttccagggacgacgccaaagaaatcagtatatctacaaatgagtagcctgagagacgaggacacggctgtgtattactgtgcggggccgggganccacgtcggaccacccttacaccaagacctacgtcgggggaccacggggaacccctgggtcgacccggtctcccgtcctacggcccctccaaccgaacggggccccaacgtcccgggttcctttcccccccgtgggaccctcccccttcccttaccccgaaaacggacgacccgtaacccctttcccggttcggggggggacccaacggacgacccgaaccggtcccccgttgggggaacccgtccgggtccctttcgggggtacaaaccggggtaccttaacccggtttttccctccttaccgttccccgaccgtttcccggttgaaccgggtccggggtccgttagggacccgaacgggaccggaccgtaggtaacgcgtcaggcnncnnncncgnnngnnnnnnnnnnncnnnnnnnnnnnnn

SEQ ID NO: 254997 - DNA, 434 bp, Homo sapiens
  misc_feature: GYAE6OF02GWDAG.30.45.E01.1.454.CMB.1.raw
  modified_base (423)..(434): a, c, t, g, unknown or other
  misc_feature (423)..(434): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctaagcctccaccaagggcccatcggtcttcccccctggcaccctcctccaagagcacctctgggggcacagcagccctgggctgcctggtcaaggactacttccacgtagcgtgctgagcgggctggcaggcgcatagnnnnnnnnnnnn

SEQ ID NO: 254998 - DNA, 557 bp, Homo sapiens
  misc_feature: GYAE6OF02IH3XI.30.45.E01.1.454.CMB.1.raw
  modified_base (521)..(557): a, c, t, g, unknown or other
  misc_feature (521)..(557): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccacgtcggaccaccctaccaccaagactacgtcggggccacgggaaccctggtccgccgtcctcctcacgcctcccaccgaacgggccccagtccggtcccttcccccgtggcccacccctccctaccaagacgccacccgtcggtcgggggccaacgacgacgacgtccccggtggggtcctcggcccgtcgggtaccgaaacgggtacccttaccgttacccgtaacggtacgccggttcgaccgtaggacgggccgggcgtacgggaccgaacgggccgacaagtacgagcnnnnnnnnnnnnnnnnnnnnnnnnnnnnnnnnnnnnn

SEQ ID NO: 254999 - DNA, 508 bp, Homo sapiens
  misc_feature: GYAE6OF02HS2UQ.30.45.E01.1.454.CMB.1.raw
  modified_base (449)..(449): a, c, t, g, unknown or other
  misc_feature (449)..(449): n is a, c, g, or t
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
  modified_base (476)..(508): a, c, t, g, unknown or other
  misc_feature (476)..(508): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctaacaaatgagtagcctgagagacgaggacacggctgtgtattactgtgcgggccgggggagccacgtcggaccaccctacaccaagactacgtcggggccacgggaaccctggtccgccgtctcctcagcccctcccacccgaacgggccccaagtcccggtccttcccccgtcggcccgaccctccctaccaacgacgccaacctcgtcggggacacgacgcacgcccgtgggctacggtccgtgcgaaaggactactcccagtacgcgtgctgcggcggtcnggtacgaaggtcgacatagnancgatnnnnnnnnnnnnnnnnnnnnnnnnnnnnnnnnn

SEQ ID NO: 255000 - DNA, 458 bp, Homo sapiens
  misc_feature: GYAE6OF02F3NXF.30.45.E01.1.454.CMB.1.raw
  modified_base (287)..(287): a, c, t, g, unknown or other
  misc_feature (287)..(287): n is a, c, g, or t
  modified_base (443)..(458): a, c, t, g, unknown or other
  misc_feature (443)..(458): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcancctccaccgaacgggcccatcggtccttcccccctggccaccctccctccaagacgccacctcgtgggggccacagcacgccccgtgggctcgcctcggtacaaggactacttcccacgtagcgtgctgacggcgggctgggcgaaggcgcatagnnnnnnnnnnnnnnnn

SEQ ID NO: 255001 - DNA, 456 bp, Homo sapiens
  misc_feature: GYAE6OF02GG3VB.30.45.E01.1.454.CMB.1.raw
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
  modified_base (273)..(274): a, c, t, g, unknown or other
  misc_feature (273)..(274): n is a, c, g, or t
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
  modified_base (398)..(398): a, c, t, g, unknown or other
  misc_feature (398)..(398): n is a, c, g, or t
  modified_base (419)..(419): a, c, t, g, unknown or other
  misc_feature (419)..(419): n is a, c, g, or t
  modified_base (421)..(456): a, c, t, g, unknown or other
  misc_feature (421)..(456): n is a, c, g, or t
tcagcacgctacgtcacgaccggtgctcgatttagtgagtcagtaagggaagggggctgggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggcgggagccatcggaccacctanacaanacangggcaggaccngcgccgtctctcnncctcaccaggccatcgtcctccccnggcaccctcctcaagacncacctcgtggggcacgngcagcccnggggctgcctggtactaacggactaccgttccacgtacgcgtgccgtagaggcggngtcggcgaaggcgcagtacgnannnnnnnnnnnnnnnnnnnnnnnnnnnnnnnnnnnn

SEQ ID NO: 255002 - DNA, 530 bp, Homo sapiens
  misc_feature: GYAE6OF02JIUND.30.45.E01.1.454.CMB.1.raw
  modified_base (226)..(226): a, c, t, g, unknown or other
  misc_feature (226)..(226): n is a, c, g, or t
  modified_base (339)..(339): a, c, t, g, unknown or other
  misc_feature (339)..(339): n is a, c, g, or t
  modified_base (488)..(488): a, c, t, g, unknown or other
  misc_feature (488)..(488): n is a, c, g, or t
  modified_base (492)..(494): a, c, t, g, unknown or other
  misc_feature (492)..(494): n is a, c, g, or t
  modified_base (496)..(500): a, c, t, g, unknown or other
  misc_feature (496)..(500): n is a, c, g, or t
  modified_base (502)..(530): a, c, t, g, unknown or other
  misc_feature (502)..(530): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacacgccaagaaatcagtatatctacaaatgagtagcctgagagacgaggacacggctgtgtattactggtgccggggccggggancccacgtcggacccaccctacaccgaagactacgtggggccagggaaccctggtcgccgtctcctcagcctccaccgaggcccatcgtcctcccctggccaccctctccaagngccaccctgtcgggggccacgacgcaaccggtccgtacgggtcaccggccgtgggttaccgaaacggtacccgttaccttaccccgtaacggtacggtccgtacgccggtaggacgtccggggcctcgggacgaacgggcgcagtacgngacnnncnnnnncnnnnnnnnnnnnnnnnnnnnnnnnnnnnn

SEQ ID NO: 255003 - DNA, 553 bp, Homo sapiens
  misc_feature: GYAE6OF02F4KC9.30.45.E01.1.454.CMB.1.raw
  modified_base (415)..(415): a, c, t, g, unknown or other
  misc_feature (415)..(415): n is a, c, g, or t
  modified_base (454)..(454): a, c, t, g, unknown or other
  misc_feature (454)..(454): n is a, c, g, or t
  modified_base (496)..(496): a, c, t, g, unknown or other
  misc_feature (496)..(496): n is a, c, g, or t
  modified_base (514)..(514): a, c, t, g, unknown or other
  misc_feature (514)..(514): n is a, c, g, or t
  modified_base (518)..(519): a, c, t, g, unknown or other
  misc_feature (518)..(519): n is a, c, g, or t
  modified_base (521)..(521): a, c, t, g, unknown or other
  misc_feature (521)..(521): n is a, c, g, or t
  modified_base (523)..(524): a, c, t, g, unknown or other
  misc_feature (523)..(524): n is a, c, g, or t
  modified_base (527)..(527): a, c, t, g, unknown or other
  misc_feature (527)..(527): n is a, c, g, or t
  modified_base (529)..(535): a, c, t, g, unknown or other
  misc_feature (529)..(535): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (541)..(542): a, c, t, g, unknown or other
  misc_feature (541)..(542): n is a, c, g, or t
  modified_base (544)..(547): a, c, t, g, unknown or other
  misc_feature (544)..(547): n is a, c, g, or t
  modified_base (549)..(553): a, c, t, g, unknown or other
  misc_feature (549)..(553): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtggcggggccgggagccacgtccggaaccacccgtacaaccaagacctacgtcgggggccaacggggaacccctgggtccgcccgttctcctcacgccctccaccgaacgggcccagtccggtaccttcccccgtggcccgtacccctccctaccgaacgacgacctaacctcgtacgggggccacacgccacgcccgtcggcncgtcctggacgaaggtactacctaccgacgtagtccgtncgtgacggcgggtactcgggacaacgggcacgtaagtacggnacgtgcgtgaacggtcgncganncngnnacngnnnnnnngncncnncnnnngnnnnn

SEQ ID NO: 255004 - DNA, 455 bp, Homo sapiens
  misc_feature: GYAE6OF02I8FGQ.30.45.E01.1.454.CMB.1.raw
  modified_base (429)..(455): a, c, t, g, unknown or other
  misc_feature (429)..(455): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccgattcaccatttccagggacgacgccaagaaatcagtatatctacaaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctggggctgcctggtcaaagggactacttccacgtagcgtgctgagcgggctgggcaaggcgcaatagnnnnnnnnnnnnnnnnnnnnnnnnnnn

SEQ ID NO: 255005 - DNA, 556 bp, Homo sapiens
  misc_feature: GYAE6OF02H73SZ.30.45.E01.1.454.CMB.1.raw
  modified_base (145)..(145): a, c, t, g, unknown or other
  misc_feature (145)..(145): n is a, c, g, or t
  modified_base (222)..(222): a, c, t, g, unknown or other
  misc_feature (222)..(222): n is a, c, g, or t
  modified_base (368)..(368): a, c, t, g, unknown or other
  misc_feature (368)..(368): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (517)..(517): a, c, t, g, unknown or other
  misc_feature (517)..(517): n is a, c, g, or t
  modified_base (520)..(524): a, c, t, g, unknown or other
  misc_feature (520)..(524): n is a, c, g, or t
  modified_base (526)..(534): a, c, t, g, unknown or other
  misc_feature (526)..(534): n is a, c, g, or t
  modified_base (536)..(544): a, c, t, g, unknown or other
  misc_feature (536)..(544): n is a, c, g, or t
  modified_base (546)..(556): a, c, t, g, unknown or other
  misc_feature (546)..(556): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggcgacnccaagaaatcagtatatctacaaatgagtagcctgagagacgaggacacggctgtgtattactgtgcgggccggggngccactcggaccaaccctacaccaagactactgggggaccaggggaacccctggtccgccgtcctaccctcagcccttcccaccgaacggggccccagtcccgggttcctttcccccctgggcctacccccgtcctcccaaggacncctacctcgtgggggacaccgngacncggccccgtggggtacctcgcccgttggaccgaaggtaccttaccttcccgtaacgtacggtccggtggccgtaggacggtccgggtcgtgggaccggaaacgggtcgaccgaagtggcagcngannnnncnnnnnnnnncnnnnnnnnncnnnnnnnnnnn

SEQ ID NO: 255006 - DNA, 515 bp, Homo sapiens
  misc_feature: GYAE6OF02FGJM7.30.45.E01.1.454.CMB.1.raw
  modified_base (223)..(223): a, c, t, g, unknown or other
  misc_feature (223)..(223): n is a, c, g, or t
  modified_base (239)..(239): a, c, t, g, unknown or other
  misc_feature (239)..(239): n is a, c, g, or t
  modified_base (475)..(475): a, c, t, g, unknown or other
  misc_feature (475)..(475): n is a, c, g, or t
  modified_base (482)..(515): a, c, t, g, unknown or other
  misc_feature (482)..(515): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagccctgagagacgaggacacggctgtgtattactgtgcgggcggganccactcggaccacctnaccaagactacgtggggccagggaaccctggtcgccggtctcctcacgcctccaccagggccccatcggtacttccccctggccaccctcctccaagacgcaccctcgtgggggtacacgagccacggccctggggctcgccgtggtacgaaggaccttaccgtttcctacctccgttccgacctcgtcggtaacggccggggtcgtggaccgtaaacgggcgaccgaagtacggnagcatcnnnnnnnnnnnnnnnnnnnnnnnnnnnnnnnnnn

SEQ ID NO: 255007 - DNA, 519 bp, Homo sapiens
  misc_feature: GYAE6OF02FTHNY.30.45.E01.1.454.CMB.1.raw
  modified_base (221)..(221): a, c, t, g, unknown or other
  misc_feature (221)..(221): n is a, c, g, or t
  modified_base (441)..(441): a, c, t, g, unknown or other
  misc_feature (441)..(441): n is a, c, g, or t
  modified_base (443)..(443): a, c, t, g, unknown or other
  misc_feature (443)..(443): n is a, c, g, or t
  modified_base (448)..(448): a, c, t, g, unknown or other
  misc_feature (448)..(448): n is a, c, g, or t
  modified_base (452)..(452): a, c, t, g, unknown or other
  misc_feature (452)..(452): n is a, c, g, or t
  modified_base (454)..(454): a, c, t, g, unknown or other
  misc_feature (454)..(454): n is a, c, g, or t
  modified_base (461)..(461): a, c, t, g, unknown or other
  misc_feature (461)..(461): n is a, c, g, or t
  modified_base (463)..(463): a, c, t, g, unknown or other
  misc_feature (463)..(463): n is a, c, g, or t
  modified_base (468)..(468): a, c, t, g, unknown or other
  misc_feature (468)..(468): n is a, c, g, or t
  modified_base (470)..(470): a, c, t, g, unknown or other
  misc_feature (470)..(470): n is a, c, g, or t
  modified_base (487)..(487): a, c, t, g, unknown or other
  misc_feature (487)..(487): n is a, c, g, or t
  modified_base (491)..(491): a, c, t, g, unknown or other
  misc_feature (491)..(491): n is a, c, g, or t
  modified_base (501)..(501): a, c, t, g, unknown or other
  misc_feature (501)..(501): n is a, c, g, or t
  modified_base (510)..(512): a, c, t, g, unknown or other
  misc_feature (510)..(512): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtatactgtgcgggcggganccactcggaccacctacaccaagactactgggccaggaaccctggtcgccgtctcctcagcctccaccaacgggcccatacggtcttccccctgccgaccctcctaccaagagcacctcgtggggcacgagcacgcccgtgggttcgccgtggtcaaggacctacttccacgtagcgtgactggacgcggggctgggccaaagggccgactaagtacgancngatgncagngnacttgananagagncnagacgagtagtacgtanacgngtagcgaganacgacgcannnacgagac

SEQ ID NO: 255008 - DNA, 518 bp, Homo sapiens
  misc_feature: GYAE6OF02GKUG2.30.45.E01.1.454.CMB.1.raw
  modified_base (224)..(224): a, c, t, g, unknown or other
  misc_feature (224)..(224): n is a, c, g, or t
  modified_base (479)..(479): a, c, t, g, unknown or other
  misc_feature (479)..(479): n is a, c, g, or t
  modified_base (483)..(486): a, c, t, g, unknown or other
  misc_feature (483)..(486): n is a, c, g, or t
  modified_base (488)..(518): a, c, t, g, unknown or other
  misc_feature (488)..(518): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggnccactcggaccaccctacaccaagactacgtggggccagggaaccctggtacgccgtctcctcagccctccacaagggcccatcggtccttccccctcggccaccccgtccctccaagacgccaccctcgtcgggggcacgagccacgcccgtggggctcggcctggtacgaaggtaccttaacttcccgaacggttacggcgtcggctagggacggcggggccgtgggaccgaagggccggtacgtaacgtagncgannnngnnnnnnnnnnnnnnnnnnnnnnnnnnnnnnn

SEQ ID NO: 255009 - DNA, 526 bp, Homo sapiens
  misc_feature: GYAE6OF02GW0Q4.30.45.E01.1.454.CMB.1.raw
  modified_base (229)..(229): a, c, t, g, unknown or other
  misc_feature (229)..(229): n is a, c, g, or t
  modified_base (338)..(338): a, c, t, g, unknown or other
  misc_feature (338)..(338): n is a, c, g, or t
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
  modified_base (413)..(413): a, c, t, g, unknown or other
  misc_feature (413)..(413): n is a, c, g, or t
  modified_base (458)..(458): a, c, t, g, unknown or other
  misc_feature (458)..(458): n is a, c, g, or t
  modified_base (463)..(463): a, c, t, g, unknown or other
  misc_feature (463)..(463): n is a, c, g, or t
  modified_base (471)..(471): a, c, t, g, unknown or other
  misc_feature (471)..(471): n is a, c, g, or t
  modified_base (476)..(476): a, c, t, g, unknown or other
  misc_feature (476)..(476): n is a, c, g, or t
  modified_base (481)..(482): a, c, t, g, unknown or other
  misc_feature (481)..(482): n is a, c, g, or t
  modified_base (489)..(489): a, c, t, g, unknown or other
  misc_feature (489)..(489): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
  modified_base (509)..(509): a, c, t, g, unknown or other
  misc_feature (509)..(509): n is a, c, g, or t
  modified_base (511)..(512): a, c, t, g, unknown or other
  misc_feature (511)..(512): n is a, c, g, or t
  modified_base (516)..(516): a, c, t, g, unknown or other
  misc_feature (516)..(516): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (523)..(523): a, c, t, g, unknown or other
  misc_feature (523)..(523): n is a, c, g, or t
  modified_base (525)..(526): a, c, t, g, unknown or other
  misc_feature (525)..(526): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccgagggacgacgccaagaaatcagtatatctaacaaatgagtagcctgagagacgaggacacggctgtgtattactggtggccggggccgggancccacgtccggacccaccctacacccaagcctacgtggggaccacgggaccctggtccgcgtcctcctcagccctccaccgacggcccatccggtccttccccgtgccnccctctaccagcncacctgacgggtccactacgcncgcccgtggctcgccgtgtacgaggacctcgttctcgtcncgactcgtgacgtcgggctcggacacgggcgtccagtagcagtcncgtanctgctagngacgntacgnntcgcgancgctgancncgcgcncngtncnncgcncncncgngnn

SEQ ID NO: 255010 - DNA, 604 bp, Homo sapiens
  misc_feature: GYAE6OF02H0SAO.30.45.E01.1.454.CMB.1.raw
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
  modified_base (256)..(256): a, c, t, g, unknown or other
  misc_feature (256)..(256): n is a, c, g, or t
  modified_base (569)..(604): a, c, t, g, unknown or other
  misc_feature (569)..(604): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcacatttccagggacgacgccaaagaaatcagtatatctaacaaatgagtagcctgagagacgaggacgacgctgtagtnttactgtgcgggcggganccatcggaccaccctacaaccaacgactacgnggggaccgaacgggaacccctgggtccgccgtccttcctacgacgcctacccaaccgaacggggcccaacgtaccggtcccttccccccgtgggcccacccccgttcccacctaaacgacgtaccaacccgttcggtacgggggaccaaccgaacggaccaccggaccccgttcggggaccgtcgtcccggtacgggtaaccgtaaacgggtaacctttaccgttaaccccgtaacggttacggtaccgtcggtctacgggacggtcggggaccgtcgggaacggaacgggtccaagtaacctaaggccattnnnnnnnnnnnnnnnnnnnnnnnnnnnnnnnnnnnn

SEQ ID NO: 255011 - DNA, 609 bp, Homo sapiens
  misc_feature: GYAE6OF02IP6FW.30.45.E01.1.454.CMB.1.raw
  modified_base (503)..(503): a, c, t, g, unknown or other
  misc_feature (503)..(503): n is a, c, g, or t
  modified_base (553)..(553): a, c, t, g, unknown or other
  misc_feature (553)..(553): n is a, c, g, or t
  modified_base (560)..(560): a, c, t, g, unknown or other
  misc_feature (560)..(560): n is a, c, g, or t
  modified_base (564)..(564): a, c, t, g, unknown or other
  misc_feature (564)..(564): n is a, c, g, or t
  modified_base (571)..(571): a, c, t, g, unknown or other
  misc_feature (571)..(571): n is a, c, g, or t
  modified_base (576)..(576): a, c, t, g, unknown or other
  misc_feature (576)..(576): n is a, c, g, or t
  modified_base (578)..(580): a, c, t, g, unknown or other
  misc_feature (578)..(580): n is a, c, g, or t
  modified_base (582)..(582): a, c, t, g, unknown or other
  misc_feature (582)..(582): n is a, c, g, or t
  modified_base (585)..(587): a, c, t, g, unknown or other
  misc_feature (585)..(587): n is a, c, g, or t
  modified_base (589)..(589): a, c, t, g, unknown or other
  misc_feature (589)..(589): n is a, c, g, or t
  modified_base (591)..(594): a, c, t, g, unknown or other
  misc_feature (591)..(594): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
  modified_base (600)..(603): a, c, t, g, unknown or other
  misc_feature (600)..(603): n is a, c, g, or t
  modified_base (605)..(609): a, c, t, g, unknown or other
  misc_feature (605)..(609): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtacgcctgagagacgaggacacggctgtgtattacctgtggcgggccgggagccacgtcggacccaccctacaccaaggactacgtcggggaccacgggtaacccgtcggtacgtcccggtccttcccgtacgtacgcccctacccgaaccgtaacgggaccccgtaattcccggggtacccttcccccccgttagggcccctacccccttacccgtaaccgacggtacgtacccacccgttcgggtacgggaccacgtacgacgacgtcccggtggtccgcgtccgtggtaccgaggtacctttccgtcccttctcccgtagttaccncgttcgacggggtcccggtcgtagggacccgtaagggccgtaagagacgncttacgntagntcgactngcganannngnacnnnanannnncngnannnncnnnnn

SEQ ID NO: 255012 - DNA, 514 bp, Homo sapiens
  misc_feature: GYAE6OF02HD5IM.30.45.E01.1.454.CMB.1.raw
  modified_base (224)..(224): a, c, t, g, unknown or other
  misc_feature (224)..(224): n is a, c, g, or t
  modified_base (473)..(474): a, c, t, g, unknown or other
  misc_feature (473)..(474): n is a, c, g, or t
  modified_base (478)..(479): a, c, t, g, unknown or other
  misc_feature (478)..(479): n is a, c, g, or t
  modified_base (481)..(483): a, c, t, g, unknown or other
  misc_feature (481)..(483): n is a, c, g, or t
  modified_base (485)..(507): a, c, t, g, unknown or other
  misc_feature (485)..(507): n is a, c, g, or t
  modified_base (509)..(514): a, c, t, g, unknown or other
  misc_feature (509)..(514): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggancccactccggaccacccctacaccaagacctacgtggggccgagggaaccctggtccgccgtcctcctcacgccctccaccgaacggcccagtccggtccttccccccgtggcccacccctccctccaacgacgccacctcgtcggggccacgacgcacgcccgtcgggctcgccgtcggcgaacggtacctacgttccctcttacctcgctcgtgacggcgggtctcgggacacgggcgacgagtagnntgcnngnnngnnnnnnnnnnnnnnnnnnnnnnncnnnnnn

SEQ ID NO: 255013 - DNA, 488 bp, Homo sapiens
  misc_feature: GYAE6OF02IAFQP.30.45.E01.1.454.CMB.1.raw
  modified_base (221)..(221): a, c, t, g, unknown or other
  misc_feature (221)..(221): n is a, c, g, or t
  modified_base (327)..(327): a, c, t, g, unknown or other
  misc_feature (327)..(327): n is a, c, g, or t
  modified_base (456)..(488): a, c, t, g, unknown or other
  misc_feature (456)..(488): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggcacgccaagaaatcagtatatctacaaatgagtagcctgagagacgaggacacggctgtgtatactgtgcgggccgggtanccagtccggaccaccctacaccaagactacgtggggccagggaaccccgtggtccgccgtctcctcagcctaccaccacgggccccagtccggtccctttcccccnggccacccgtccctccaagacgcacctcgtcggggcacgacgcacgcccgttggcctcggcctcgggtacaacggctactaccgaccgtagcgtagcgtgacggtcggcgtggactaggcacaatggannnnnnnnnnnnnnnnnnnnnnnnnnnnnnnnn

SEQ ID NO: 255014 - DNA, 491 bp, Homo sapiens
  misc_feature: GYAE6OF02FIASR.30.45.E01.1.454.CMB.1.raw
  modified_base (224)..(224): a, c, t, g, unknown or other
  misc_feature (224)..(224): n is a, c, g, or t
  modified_base (438)..(438): a, c, t, g, unknown or other
  misc_feature (438)..(438): n is a, c, g, or t
  modified_base (460)..(460): a, c, t, g, unknown or other
  misc_feature (460)..(460): n is a, c, g, or t
  modified_base (462)..(491): a, c, t, g, unknown or other
  misc_feature (462)..(491): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggganccactcggaccaccctacaccaagactacgtcggggccagggaaccctggtcgccgtctcctcagcctccaccacgggcccatcggtcttccccctggccaccctcctccaagacgcacctcgtcgggggcacagcacgcccgtagggcctgccctgggttacaacgggaacctaccttcccaacggttacggcgtcgccgtggacggcgggcngggcgaaggccgacgatagcancnnnnnnnnnnnnnnnnnnnnnnnnnnnnnn

SEQ ID NO: 255015 - DNA, 598 bp, Homo sapiens
  misc_feature: GYAE6OF02HYDEE.30.45.E01.1.454.CMB.1.raw
  modified_base (228)..(228): a, c, t, g, unknown or other
  misc_feature (228)..(228): n is a, c, g, or t
  modified_base (300)..(300): a, c, t, g, unknown or other
  misc_feature (300)..(300): n is a, c, g, or t
  modified_base (549)..(550): a, c, t, g, unknown or other
  misc_feature (549)..(550): n is a, c, g, or t
  modified_base (553)..(553): a, c, t, g, unknown or other
  misc_feature (553)..(553): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (562)..(562): a, c, t, g, unknown or other
  misc_feature (562)..(562): n is a, c, g, or t
  modified_base (565)..(566): a, c, t, g, unknown or other
  misc_feature (565)..(566): n is a, c, g, or t
  modified_base (568)..(568): a, c, t, g, unknown or other
  misc_feature (568)..(568): n is a, c, g, or t
  modified_base (570)..(570): a, c, t, g, unknown or other
  misc_feature (570)..(570): n is a, c, g, or t
  modified_base (572)..(575): a, c, t, g, unknown or other
  misc_feature (572)..(575): n is a, c, g, or t
  modified_base (577)..(578): a, c, t, g, unknown or other
  misc_feature (577)..(578): n is a, c, g, or t
  modified_base (580)..(582): a, c, t, g, unknown or other
  misc_feature (580)..(582): n is a, c, g, or t
  modified_base (584)..(592): a, c, t, g, unknown or other
  misc_feature (584)..(592): n is a, c, g, or t
  modified_base (594)..(597): a, c, t, g, unknown or other
  misc_feature (594)..(597): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccgattcacatttccagggacgacgccaaagaaatcagtatatctaacaaatgagtagcctgagagacgaggacacggctgtgtattactggtggcggggcgggganccactcggaccaccctacaccaagtactacgcggggaccgagggaacccgtgggtaccgcccggtccttccncgacgtaccctcccaccgaacgggtccccagttccggttcccttaccccccgtcgggacccctaccccgtccctaccgaaacggacgaccctaaccccgttccgggtcggggggtaccacgaccggaccgaacggcccggttcgggtccgtacgtcccgtacggtacgaaacggtacttaccgttcccgacgtacggtcgtcggacgtggacggcgggtcgtcgggacggaacggcgacgtaagacgtnnagnatgncncgnacnncngnannnnannannngnnnnnnnnnannnnc

SEQ ID NO: 255016 - DNA, 496 bp, Homo sapiens
  misc_feature: GYAE6OF02IPS9D.30.45.E01.1.454.CMB.1.raw
  modified_base (454)..(454): a, c, t, g, unknown or other
  misc_feature (454)..(454): n is a, c, g, or t
  modified_base (474)..(496): a, c, t, g, unknown or other
  misc_feature (474)..(496): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccgattcaccatttccagggacgacgccaagaaatcagtatatctaacaaatgagtagcctgagagacgaggacacggctgtgtattactgtggcgggccggggagccacgtccggaccaccctacaccaagactacgtcggggccacgggaaccctggtcgccgtctcctcacgccctccaccgaacgggccccacgttccggtcccttccccccgtcggccacccctccctaccaacgacgccacctccggtcgggggccacgagcgacgcccgtggcctgccgtaggtcgaacggactaccttccgacgtacggcgtgcgtgaggcgggntcggacgaggcgcgagtagnnnnnnnnnnnnnnnnnnnnnnn

SEQ ID NO: 255017 - DNA, 445 bp, Homo sapiens
  misc_feature: GYAE6OF02FOGUE.30.45.E01.1.454.CMB.1.raw
  modified_base (432)..(445): a, c, t, g, unknown or other
  misc_feature (432)..(445): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggggagccactcggaccaccctacaccaagactacgtggggccgagggaacccctggtcgccgtctcctcagcctccaccaagggcccatcggtcttccccctcggcaccctcctccaagagcacctctggggggcacagcagccctggggctgcctggtcaaggactacttccacgtacgcgtgctggagcgggctggcaaggcgcactagnnnnnnnnnnnnnn

SEQ ID NO: 255018 - DNA, 447 bp, Homo sapiens
  misc_feature: GYAE6OF02HQCT7.30.45.E01.1.454.CMB.1.raw
  modified_base (343)..(343): a, c, t, g, unknown or other
  misc_feature (343)..(343): n is a, c, g, or t
  modified_base (429)..(431): a, c, t, g, unknown or other
  misc_feature (429)..(431): n is a, c, g, or t
  modified_base (433)..(447): a, c, t, g, unknown or other
  misc_feature (433)..(447): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactacgtggggccagggaaccctggtcgccgtctcctcagcctccaccgaacgggcccatccggtccttcccccgtggccaccctcctccaagcncacctcgtggggcacagcacgccctgggctgcctggtcaaggactactccacgtagcgtgctgacgcggctggcaggcgcagtagnnngnnnnnnnnnnnnnnn

SEQ ID NO: 255019 - DNA, 538 bp, Homo sapiens
  misc_feature: GYAE6OF02FGMKY.30.45.E01.1.454.CMB.1.raw
  modified_base (364)..(364): a, c, t, g, unknown or other
  misc_feature (364)..(364): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (504)..(504): a, c, t, g, unknown or other
  misc_feature (504)..(504): n is a, c, g, or t
  modified_base (507)..(538): a, c, t, g, unknown or other
  misc_feature (507)..(538): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggcggggagccactcggacccaccctacaccaagacctacgtgggggccacgggaacccctggtccgcccggtcctccttccacgccctcccacccgaacgggccccacgtccggttccttccccctggccaccctccctaccaagacnccacctccgtgggggccacagccacgccccgtgggctcgccgtggtacgaacggactaccttacccgacggtacgcgtcggcgtggacgggccggggtcgtcgggaccgtaacgggccgaccgtaagtaacggngnagcngcnnnnnnnnnnnnnnnnnnnnnnnnnnnnnnnn

SEQ ID NO: 255020 - DNA, 612 bp, Homo sapiens
  misc_feature: GYAE6OF02F6A3A.30.45.E01.1.454.CMB.1.raw
  modified_base (230)..(230): a, c, t, g, unknown or other
  misc_feature (230)..(230): n is a, c, g, or t
  modified_base (573)..(573): a, c, t, g, unknown or other
  misc_feature (573)..(573): n is a, c, g, or t
  modified_base (578)..(578): a, c, t, g, unknown or other
  misc_feature (578)..(578): n is a, c, g, or t
  modified_base (583)..(612): a, c, t, g, unknown or other
  misc_feature (583)..(612): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaaagaaatcagtatatctacaaatgagtagcctgagagacgaggacacggctgtgtaattactggtcggcggggaccggganccacgtcggacccaccctacaccaaaggacctacgtcggggaccgacgggacccgtaggtcggccgttacctcccgttaccgagtcccctcccgaaccgtacgggcccctaacgtccggttcccttccccccgttcggggaccctacccccttcccgtaccgaaacgtacggccctaaccgtccggttacgggggcctaccgacgccgaccggtcccgtcgggtcctcggcccgtcggtacgaacggtaaccttaccgttcccgacggtacggccggtcgacgtcgggacggtccggggtacgtcgggacggaacgggtaccggtcgaacgttacgctagcgnagcangccgnnnnnnnnnnnnnnnnnnnnnnnnnnnnnn

SEQ ID NO: 255021 - DNA, 473 bp, Homo sapiens
  misc_feature: GYAE6OF02HKN73.30.45.E01.1.454.CMB.1.raw
  modified_base (449)..(473): a, c, t, g, unknown or other
  misc_feature (449)..(473): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggagccacgtccggaccaccctacaccaagactactggggccagggaaccctggtcgccgtctcctcagcctccaccacggcccatccggtccttcccccgtggccaccctcctccaagacgcaccctcgtcgggggacacgagcgacgcccgtggctcgtccgtggtcaacggactaccttccgacgtacgcgtgctgaggcgggacgtggacgacggcgcgagtaggnnnnnnnnnnnnnnnnnnnnnnnnn

SEQ ID NO: 255022 - DNA, 712 bp, Homo sapiens
  misc_feature: GYAE6OF02JZ5VH.30.45.E01.1.454.CMB.1.raw
  modified_base (170)..(170): a, c, t, g, unknown or other
  misc_feature (170)..(170): n is a, c, g, or t
  modified_base (184)..(184): a, c, t, g, unknown or other
  misc_feature (184)..(184): n is a, c, g, or t
  modified_base (238)..(238): a, c, t, g, unknown or other
  misc_feature (238)..(238): n is a, c, g, or t
  modified_base (631)..(631): a, c, t, g, unknown or other
  misc_feature (631)..(631): n is a, c, g, or t
  modified_base (642)..(642): a, c, t, g, unknown or other
  misc_feature (642)..(642): n is a, c, g, or t
  modified_base (648)..(648): a, c, t, g, unknown or other
  misc_feature (648)..(648): n is a, c, g, or t
  modified_base (665)..(665): a, c, t, g, unknown or other
  misc_feature (665)..(665): n is a, c, g, or t
  modified_base (674)..(674): a, c, t, g, unknown or other
  misc_feature (674)..(674): n is a, c, g, or t
  modified_base (679)..(679): a, c, t, g, unknown or other
  misc_feature (679)..(679): n is a, c, g, or t
  modified_base (687)..(687): a, c, t, g, unknown or other
  misc_feature (687)..(687): n is a, c, g, or t
  modified_base (689)..(689): a, c, t, g, unknown or other
  misc_feature (689)..(689): n is a, c, g, or t
  modified_base (711)..(711): a, c, t, g, unknown or other
  misc_feature (711)..(711): n is a, c, g, or t
tcagcacgctacgtcacgaccggtgctcgatttagtgagtcagtaagggaaggggctggagtggatttcatatagttagtgcgtggtgcgtactaccatggaagtacgcaggactctgtgaggggccgattcaccatttccgagggtacacgccaagaaactcagtatanctacaaatgagtancctgagagacgaggacacggctgtggtaattacgtgtcggacggggccgggtanacccgtacgttacgggaacccctaccccgttaaccgaacccgtaaggtaacttaccggtacgggggacccgaacgggtaaacccgtgggtcccggtaccggttcctccgttccggaccggtacccctcccgaaccgaaccgggtaccccgtaacgtacccgggttcccttaccccccggttcggacccctaacccgttcccgtaccgtaaacgaccggtacctacccggtaacggtacggggcctaacgacggacctaccggcccgtacggggtcctacgggtccgttcggtaccaagggtacccttacgtacccgtaaccggtactaccggtcgtacgtagggtacccggtacggtacggtacggaccgaacgggacgtccgtaagcggacncgacgtcgcgngagacngctgacgacgacgtctnacgcgcgcncgcgngcgcgtcncngcgcgagcgcgcgcacgtctcnc

SEQ ID NO: 255023 - DNA, 528 bp, Homo sapiens
  misc_feature: GYAE6OF02HJ5MF.30.45.E01.1.454.CMB.1.raw
  modified_base (499)..(500): a, c, t, g, unknown or other
  misc_feature (499)..(500): n is a, c, g, or t
  modified_base (504)..(528): a, c, t, g, unknown or other
  misc_feature (504)..(528): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtggcgggccggggagccacgtccggaccaccctacaaccaagactacgtcggggccacgggaaccctggtccgccgtctcctcgacgccctacccaccgaacgggccccagtccggtcccttccccccgtggcccacccctccctaccgaacggaccgtacccacccgttccggtcgggggcctaacgacgccaccgccccgtgggccttccggacgtcggtacgaacggtacctaccgttccgacgtacgcggtgcgtggcggcgggcgtcggacgaggcgacatagnnagcnnnnnnnnnnnnnnnnnnnnnnnnn

SEQ ID NO: 255024 - DNA, 482 bp, Homo sapiens
  misc_feature: GYAE6OF02JEN1W.30.45.E01.1.454.CMB.1.raw
  modified_base (442)..(443): a, c, t, g, unknown or other
  misc_feature (442)..(443): n is a, c, g, or t
  modified_base (446)..(446): a, c, t, g, unknown or other
  misc_feature (446)..(446): n is a, c, g, or t
  modified_base (450)..(482): a, c, t, g, unknown or other
  misc_feature (450)..(482): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgatagcctgagagacgagacacggctgtgtatactgtgcgggccgggaccactcggaccaccctacaccaagacactggggccagggaaccctggtcgccgtcgtcctcagcctcaccaacgggcccatcggtacttccccgtgccaccctccgtccaaggcgccacctccgtgggggcacgacgcacgcccgtcggctcgcctggtcaaggacctaacttccgtctccgtcgtacctctgacgcgggctcggacagggcgcagtaggcanncgntcgnnnnnnnnnnnnnnnnnnnnnnnnnnnnnnnnn

SEQ ID NO: 255025 - DNA, 494 bp, Homo sapiens
  misc_feature: GYAE6OF02HQGJP.30.45.E01.1.454.CMB.1.raw
  modified_base (224)..(224): a, c, t, g, unknown or other
  misc_feature (224)..(224): n is a, c, g, or t
  modified_base (456)..(456): a, c, t, g, unknown or other
  misc_feature (456)..(456): n is a, c, g, or t
  modified_base (458)..(458): a, c, t, g, unknown or other
  misc_feature (458)..(458): n is a, c, g, or t
  modified_base (460)..(463): a, c, t, g, unknown or other
  misc_feature (460)..(463): n is a, c, g, or t
  modified_base (466)..(494): a, c, t, g, unknown or other
  misc_feature (466)..(494): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccgggganccactcggaccaccctacaccaagactactggggccagggaaccctggtcgccgtctcctcagcctccaccaagggcccatcggtccttccccctgggccaccctccctccgaacgacgccaccctcgtcgggggccacgagcacgccccgtgggctcgccgtggtacaaggacctacgttccgacgtagcgtgcgtgacggcgggcgtcggcgaagggccgacgtagtagngntnnnncgnnnnnnnnnnnnnnnnnnnnnnnnnnnnn

SEQ ID NO: 255026 - DNA, 500 bp, Homo sapiens
  misc_feature: GYAE6OF02ISIDE.30.45.E01.1.454.CMB.1.raw
  modified_base (225)..(225): a, c, t, g, unknown or other
  misc_feature (225)..(225): n is a, c, g, or t
  modified_base (350)..(350): a, c, t, g, unknown or other
  misc_feature (350)..(350): n is a, c, g, or t
  modified_base (427)..(427): a, c, t, g, unknown or other
  misc_feature (427)..(427): n is a, c, g, or t
  modified_base (465)..(465): a, c, t, g, unknown or other
  misc_feature (465)..(465): n is a, c, g, or t
  modified_base (469)..(500): a, c, t, g, unknown or other
  misc_feature (469)..(500): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccattcaccatttccagggacgacgccaagaaatcagtatatctacaaatgagtagcctgagagacgaggacacggctgtgtattactgtggcggggccgggganccacgtcggaacccaccctacaccaagactaacgtcggggaccgacggaacccgtggtccgccgtctcctcacgccctccaaccgacggcccacgtccggtccttccccgcggcccacccctccnccaaagacgtcctaccgtcgtggggaccagacgcacgtccgtggcacgccgtggacaaggctacgtcaacgtgcgtncgttaggacggtcggcgtcgacgacggtcacgacgtancgannnnnnnnnnnnnnnnnnnnnnnnnnnnnnnn

SEQ ID NO: 255027 - DNA, 684 bp, Homo sapiens
  misc_feature: GYAE6OF02G69LU.30.45.E01.1.454.CMB.1.raw
  modified_base (611)..(611): a, c, t, g, unknown or other
  misc_feature (611)..(611): n is a, c, g, or t
  modified_base (615)..(615): a, c, t, g, unknown or other
  misc_feature (615)..(615): n is a, c, g, or t
  modified_base (622)..(622): a, c, t, g, unknown or other
  misc_feature (622)..(622): n is a, c, g, or t
  modified_base (642)..(642): a, c, t, g, unknown or other
  misc_feature (642)..(642): n is a, c, g, or t
  modified_base (651)..(651): a, c, t, g, unknown or other
  misc_feature (651)..(651): n is a, c, g, or t
tcagcacgctacgtcacgaccggtgctcgatttagtgagtcagtaagggaagggcgtggagtggatttcatatattagtgctggtgctactaccatgaagtacgcagactctgtggagggccgattcacatttcgagggacacgccaagaaacttcagtatactctaacaaatgagtacgcctagagagacgaggacacggcgtgtagtattactggtcggccgggaccgggggcgacccacgtaccggtaacccaacccacgtaacccgaaggtaacctaccggtaggggacccaaccgggtaacccgtcggttacccggtacccgtccgttccgaccgtacgaccccgtacccgaacgtaaccgggacctccgttccgttacccgttcccccggtagacccgtacccccttacccgtaccgaacggacgacccgtaccgttacgggtaccgggacaacgacggcctaaccggtccgttcgggacgttccgtcccgttagggtaacctaccggtacttaccgtcccttcgtacctccgtacgtccgtcgtacggtcggtccggacggtcggaacggcgtacgtacgtacgcagtctcgcgctagcagccngtancgctagngcgtacgcgtacgagagcgngtcgcgacngtacgtcgacgcgtctacgctcgtcgtcgtacg

SEQ ID NO: 255028 - DNA, 499 bp, Homo sapiens
  misc_feature: GYAE6OF02JTY72.30.45.E01.1.454.CMB.1.raw
  modified_base (294)..(294): a, c, t, g, unknown or other
  misc_feature (294)..(294): n is a, c, g, or t
  modified_base (339)..(339): a, c, t, g, unknown or other
  misc_feature (339)..(339): n is a, c, g, or t
  modified_base (371)..(371): a, c, t, g, unknown or other
  misc_feature (371)..(371): n is a, c, g, or t
  modified_base (424)..(424): a, c, t, g, unknown or other
  misc_feature (424)..(424): n is a, c, g, or t
  modified_base (462)..(462): a, c, t, g, unknown or other
  misc_feature (462)..(462): n is a, c, g, or t
  modified_base (472)..(473): a, c, t, g, unknown or other
  misc_feature (472)..(473): n is a, c, g, or t
  modified_base (475)..(499): a, c, t, g, unknown or other
  misc_feature (475)..(499): n is a, c, g, or t
tcagcacgctacgtcacgaccggtgctcgatttagtgagtcagtaagggaaaggggctggagtggatttcatatattagtgctggtgctactaccatgaagtacgcagactctgtgaggggccgattcaccaatttccagggaccgacgccaagaaatcagtatatctaacaaatgagtagcctgagagacgaggacacgctgtgtattactggtgcggggccggggatccacgtcggacccaccctaaccgaagactcgtcggggccgacgggaacccgtggccgccggttcnccgtcacgcctccaccgaggcccacgtcggtcctcccccgtgccncccgtcctcacgacgccacctcgtggggcacngtcacgccctgggctcggccgtggtaccaaggaccttaccttcccgtcttccnccgtactcgttacgacggccgggcgtggacaacgggcnccgtagacgnntnnnnnnnnnnnnnnnnnnnnnnnnn

SEQ ID NO: 255029 - DNA, 691 bp, Homo sapiens
  misc_feature: GYAE6OF02JG5WZ.30.45.E01.1.454.CMB.1.raw
  modified_base (264)..(264): a, c, t, g, unknown or other
  misc_feature (264)..(264): n is a, c, g, or t
  modified_base (655)..(655): a, c, t, g, unknown or other
  misc_feature (655)..(655): n is a, c, g, or t
  modified_base (661)..(691): a, c, t, g, unknown or other
  misc_feature (661)..(691): n is a, c, g, or t
tcagcacgctacgtcacgaccggtgctcgatttagtgagtcagtaagggaaagggggctggagtggatttcatatattagtgctggtgctactaccatgaagtacgcagactctgtgagggccgattcaccatttccagggacgacgccaaagaaatcagtatatctaacaaattgagtagcctgagagacgaggacacggctgtaggtattacgtgtgggcgggccgggggacccgacgtcggaaccctaccctacgaccaanactacgtcggggccgacgggtaacccgtcgggtccggccgtccgtaccttaccgaccggtcccctccccaacccgaaacgggggcccccttaacgttccccggggtccccctttccccccgtagggtaccccccttaacccccgtttcccccgttaacccgaaaccggtaaggtacccccggtaaaccccggtacggttccgggggggtaccccaaccggttaaaaccgcccgtaaacccggtcccggccggggtaccgttggtcccccggtaggggtaaaccgtaacccggggttaactaccccgggttttaccctccgttaccgtccgtaacccttcggtagaccgggcgggtaccgacgggtcgaacgggtccaggtacagctgactncgatcnnnnnnnnnnnnnnnnnnnnnnnnnnnnnnn

SEQ ID NO: 255030 - DNA, 207 bp, Homo sapiens
  misc_feature: GYAE6OF02GXLEV.30.45.E01.1.454.CMB.1.raw
  modified_base (155)..(207): a, c, t, g, unknown or other
  misc_feature (155)..(207): n is a, c, g, or t
tcagcacgctacgtcacgaccggtgctcgatttagtgagtcagtaagggaaagggaccaaggtggaaatcaaacgaactgtggctgcaccatctgtcttcatcttcccgccatctgaacgtgcgtgctgagcgggctggcaagggctcaagtagnnnnnnnnnnnnnnnnnnnnnnnnnnnnnnnnnnnnnnnnnnnnnnnnnnnnn

SEQ ID NO: 255031 - DNA, 620 bp, Homo sapiens
  misc_feature: GYAE6OF02F3HZE.30.45.E01.1.454.CMB.1.raw
  modified_base (172)..(172): a, c, t, g, unknown or other
  misc_feature (172)..(172): n is a, c, g, or t
  modified_base (222)..(222): a, c, t, g, unknown or other
  misc_feature (222)..(222): n is a, c, g, or t
  modified_base (518)..(518): a, c, t, g, unknown or other
  misc_feature (518)..(518): n is a, c, g, or t
  modified_base (537)..(537): a, c, t, g, unknown or other
  misc_feature (537)..(537): n is a, c, g, or t
  modified_base (541)..(541): a, c, t, g, unknown or other
  misc_feature (541)..(541): n is a, c, g, or t
  modified_base (566)..(566): a, c, t, g, unknown or other
  misc_feature (566)..(566): n is a, c, g, or t
  modified_base (574)..(574): a, c, t, g, unknown or other
  misc_feature (574)..(574): n is a, c, g, or t
tcagcacgctacgtcacgaccggtgctcgatttagtgagtcagtaaggaaggggctggagtggatttcatatattagtgctggtgctactacatgaagtacgcagactctgtgagggccgattcacattccagggacacgccaagaatcagtatatcgtacaaatgacgtancctgagagacgaggacacggctgtgtacttactggtgacggggccggganccacgtcggacacctacaccgtaagacgttactggggacctagggaccctaggtcgccgtacgtccttcacgtcctccgaaccgaacggtcccgatacccggttccttccccgtaggtccaccccgttcccgtcaaagacggctaacccgtcgttagggggcacgaacgtcaacggcccttacgggcgtcgaccgttcgggttacaaacggacggtttaccttaccgaacggttacgaccgtcgtacgtcgtaacggccggtacgtagggcctaaacgggtcacgttaactaggcncgtagctaagccagctaancgtntcgactacgcgattccggattccanggacttanacgcaatcgtctagcgtacgtcgacgtgtacgtacgtacgagtacg

SEQ ID NO: 255032 - DNA, 536 bp, Homo sapiens
  misc_feature: GYAE6OF02GHVES.30.45.E01.1.454.CMB.1.raw
  modified_base (226)..(226): a, c, t, g, unknown or other
  misc_feature (226)..(226): n is a, c, g, or t
  modified_base (256)..(256): a, c, t, g, unknown or other
  misc_feature (256)..(256): n is a, c, g, or t
  modified_base (287)..(287): a, c, t, g, unknown or other
  misc_feature (287)..(287): n is a, c, g, or t
  modified_base (346)..(346): a, c, t, g, unknown or other
  misc_feature (346)..(346): n is a, c, g, or t
  modified_base (366)..(366): a, c, t, g, unknown or other
  misc_feature (366)..(366): n is a, c, g, or t
  modified_base (432)..(432): a, c, t, g, unknown or other
  misc_feature (432)..(432): n is a, c, g, or t
  modified_base (466)..(466): a, c, t, g, unknown or other
  misc_feature (466)..(466): n is a, c, g, or t
  modified_base (475)..(476): a, c, t, g, unknown or other
  misc_feature (475)..(476): n is a, c, g, or t
  modified_base (491)..(492): a, c, t, g, unknown or other
  misc_feature (491)..(492): n is a, c, g, or t
  modified_base (499)..(499): a, c, t, g, unknown or other
  misc_feature (499)..(499): n is a, c, g, or t
  modified_base (504)..(504): a, c, t, g, unknown or other
  misc_feature (504)..(504): n is a, c, g, or t
  modified_base (506)..(507): a, c, t, g, unknown or other
  misc_feature (506)..(507): n is a, c, g, or t
  modified_base (509)..(509): a, c, t, g, unknown or other
  misc_feature (509)..(509): n is a, c, g, or t
  modified_base (514)..(516): a, c, t, g, unknown or other
  misc_feature (514)..(516): n is a, c, g, or t
  modified_base (519)..(521): a, c, t, g, unknown or other
  misc_feature (519)..(521): n is a, c, g, or t
  modified_base (523)..(523): a, c, t, g, unknown or other
  misc_feature (523)..(523): n is a, c, g, or t
  modified_base (526)..(527): a, c, t, g, unknown or other
  misc_feature (526)..(527): n is a, c, g, or t
  modified_base (529)..(529): a, c, t, g, unknown or other
  misc_feature (529)..(529): n is a, c, g, or t
  modified_base (532)..(536): a, c, t, g, unknown or other
  misc_feature (532)..(536): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccattcaccatttccagggacgacgccaagaaatcagtatatctaacaaatgagtagcctgagagacgaggacacggctgtagtattactgtggcggggccggganccacgtcggaccacctacaccaagactagnggggccagggaccctggccgccgtctcctcncgccctccaccgaaggccccagtccggtccttccccgtggccaccctcctaccaaggcncctacctcgtaggggcaacngcacgtcccgagggctgccgtgggtacaacggtaccttaccttccctacttccgtccgaccttcgnggacggccgggtacgtcgggacgaacgggccganacggtacgnngtagcttagcagtcnnagagtgngcgtntnncngacgnnnagnnnancgnngngannnnn

SEQ ID NO: 255033 - DNA, 596 bp, Homo sapiens
  misc_feature: GYAE6OF02HP3M0.30.45.E01.1.454.CMB.1.raw
  modified_base (225)..(225): a, c, t, g, unknown or other
  misc_feature (225)..(225): n is a, c, g, or t
  modified_base (284)..(284): a, c, t, g, unknown or other
  misc_feature (284)..(284): n is a, c, g, or t
  modified_base (552)..(552): a, c, t, g, unknown or other
  misc_feature (552)..(552): n is a, c, g, or t
  modified_base (560)..(560): a, c, t, g, unknown or other
  misc_feature (560)..(560): n is a, c, g, or t
  modified_base (563)..(565): a, c, t, g, unknown or other
  misc_feature (563)..(565): n is a, c, g, or t
  modified_base (567)..(596): a, c, t, g, unknown or other
  misc_feature (567)..(596): n is a, c, g, or t
tcagcacgctacgtcacgaccggtgctcgatttagtgagtcagtaagggaagggggctggagtggatttcatatattagtgctggtgctactaccatgaagtacgcagactctgtgaggggccgattcaccatttccagggacgacgccaagaaatcagtatatctacaatgagtagcctgagagacgagacacggctgtgtattactgtgcgggcggggagccnctcggacccacctacaccaagactacgtggggcacgggaccctggtcgccgtctcctcncgccctccaccacgggccccacgtccgtccgttcccccgtcggcctacccctccctaccgaaacgacgacccgtaccctcggttcgggggcaaccgcgccgacgccccggtcggggtcctcgcccgttcggtaccgaaacgggttaacccttaaccgttttcccttccgtttcccgttaccggacccgtttaccggtcggtaacccgggtccggggttacccggtgggtacccggtaaacgggtcccggaacttaacggttacggganacgacgcncgnnncnnnnnnnnnnnnnnnnnnnnnnnnnnnnnn

SEQ ID NO: 255034 - DNA, 511 bp, Homo sapiens
  misc_feature: GYAE6OF02IKF2H.30.45.E01.1.454.CMB.1.raw
  modified_base (355)..(355): a, c, t, g, unknown or other
  misc_feature (355)..(355): n is a, c, g, or t
  modified_base (388)..(388): a, c, t, g, unknown or other
  misc_feature (388)..(388): n is a, c, g, or t
  modified_base (470)..(470): a, c, t, g, unknown or other
  misc_feature (470)..(470): n is a, c, g, or t
  modified_base (473)..(473): a, c, t, g, unknown or other
  misc_feature (473)..(473): n is a, c, g, or t
  modified_base (475)..(476): a, c, t, g, unknown or other
  misc_feature (475)..(476): n is a, c, g, or t
  modified_base (478)..(511): a, c, t, g, unknown or other
  misc_feature (478)..(511): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcacatttcagggacgacgccaaagaaatcagtatatctaacaaatgagtagcctgagagacgaggacacggctgtgtattactgtcggcggggcgggacgccacgtccggacccaccctacaaccaacgtactacgtcgggaccaacgggaacctggtccgccgtctcctcacgccctaccaccgacgggccctacgtccgtccccttcccccgtcgcccacccctccnccgaacgcgcctaccgtcggtcgggcacgcgcnccgccgcggctcgccgttgaacgacgactaccttcaacgtcgcgtgcgtggacggtcgggtccgaggaccgagggcacgtanagncnncnnnnnnnnnnnnnnnnnnnnnnnnnnnnnnnnnn

SEQ ID NO: 255035 - DNA, 567 bp, Homo sapiens
  misc_feature: GYAE6OF02FW4O5.30.45.E01.1.454.CMB.1.raw
  modified_base (207)..(207): a, c, t, g, unknown or other
  misc_feature (207)..(207): n is a, c, g, or t
  modified_base (221)..(221): a, c, t, g, unknown or other
  misc_feature (221)..(221): n is a, c, g, or t
  modified_base (281)..(281): a, c, t, g, unknown or other
  misc_feature (281)..(281): n is a, c, g, or t
  modified_base (386)..(386): a, c, t, g, unknown or other
  misc_feature (386)..(386): n is a, c, g, or t
  modified_base (479)..(479): a, c, t, g, unknown or other
  misc_feature (479)..(479): n is a, c, g, or t
  modified_base (487)..(487): a, c, t, g, unknown or other
  misc_feature (487)..(487): n is a, c, g, or t
  modified_base (490)..(490): a, c, t, g, unknown or other
  misc_feature (490)..(490): n is a, c, g, or t
  modified_base (498)..(498): a, c, t, g, unknown or other
  misc_feature (498)..(498): n is a, c, g, or t
  modified_base (504)..(504): a, c, t, g, unknown or other
  misc_feature (504)..(504): n is a, c, g, or t
  modified_base (508)..(508): a, c, t, g, unknown or other
  misc_feature (508)..(508): n is a, c, g, or t
  modified_base (518)..(518): a, c, t, g, unknown or other
  misc_feature (518)..(518): n is a, c, g, or t
  modified_base (527)..(527): a, c, t, g, unknown or other
  misc_feature (527)..(527): n is a, c, g, or t
  modified_base (551)..(551): a, c, t, g, unknown or other
  misc_feature (551)..(551): n is a, c, g, or t
  modified_base (566)..(566): a, c, t, g, unknown or other
  misc_feature (566)..(566): n is a, c, g, or t
tcagcacgctacgtcacgaccggtgctcgatttagtgagtcagtaagggaaggggctggagtggatttcatatattagtgctggtgctactaccatgaagtacgcagactctgtgagggccattcaccatttccagggacgacgccaagaaatcagtatatctacaaatgagtagcctgagagacgaggacacggctgtgtattacngtgcgggccggganccacgtcggacccacctacaccgaagactacgtggggccagggaccctggtccgccgtcncctcacgcctccaccacgggcccacgtcgtccgttcccccgtggacctaccccgtcctaccgtaagcgccaccgtcggtcggggcaccgagaccgtacgtcccgngggtcctcgccgtacggtacgaaacggtaccttacgtctaccgtaggtaccgtgtcctggacggcgggacgtcggcgaacggcgacaggtacngtgctgancgngcaacgtnacgtgntacncgagcgtgcncgcgcgacngtcgtcgcgtagcgtacgacgtanatacgacgcgtcacnc

SEQ ID NO: 255036 - DNA, 688 bp, Homo sapiens
  misc_feature: GYAE6OF02HQYFX.30.45.E01.1.454.CMB.1.raw
  modified_base (631)..(632): a, c, t, g, unknown or other
  misc_feature (631)..(632): n is a, c, g, or t
  modified_base (636)..(636): a, c, t, g, unknown or other
  misc_feature (636)..(636): n is a, c, g, or t
  modified_base (638)..(638): a, c, t, g, unknown or other
  misc_feature (638)..(638): n is a, c, g, or t
  modified_base (647)..(647): a, c, t, g, unknown or other
  misc_feature (647)..(647): n is a, c, g, or t
  modified_base (649)..(649): a, c, t, g, unknown or other
  misc_feature (649)..(649): n is a, c, g, or t
  modified_base (654)..(655): a, c, t, g, unknown or other
  misc_feature (654)..(655): n is a, c, g, or t
  modified_base (658)..(658): a, c, t, g, unknown or other
  misc_feature (658)..(658): n is a, c, g, or t
  modified_base (663)..(663): a, c, t, g, unknown or other
  misc_feature (663)..(663): n is a, c, g, or t
  modified_base (670)..(670): a, c, t, g, unknown or other
  misc_feature (670)..(670): n is a, c, g, or t
  modified_base (674)..(675): a, c, t, g, unknown or other
  misc_feature (674)..(675): n is a, c, g, or t
  modified_base (678)..(678): a, c, t, g, unknown or other
  misc_feature (678)..(678): n is a, c, g, or t
  modified_base (684)..(684): a, c, t, g, unknown or other
  misc_feature (684)..(684): n is a, c, g, or t
  modified_base (686)..(688): a, c, t, g, unknown or other
  misc_feature (686)..(688): n is a, c, g, or t
tcagcacgctacgtcacgaccggtgctcgatttagtgagtcagtaagggaaaggggctggagtggatttcatatattagtgctggtgctactaccatgaagtacgcagactctgtgagggccgattcaccatttccgagggacgacgccaagaaatcagtatatctaacaaatgagtagctgagagacgagacgacggtcgtgtagtacttacgtgtcggcggggcgggacgccgacgtccggacccaacccctacgaaccaaacgtacctaccggtacggggacccgaaccggggtaaccccgttggtacccgcccggtcccttacccgtaccgaccggcccctaccccgaacccggaacggaccccctacgttacccgggtttcccccttcccccgtcgggacccctacccccgttaccctaccccggaaacggtacgtacccacccgttcgggttccggggaacctacgaaccggccgaaccggtccccggttcgggtaccgttccgaccggtacggtaaccggaacggttacctaccgtttcccctacgtaccgttaccgtacgttaccgtagaccggtcggtacggtcgaacgggtagggtaccgacgtataggcgatagcgtacnngcananagcgtgagngngtcannagngtcancgacgcnagcnngcncgctgngnnn

SEQ ID NO: 255037 - DNA, 635 bp, Homo sapiens
  misc_feature: GYAE6OF02IEKT9.30.45.E01.1.454.CMB.1.raw
  modified_base (105)..(105): a, c, t, g, unknown or other
  misc_feature (105)..(105): n is a, c, g, or t
  modified_base (585)..(585): a, c, t, g, unknown or other
  misc_feature (585)..(585): n is a, c, g, or t
  modified_base (591)..(592): a, c, t, g, unknown or other
  misc_feature (591)..(592): n is a, c, g, or t
  modified_base (594)..(594): a, c, t, g, unknown or other
  misc_feature (594)..(594): n is a, c, g, or t
  modified_base (598)..(598): a, c, t, g, unknown or other
  misc_feature (598)..(598): n is a, c, g, or t
  modified_base (601)..(601): a, c, t, g, unknown or other
  misc_feature (601)..(601): n is a, c, g, or t
  modified_base (603)..(604): a, c, t, g, unknown or other
  misc_feature (603)..(604): n is a, c, g, or t
  modified_base (606)..(606): a, c, t, g, unknown or other
  misc_feature (606)..(606): n is a, c, g, or t
  modified_base (608)..(608): a, c, t, g, unknown or other
  misc_feature (608)..(608): n is a, c, g, or t
  modified_base (610)..(618): a, c, t, g, unknown or other
  misc_feature (610)..(618): n is a, c, g, or t
  modified_base (620)..(633): a, c, t, g, unknown or other
  misc_feature (620)..(633): n is a, c, g, or t
  modified_base (635)..(635): a, c, t, g, unknown or other
  misc_feature (635)..(635): n is a, c, g, or t
tcagcacgctacgtcacgaccggtgctcgatttagtgagtcagtaagggaaggggctggagtggatttcatatattagtgctggtgctactaccatgaagtacgnagactctgtgaggggccgattcacatttccagggacgacgccaagaaatcagtatatctaacaaatggagtagcctgagagacgaggacacggctgtgtattacgtgtggcggggccggggagcccatccggaccacccctacaccaagactacgtcggggaccgacgggaaccctggtaccggccgtccttcccgcacgccctacccaccgaacggggccccagttcccggttccctttccccccgtcgggaccctccccttccctacccaacggaccgaccgtaccccttcgggtacggggggacccacgacggaccgaccggccccggtaggggcccgtcggtcctacgggttaccgaaaggggtacccttaaccgttaccggtaaccggtttaagggcccgtttcggtcggttaaggggccgggtacggggccggttacgggaacccggaacggggacccggcttaaacgtcgggngcgcanncncgcncancnngngngnnnnnnnnngnnnnnnnnnnnnnntn

SEQ ID NO: 255038 - DNA, 484 bp, Homo sapiens
  misc_feature: GYAE6OF02F2KVN.30.45.E01.1.454.CMB.1.raw
  modified_base (224)..(224): a, c, t, g, unknown or other
  misc_feature (224)..(224): n is a, c, g, or t
  modified_base (378)..(378): a, c, t, g, unknown or other
  misc_feature (378)..(378): n is a, c, g, or t
  modified_base (455)..(455): a, c, t, g, unknown or other
  misc_feature (455)..(455): n is a, c, g, or t
  modified_base (461)..(461): a, c, t, g, unknown or other
  misc_feature (461)..(461): n is a, c, g, or t
  modified_base (463)..(484): a, c, t, g, unknown or other
  misc_feature (463)..(484): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcggggccggganccactcggacccaccctacaccaagactactgggggccaggggtaaccctggtcgccgtctcctcagccctccaccaacgggcccacgtcgggtccttcccccgtggcccacccctccctccaagcgcacctcggtcggggcacagcacgcccngggcctcgcctggtacgaacggacttaccttcccgaacgtagccggtgctagaggccgggtcgtggactagggctanacgtgncnnnnnnnnnnnnnnnnnnnnnn

SEQ ID NO: 255039 - DNA, 664 bp, Homo sapiens
  misc_feature: GYAE6OF02JIDUV.30.45.E01.1.454.CMB.1.raw
  modified_base (231)..(231): a, c, t, g, unknown or other
  misc_feature (231)..(231): n is a, c, g, or t
  modified_base (311)..(311): a, c, t, g, unknown or other
  misc_feature (311)..(311): n is a, c, g, or t
  modified_base (569)..(569): a, c, t, g, unknown or other
  misc_feature (569)..(569): n is a, c, g, or t
  modified_base (582)..(582): a, c, t, g, unknown or other
  misc_feature (582)..(582): n is a, c, g, or t
  modified_base (588)..(588): a, c, t, g, unknown or other
  misc_feature (588)..(588): n is a, c, g, or t
  modified_base (591)..(591): a, c, t, g, unknown or other
  misc_feature (591)..(591): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
  modified_base (615)..(615): a, c, t, g, unknown or other
  misc_feature (615)..(615): n is a, c, g, or t
  modified_base (618)..(618): a, c, t, g, unknown or other
  misc_feature (618)..(618): n is a, c, g, or t
  modified_base (633)..(633): a, c, t, g, unknown or other
  misc_feature (633)..(633): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctaacaaatgagtagaccgtgagagacggaggaccacggctgtgttatactggtgccggggcgggacncccacgtccggaccctacccacacccgaagaccgtacgtcggggtaccgacgggaacccgtcggtcgacccgttcgtccncgacgcccctccgaccgacgggcccacggttcggttacccttcccccgtggcccacccgttccctaccgaacgacgtcctccgtcgggtcggggaccacggaaccgtcgaccgtcccggtacgggctaccgggtccgttacggtacgaaccggtaaccgtaccctttacccggaacggttaccggtccgtacggccttaacgggcgggtccgggtaccgttacggggaccgaaccgggtacgtacgacgacgtccgangcgacgctcgcgngttcgnacncgcgacncncgacgtacgtacganacncgcgacgtcgtacgngacacaccgcgtcgacgtcgacgtacgcgcg

SEQ ID NO: 255040 - DNA, 666 bp, Homo sapiens
  misc_feature: GYAE6OF02IE1LL.30.45.E01.1.454.CMB.1.raw
  modified_base (236)..(236): a, c, t, g, unknown or other
  misc_feature (236)..(236): n is a, c, g, or t
  modified_base (594)..(594): a, c, t, g, unknown or other
  misc_feature (594)..(594): n is a, c, g, or t
  modified_base (599)..(599): a, c, t, g, unknown or other
  misc_feature (599)..(599): n is a, c, g, or t
  modified_base (609)..(609): a, c, t, g, unknown or other
  misc_feature (609)..(609): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
  modified_base (620)..(620): a, c, t, g, unknown or other
  misc_feature (620)..(620): n is a, c, g, or t
  modified_base (625)..(625): a, c, t, g, unknown or other
  misc_feature (625)..(625): n is a, c, g, or t
  modified_base (641)..(641): a, c, t, g, unknown or other
  misc_feature (641)..(641): n is a, c, g, or t
  modified_base (643)..(643): a, c, t, g, unknown or other
  misc_feature (643)..(643): n is a, c, g, or t
  modified_base (656)..(656): a, c, t, g, unknown or other
  misc_feature (656)..(656): n is a, c, g, or t
  modified_base (660)..(660): a, c, t, g, unknown or other
  misc_feature (660)..(660): n is a, c, g, or t
  modified_base (664)..(664): a, c, t, g, unknown or other
  misc_feature (664)..(664): n is a, c, g, or t
tcagcacgctacgtcacgaccggtgctcgatttagtgagtcagtaagggaaggggcgtggagtggatttcgatatattagtgctggtcgctacgtaccagtgaagtacgcagactctgtgagggccgattcaccatttccgagggtacgacgccaaagaaatcgagtatatctaacaaatgagtgcctgagagacgaggacacggctgtgtattacgtgtacgcgggtaccgggancccgtacgtccggacctaccctaacgaaccaacgacctacggtgggaccgacggaaccctggtaccgccgtctcctcgacgtccctaccgtacgaacgggcccctagttcccggtacccttttcccccgaggtaccctaacccctccgttaacccgaaggaaccgtccctaacccgtaccgggtagggggtaccccaacgtaccgtaccgaccggtacccggttagggcccttaaccgggtccttacgggtaaccgaacgggttacgttaacccttccttcgttacccgtaccgtacgttccggtgacgggtccgggtccgtggcggaacggtctacggtaagccaggtacaggccancgtanccggatcgancgtcntngtgncgcgncgtcgctcgcgcgtcncncgtgtctcgtacncgcncgtntc

SEQ ID NO: 255041 - DNA, 598 bp, Homo sapiens
  misc_feature: GYAE6OF02FVCPB.30.45.E01.1.454.CMB.1.raw
  modified_base (561)..(561): a, c, t, g, unknown or other
  misc_feature (561)..(561): n is a, c, g, or t
  modified_base (563)..(566): a, c, t, g, unknown or other
  misc_feature (563)..(566): n is a, c, g, or t
  modified_base (568)..(583): a, c, t, g, unknown or other
  misc_feature (568)..(583): n is a, c, g, or t
  modified_base (585)..(598): a, c, t, g, unknown or other
  misc_feature (585)..(598): n is a, c, g, or t
tcagcacgctacgtcacgaccggtgctcgatttagtgagtcagtaagggaaggggctggagtggatttcatatattagtgctggtgctactaaccatgaagtacgcagactctgtgaggggccgattcaccatttccgagggacgacgccaaagaaatcagtatatctaacaaatgagtagcctgagagacgaggacacggctgtgtattactgtgcggggcggggagccatcggaccaccctacaccaagactacgtggggaccgacgggaaccctggtccgccgtcctcctcacgccctccaaccgaacgggccccacgttaccggtcccttccccccgtcggacctaccccctacccttcccgaaaagacgacccacccttccggtggggggacctaaccgagaccgacgccccggacggggcgtcgtccgtacggtaccgaaacgggaaccttaaccgtttaccgaaccggtaaggtcccgttaggtccgttacggaggggtcccggggtacgtacggggaccgtaaacggggccggaacctaaggtaaggcaggangnnnngnnnnnnnnnnnnnnnncnnnnnnnnnnnnnn

SEQ ID NO: 255042 - DNA, 464 bp, Homo sapiens
  misc_feature: GYAE6OF02GKU4W.30.45.E01.1.454.CMB.1.raw
  modified_base (422)..(422): a, c, t, g, unknown or other
  misc_feature (422)..(422): n is a, c, g, or t
  modified_base (450)..(464): a, c, t, g, unknown or other
  misc_feature (450)..(464): n is a, c, g, or t
tcagcacgctacgtcacgaccggtgctcgatttagtgagtcagtaagggaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactagtggggccagggaaccctggtcgccgtctcctcagccctccaccgaacgggcccatccggtccttccccccgtggccaccccctcctccaacgacgccaccctcggtcgggggccactagccgacgccctgggcctcgccgtggtcaaggactactccacgtagcgtgcnggacgcgggctggacgaggccgcatagnnnnnnnnnnnnnnn

SEQ ID NO: 255043 - DNA, 262 bp, Homo sapiens
  misc_feature: GYAE6OF01DCT8F.11.66.F11.1.454.CMB.1.raw
  modified_base (260)..(262): a, c, t, g, unknown or other
  misc_feature (260)..(262): n is a, c, g, or t
tcagcgagagataccacgaccggtgctcgatttagtcacgcgagaagggaagggatatagtggctacaatcggccctactacggtatggacgtctgggccaagggaccacggtcaccgtctcctcagcctccaccaagggcccatcggtcttcccctggcaccctcctccaagagcacctctggggcacagcggccctgggctgcctggtcaaggactacttccgtatctctcgctgagcgggctggcaaggcgcatagnnn

SEQ ID NO: 255044 - DNA, 262 bp, Homo sapiens
  misc_feature: GYAE6OF01B2FGF.11.66.F11.1.454.CMB.1.raw
  modified_base (260)..(262): a, c, t, g, unknown or other
  misc_feature (260)..(262): n is a, c, g, or t
tcagcgagagataccacgaccggtgctcgatttagtcacgcgagaaagggggatatagtggctacaatcggccctactacggtatggacgtctggggccaagggaccacggtcaccgtctcctcagcctccaccaagggcccatcggtcttcccctggcaccctcctccaagagcacctctgggggcacagcggccctgggctgcctggtcaaggactacttccgtatctctcgctgagcgggctggcaaggcgcatagnnn

SEQ ID NO: 255045 - DNA, 266 bp, Homo sapiens
  misc_feature: GYAE6OF01DX93C.11.66.F11.1.454.CMB.1.raw
  modified_base (259)..(266): a, c, t, g, unknown or other
  misc_feature (259)..(266): n is a, c, g, or t
tcagcgagagataccacgaccggtgctcgatttagtcacgcgagaaagggggatatagtggctacaatcggccctactacggtatggacgtctggggccaagggaccacggtcaccgtctcctcagcctccaccaagggcccatcggtcttcccctggcaccctcctccaagagcacctctggggcacagcggccctgggctgcctggtcaaggactacttccgtatctctcgctgagcgggctggcaaggcgcatagnnnnnnnn

SEQ ID NO: 255046 - DNA, 284 bp, Homo sapiens
  misc_feature: GYAE6OF01AEZPO.11.66.F11.1.454.CMB.1.raw
  modified_base (265)..(284): a, c, t, g, unknown or other
  misc_feature (265)..(284): n is a, c, g, or t
tcagcgagagataccacgaccggtgctcgatttagtcacgcgagaaagggggagtatagtggctacaatcggccctactacggtatggacgtctggggtccaagggaccacggtcaccgtctcctcagcctccaccaagggcccatcggtcttccccctggccaccctcctccaagagcacctctgggggcacagcggccctgggctgcctggtcaaggactacttccgtatctctcgcttgagcgggctggcaaggcgcatagnnnnnnnnnnnnnnnnnnnn

SEQ ID NO: 255047 - DNA, 263 bp, Homo sapiens
  misc_feature: GYAE6OF01DFMCA.11.66.F11.1.454.CMB.1.raw
  modified_base (262)..(263): a, c, t, g, unknown or other
  misc_feature (262)..(263): n is a, c, g, or t
tcagcgagagataccacgaccggtgctcgatttagtcacgcgagaaaggggggatatagtggctacaatcggccctactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgtatctctcgctgagcgggctggcaaggcgcatagnn

SEQ ID NO: 255048 - DNA, 264 bp, Homo sapiens
  misc_feature: GYAE6OF01E4A4C.11.66.F11.1.454.CMB.1.raw
  modified_base (261)..(264): a, c, t, g, unknown or other
  misc_feature (261)..(264): n is a, c, g, or t
tcagcgagagataccacgaccggtgctcgatttagtcacgcgagaaagggggatatagtggctacaatcggccctactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgtatctctcgctgagcgggctggcaaggcgcatagnnnn

SEQ ID NO: 255049 - DNA, 263 bp, Homo sapiens
  misc_feature: GYAE6OF01AGHY4.11.66.F11.1.454.CMB.1.raw
  modified_base (261)..(263): a, c, t, g, unknown or other
  misc_feature (261)..(263): n is a, c, g, or t
tcagcgagagataccacgaccggtgctcgatttagtcacgcgagaaagggggatatagtggctacaatcggccctactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgtatctctcgctgagcgggctggcaaggcgcatagnnn

SEQ ID NO: 255050 - DNA, 264 bp, Homo sapiens
  misc_feature: GYAE6OF01CZH1C.11.66.F11.1.454.CMB.1.raw
  modified_base (261)..(264): a, c, t, g, unknown or other
  misc_feature (261)..(264): n is a, c, g, or t
tcagcgagagataccacgaccggtgctcgatttagtcacgcgagaaaggggggatatagtggctacaatcggccctactacggtatggacgtctggggccaagggaccacggtcaccgtctcctcagcctccaccaagggcccatcggtcttcccctggcaccctcctccaagagcacctctgggggcacagcggccctgggctgcctggtcaaggactacttccgtatctctcgctgagcgggctggcaaggcgcatagnnnn

SEQ ID NO: 255051 - DNA, 262 bp, Homo sapiens
  misc_feature: GYAE6OF01D3Y0A.11.66.F11.1.454.CMB.1.raw
  modified_base (261)..(262): a, c, t, g, unknown or other
  misc_feature (261)..(262): n is a, c, g, or t
tcagcgagagataccacgaccggtgctcgatttagtcacgcgagaaagggggatatagtggctacaatcggccctactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgtatctctcgctgagcgggctggcaaggcgcatagnn

SEQ ID NO: 255052 - DNA, 256 bp, Homo sapiens
  misc_feature: GYAE6OF01D5UC9.11.66.F11.1.454.CMB.1.raw
  modified_base (157)..(157): a, c, t, g, unknown or other
  misc_feature (157)..(157): n is a, c, g, or t
  modified_base (249)..(256): a, c, t, g, unknown or other
  misc_feature (249)..(256): n is a, c, g, or t
tcagcgagagataccacgaccggtgctcgatttagtcacgcgagaaggggaagactgacggtcctcccaggagttcaggtgctgggcaccgtgggcatgggggagtgtgtcacaagatttgggctctgggcaccgtgggcatgggggagtgtgtcanaagatttgggctctgggcacagcggccctgggctgcctggtcaaggactacttccgtatctctcgctgagcgggctggacaaggcgcatagnnnnnnnn

SEQ ID NO: 255053 - DNA, 265 bp, Homo sapiens
  misc_feature: GYAE6OF01EIN99.11.66.F11.1.454.CMB.1.raw
  modified_base (261)..(265): a, c, t, g, unknown or other
  misc_feature (261)..(265): n is a, c, g, or t
tcagcgagagataccacgaccggtgctcgatttagtcacgcgagaaagggggatatagtggctacaatcggccctactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgtatctctcgctgagcgggctggcaaggcgcatagnnnnn

SEQ ID NO: 255054 - DNA, 603 bp, Homo sapiens
  misc_feature: GYAE6OF01BCL0C.11.66.F11.1.454.CMB.1.raw
  modified_base (278)..(278): a, c, t, g, unknown or other
  misc_feature (278)..(278): n is a, c, g, or t
  modified_base (557)..(558): a, c, t, g, unknown or other
  misc_feature (557)..(558): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
  modified_base (572)..(576): a, c, t, g, unknown or other
  misc_feature (572)..(576): n is a, c, g, or t
  modified_base (578)..(578): a, c, t, g, unknown or other
  misc_feature (578)..(578): n is a, c, g, or t
  modified_base (580)..(585): a, c, t, g, unknown or other
  misc_feature (580)..(585): n is a, c, g, or t
  modified_base (588)..(591): a, c, t, g, unknown or other
  misc_feature (588)..(591): n is a, c, g, or t
  modified_base (593)..(594): a, c, t, g, unknown or other
  misc_feature (593)..(594): n is a, c, g, or t
  modified_base (596)..(600): a, c, t, g, unknown or other
  misc_feature (596)..(600): n is a, c, g, or t
  modified_base (602)..(603): a, c, t, g, unknown or other
  misc_feature (602)..(603): n is a, c, g, or t
tcagcgagagataccacgaccggtgctcgatttagtcacgcgagaagggctggagtgggttggccgtattaaaagcgaggccgatggtggggcagcagacttcgctgcacccgtgcaaggcagattcaccctctcaagacatgaatcagagaacatagtatatcttcaaatgaacagcctgacaaccgaggacacaggcgtgtattattgtgccagtagtggtacctggcctactctactttctttagacttgtgggccagggtaacccgtggtaccnccgttctccgtcggtccttccgaccgaacgggcccagttccggtccttcccccgtggccgtccctgcctacgacggacgcctaccgtcggtcggggccacgtacggccgggcccgtacggggcctcggtcccgtacgggtacgtaaacgggtaccctttaaccgttacccggttagttcccgttaccgttcccgggtacccggttacggtaccgggggtccgggggttaccgttacgggggaacccgtaacgggggtaccccgtagtacgtaggccgtnncgcagtncngngcnnnnnancnnnnnncgnnnncnncnnnnngnn

SEQ ID NO: 255055 - DNA, 274 bp, Homo sapiens
  misc_feature: GYAE6OF01EF8OK.11.66.F11.1.454.CMB.1.raw
  modified_base (260)..(260): a, c, t, g, unknown or other
  misc_feature (260)..(260): n is a, c, g, or t
  modified_base (266)..(274): a, c, t, g, unknown or other
  misc_feature (266)..(274): n is a, c, g, or t
tcagcgagagataccacgaccggtgctcgatttagtcacgcgagaaagggggatatagtggctacaatcggccctactacggtatggacgtctggggccaagggaccacggtcaccgtctcctcagcctccaccaagggcccatcggtccttccccctggccaccctcctccaagagcaccctcgtgggggcacagccggccctgggctgcctggtcaaggactacttccgtatctctcgctgagcgggctggcgaggcncagtgnnnnnnnnn

SEQ ID NO: 255056 - DNA, 257 bp, Homo sapiens
  misc_feature: GYAE6OF02G497L.11.66.F11.1.454.CMB.1.raw
  modified_base (255)..(257): a, c, t, g, unknown or other
  misc_feature (255)..(257): n is a, c, g, or t
tcagcgagagataccacgaccggtgctcgatttagtcacgcgagaagggatatagtggctacaatcggccctactacggtatggacgtctgggccaagggaccacggtcaccgtctcctcagcctccaccaagggcccatcggtcttcccctggcaccctcctccaagagcacctctggggcacagcggccctgggctgcctggtcaaggactacttccgtatctctcgctgagcgggctggcaaggcgcatagnnn

SEQ ID NO: 255057 - DNA, 265 bp, Homo sapiens; identical to SEQ ID NO: 255053
  misc_feature: GYAE6OF02HPTKF.11.66.F11.1.454.CMB.1.raw
  modified_base (261)..(265): a, c, t, g, unknown or other
  misc_feature (261)..(265): n is a, c, g, or t

SEQ ID NO: 255058 - DNA, 251 bp, Homo sapiens
  misc_feature: GYAE6OF02GCTZY.11.66.F11.1.454.CMB.1.raw
  modified_base (248)..(251): a, c, t, g, unknown or other
  misc_feature (248)..(251): n is a, c, g, or t
tcagcgagagataccacgaccggtgctcgatttagtcacgcgagaagggaagactgacggtcctcccaggagttcaggtgctgggcaccgtgggcatggggaggtgtgtcacaagatttgggctctgggcaccgtgggcatgggggaggtgtgtcacaagatttgggctctgggcacagcggccctgggctgcctggtcaaggactacttccgtatctctcgctgagcgggctggcaaggcgcatagnnnn

SEQ ID NO: 255059 - DNA, 264 bp, Homo sapiens
  misc_feature: GYAE6OF02GDHXX.11.66.F11.1.454.CMB.1.raw
  modified_base (252)..(264): a, c, t, g, unknown or other
  misc_feature (252)..(264): n is a, c, g, or t
tcagcgagagataccacgaccggtgctcgatttagtcacgcgagaaggggaagacgtgacggtcctcccaggagttcaggtgctgggcaccgtgggcatgggggaggtgtgtcacaagatttgggctctgggcaccgtgggcatgggggaggtgtgtcgacaagatttgggctctgggcacagcggccctgggctgcctggtcaaggactacttccgtatctctcgctgagcgggctggcaaggcgcatagnnnnnnnnnnnnn

SEQ ID NO: 255060 - DNA, 531 bp, Homo sapiens
  misc_feature: GYAE6OF02HJL81.11.66.F11.1.454.CMB.1.raw
  modified_base (518)..(518): a, c, t, g, unknown or other
  misc_feature (518)..(518): n is a, c, g, or t
tcagcgagagataccacgaccggtgctcgatttagtcacgcgagaaggggggaagcctgagaacacttagccttcatgagtgtccccaccatggcctggatgatgcttctcctcggactccttgcttttgggtcaggagtgcattctcagactgtggtgacccaggaggcatcgttctcagtgtcccctggagggacagtcacactcacttgtggtttgaaatatgggtcagtctctactgcctactaccccagttggtaccagcaggccccaggccagactccacgcacgctcatctataacacaaagactcgctcttctgggtccctgctcgcttctctggctccatccttgggaacaaagctgccctcaccatccacggggcccaggcggacgatgaatctatttattattgttgttacttttgtgggtcgtggctatttctgtctgtggttcgggcggtaggcacccgaggtcgaccgtcctcggtcacgcccaaggcctcgcccagtccgtcnctctcgttccccg

SEQ ID NO: 255061 - DNA, 280 bp, Homo sapiens
  misc_feature: GYAE6OF02I36GU.11.66.F11.1.454.CMB.1.raw
  modified_base (239)..(239): a, c, t, g, unknown or other
  misc_feature (239)..(239): n is a, c, g, or t
  modified_base (264)..(280): a, c, t, g, unknown or other
  misc_feature (264)..(280): n is a, c, g, or t
tcagcgagagataccacgaccggtgctcgatttagtcacgcgagaaaggggggagtatagtggctacaatcggccctactacggtatggacgtctggggccaagggaccacggtcaccgtctcctcagcctccaccaacgggcccatcggtccttcccctggcaccctcctccaagagcacctctggggcacagcgccctgggctgcctggtcaaggactacttccgtatctctcgctngacgcggctggcaaggcacagtagnnnnnnnnnnnnnnnnn

SEQ ID NO: 255062 - DNA, 262 bp, Homo sapiens
  misc_feature: GYAE6OF02FRXGP.11.66.F11.1.454.CMB.1.raw
  modified_base (245)..(245): a, c, t, g, unknown or other
  misc_feature (245)..(245): n is a, c, g, or t
  modified_base (251)..(262): a, c, t, g, unknown or other
  misc_feature (251)..(262): n is a, c, g, or t
tcagcgagagataccacgaccggtgctcgatttagtcacgcgagaaggggaagactgacggtcctcccaggagttcaggtgctgggcaccgtgggcagtgggggaggtgtgtcacaagatttgggctctgggcaccgtgggcagtgggggagtgtgtcactaagatttgggctctgggcacagcggccctgggctgcctggtcaaggctacttccgtatctctcgctgagcgggctggcaaggcncatagnnnnnnnnnnnn

SEQ ID NO: 255063 - DNA, 268 bp, Homo sapiens
  misc_feature: GYAE6OF02FMESW.11.66.F11.1.454.CMB.1.raw
  modified_base (262)..(268): a, c, t, g, unknown or other
  misc_feature (262)..(268): n is a, c, g, or t
tcagcgagagataccacgaccggtgctcgatttagtcacgcgagaaaggggggatatagtggctacaatcggccctactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgtatctctcgctgagcgggctggcaaggcgcatagnnnnnnn

SEQ ID NO: 255064 - DNA, 260 bp, Homo sapiens
  misc_feature: GYAE6OF02GG2L6.11.66.F11.1.454.CMB.1.raw
  modified_base (245)..(245): a, c, t, g, unknown or other
  misc_feature (245)..(245): n is a, c, g, or t
  modified_base (251)..(260): a, c, t, g, unknown or other
  misc_feature (251)..(260): n is a, c, g, or t
tcagcgagagataccacgaccggtgctcgatttagtcacgcgagaagggaagactgacggtcctcccaggagttcaggtgctgggcaccgtgggcatgggggaggtgtgtcacaagatttgggctctgggcaccgtgggcagtgggggaggtgtgtcacaagatttgggctctgggcacagcggccctgggctgcctggtcaaggactacttccgtatcgtctcgctgagcgggctggcaaggcncatagnnnnnnnnnn

SEQ ID NO: 255065 - DNA, 273 bp, Homo sapiens
  misc_feature: GYAE6OF02HBTOL.11.66.F11.1.454.CMB.1.raw
  modified_base (262)..(273): a, c, t, g, unknown or other
  misc_feature (262)..(273): n is a, c, g, or t
tcagcgagagataccacgaccggtgctcgatttagtcacgcgagaaagggggatatagtggctacaatcggccctactacggtatggacgtctgggggccaagggaccacggtcaccgtctcctcagcctccaccaagggcccatcggtcttccccctggcaccctcctccaagagcacctctgggggcacagcggccctgggctgcctggtcaaggactacttccgtatctctcgctgagcgggctggcaaggcgcatagnnnnnnnnnnnn

SEQ ID NO: 255066 - DNA, 273 bp, Homo sapiens
  misc_feature: GYAE6OF02GV7K1.11.66.F11.1.454.CMB.1.raw
  modified_base (260)..(273): a, c, t, g, unknown or other
  misc_feature (260)..(273): n is a, c, g, or t
tcagcgagagataccacgaccggtgctcgatttagtcacgcgagaaagggggatatagtggctacaatcggccctactacggtatggacgtctggggccaagggaccacggtcaccgtctcctcagcctccaccaagggcccatcggtcttccccctggcaccctcctccaagagcacctctggggcacagcgccctgggctgcctggtcaaggactacttccgtatctctcgctgagcgggctggcaaggcgcataggnnnnnnnnnnnnnn

SEQ ID NO: 255067 - DNA, 238 bp, Homo sapiens
  misc_feature: GYAE6OF01B4TPX.48.12.B01.1.454.CMB.1.raw
  modified_base (237)..(238): a, c, t, g, unknown or other
  misc_feature (237)..(238): n is a, c, g, or t
tcagagtatacatacacgaccggtgctcgatttagtagtgtagattccgcgggagttactactttgactactgggccagggagtcctggtcaccgtctcctcagcctccaccaagggcccatcggtcttcccctggcaccctcctccaagagcacctctggggcacagcggccctgggctgcctggtcaaggactacttcctatgtatactctgagcgggctggcaaggcgcatagnn

SEQ ID NO: 255068 - DNA, 240 bp, Homo sapiens
  misc_feature: GYAE6OF01DMJAG.48.12.B01.1.454.CMB.1.raw
  modified_base (239)..(240): a, c, t, g, unknown or other
  misc_feature (239)..(240): n is a, c, g, or t
tcagagtatacatacacgaccggtgctcgatttagtagtgtagattccgcgggagttactactttgactactggggccagggagtcctggtcaccgtctcctcagcctccaccaagggcccatcggtcttcccctggcaccctcctccaagagcacctctgggggcacagcggccctgggctgcctggtcaaggactacttcctctctcgactctgagcgggctggcaaggcgcatagnn

SEQ ID NO: 255069 - DNA, 282 bp, Homo sapiens
  misc_feature: GYAE6OF01EAMRC.48.12.B01.1.454.CMB.1.raw
  modified_base (278)..(282): a, c, t, g, unknown or other
  misc_feature (278)..(282): n is a, c, g, or t
tcagagtatacatacacgaccggtgctcgatttagtagtgtagattccgcgggcacgaccggtgctcgatttagctgcgtcacgatctctcttgggcccagctctgtcccacaccgcggtcacatggcaccacctctcttgcagcctccaccaagggcccatcggtcttccccctggcaccctcctccaagagcacctctggggcacagcggccctgggctgcctggtcaaggactacttcctctctcgactctgagcgggctggcaaggcgcatagnnnnn

SEQ ID NO: 255070 - DNA, 242 bp, Homo sapiens
  misc_feature: GYAE6OF01B5GEX.48.12.B01.1.454.CMB.1.raw
  modified_base (237)..(242): a, c, t, g, unknown or other
  misc_feature (237)..(242): n is a, c, g, or t
tcagagtatacatacacgaccggtgctcgatttagtagtgtagattccgcgggagttactactttgactactgggccagggagtcctggtcaccgtctcctcagcctccaccaagggcccatcggtcttcccctggcaccctcctccaagagcacctctggggcacagcggccctgggctgcctggtcaaggactacttcctatgtatactctgagcgggctggcaaggcgcatagnnnnnn

SEQ ID NO: 255071 - DNA, 172 bp, Homo sapiens
  misc_feature: GYAE6OF01C2QHI.48.12.B01.1.454.CMB.1.raw
  modified_base (172)..(172): a, c, t, g, unknown or other
  misc_feature (172)..(172): n is a, c, g, or t
tcagagtatacatacacgaccggtgctcgatttagtagtgtagattccgcgggcacgaccggtgctcgatttagtcacgcgagaaagggaaagggtgatcttgctgacgaaatttcttcatcttcccgccatctgatatgtatactctgagcgggctggcaaggcgcatagn

SEQ ID NO: 255072 - DNA, 240 bp, Homo sapiens
  misc_feature: GYAE6OF01AX1VE.48.12.B01.1.454.CMB.1.raw
  modified_base (239)..(240): a, c, t, g, unknown or other
  misc_feature (239)..(240): n is a, c, g, or t
tcagagtatacatacacgaccggtgctcgatttagtagtgtagattccgcgggagttactactttgactactggggccagggagtcctggtcaccgtctcctcagcctccaccaagggcccatcggtcttcccctggcaccctcctccaagagcacctctgggggcacagcggccctgggctgcctggtcaaggactacttcctatgtatactctgagcgggctggcaaggcgcatagnn

SEQ ID NO: 255073 - DNA, 341 bp, Homo sapiens
  misc_feature: GYAE6OF01D6HP1.48.12.B01.1.454.CMB.1.raw
  modified_base (334)..(341): a, c, t, g, unknown or other
  misc_feature (334)..(341): n is a, c, g, or t
tcagagtatacatacacgaccggtgctcgatttagtagtgtagattccgcgggcacgaccggtgctcgatttagtagtgtagattccgcgggcacgaccggtgctcgatttagctctacgctcagggcacgaccggtgctcgatttagtagcatactgttgggtttggggccaagggacaacggtcaccgtctcttcagcctccaccgaagggcccatcggtcttcccctggcgccctgctccaggagcacctccgagagcacagcggccctgggctgcctggtcaaggactacttcctctctcgactctgagcgggctggcaaggcgcatagnnnnnnnn

SEQ ID NO: 255074 - DNA, 240 bp, Homo sapiens
  misc_feature: GYAE6OF01ECOUH.48.12.B01.1.454.CMB.1.raw
  modified_base (240)..(240): a, c, t, g, unknown or other
  misc_feature (240)..(240): n is a, c, g, or t
tcagagtatacatacacgaccggtgctcgatttagtagtgtagattccgcgggagttactactttgactactggggccagggagtcctggtcaccgtctcctcagcctccaccaagggcccatcggtcttccccctggcaccctcctccaagagcacctctgggggcacagcggccctgggctgcctggtcaaggactacttcctatgtatactctgagcgggctggcaaggcgcatagn

SEQ ID NO: 255075 - DNA, 286 bp, Homo sapiens
  misc_feature: GYAE6OF01DPA1B.48.12.B01.1.454.CMB.1.raw
  modified_base (280)..(286): a, c, t, g, unknown or other
  misc_feature (280)..(286): n is a, c, g, or t
tcagagtatacatacacgaccggtgctcgatttagtagtgtagattccgcgggcacgaccggtgctcgatttagctgcgtcacgatctctcttgggcccagctctgtcccacaccgcggtcacatggcaccacctctcttgcagcctccaccaagggcccatcggtcttccccctggcaccctcctccaagagcacctcgtgggggcacagcggccctgggctgcctggtcaaggactacttcctctctcgactctgagcgggctggcaaggcgcatagnnnnnnn

SEQ ID NO: 255076 - DNA, 283 bp, Homo sapiens
  misc_feature: GYAE6OF01C6TD8.48.12.B01.1.454.CMB.1.raw
  modified_base (277)..(283): a, c, t, g, unknown or other
  misc_feature (277)..(283): n is a, c, g, or t
tcagagtatacatacacgaccggtgctcgatttagtagtgtagattccgcgggcacgaccggtgctcgatttagctgcgtcacgatctctcttgggcccagctctgtcccacaccgcggtcacatggcaccacctctcttgcagcctccaccaagggcccatcggtcttcccctggcaccctcctccaagagcacctctggggcacagcggccctgggctgcctggtcaaggactacttcctatgtatactctgagcgggctggcaaggcgcatagnnnnnnn

SEQ ID NO: 255077 - DNA, 662 bp, Homo sapiens
  misc_feature: GYAE6OF01DIRI1.48.12.B01.1.454.CMB.1.raw
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
tcagagtatacatacacgaccggtgctcgatttagtagtgtagatttggggtttaggggggaggaactgctcagttaggacccagacggaaccatggaagccccagcgcagcttctcttcctcctgctactctggctccagattccactggacaaatagtgatgacgcagtccccagccaccctgtctgtgtctccaggggaaagagtcaccctctcctgcagggccagtgagagtcttgacagctcctagcctggtaccaacaaggcctggccagccctcccaggctcctnatttacngatacatccacgagggccactggtcgtcccagccgaggttcacgtgggcggttgggtcgtggggacagtagtttcactctcaccatcagcagcctgcagttactagtaaagttactttttactaattttttaattaccttgttactagtctaggttaattcggtaaggttcggtacttacccggttaacggtttacgggaccgtaaaggggtacccgtaaaggggtacgggtaacggtaaccgtaaaaaccggtaacgttggtacggggtaccttacggacccgttaacccttaagttcccgtttacggtttaccctttaccgtaacttttccccggttttaccccccgccttaacgttaccg

SEQ ID NO: 255078 - DNA, 282 bp, Homo sapiens
  misc_feature: GYAE6OF01BBAR9.48.12.B01.1.454.CMB.1.raw
  modified_base (278)..(282): a, c, t, g, unknown or other
  misc_feature (278)..(282): n is a, c, g, or t
tcagagtatacatacacgaccggtgctcgatttagtagtgtagattccgcgggcacgaccggtgctcgatttagctgcgtcacgatctctcttgggcccagctctgtcccacaccgcggtcacatggcaccacctctcttgcagcctccaccaagggcccatcggtcttcccctggccaccctcctccaagagcacctctggggcacagcggccctgggctgcctggtcaaggactacttcctatgtatactctgagcgggctggcaaggcgcatagnnnnn

SEQ ID NO: 255079 - DNA, 666 bp, Homo sapiens
  misc_feature: GYAE6OF01EXW93.48.12.B01.1.454.CMB.1.raw
tcagagtatacatacacgaccggtgctcgatttagtagtgtagattccgcgggcacgaccggtgctcgatttagtagtgtagattccgcggcacgaccggtgctcgatttagctctacgctcaggcacgaccggtgctcgatttagtagcatactgttggttgggccaagggcaacggtcacgtctcttcagcctcacaggccatcggtctccctgcgcctgctccaggacgcacctcgagacgtcacgagtccggcctgggccttaggcccttagggtccaaagggtacctaacgtttcccgtaagtcggttaactaccgttccgtaggtaacggtccggggtacttagggccgtaaaagggtccgtacgtaacgttaacggcgtacgtcgtaacgtcgtacgtcgtacgtacgtcgtacgtacgtacgtcggtacgtcgtacgtaacgcgtcggtactcgtacgtcgtaacgtcgtcgtacgtacgtacgtcgtacgtacgtcgtacgtcgtacgtcgtacgtacgtacgtcgtacgtactgtaacgcgttcgacgttacgtcgttacgtacgtacgttcgagttacgtaccgtacttaacggtctacggttacgtcgtaccgttacgtacgtacggtacgttaacgcccgttagtacgtaccg

SEQ ID NO: 255080 - DNA, 247 bp, Homo sapiens
  misc_feature: GYAE6OF01DO7ZL.48.12.B01.1.454.CMB.1.raw
  modified_base (240)..(247): a, c, t, g, unknown or other
  misc_feature (240)..(247): n is a, c, g, or t
tcagagtatacatacacgaccggtgctcgatttagtagtgtagattccgcgggagttactactttgactactggggccagggagtcctggtcaccgtctcctcagcctccaccaagggcccatcggtcttccccctggcaccctcctccaagagcacctctgggggcacagcggccctgggctgcctggtcaaggactacttcctatgtatactctgagcgggctggcaaggcgcatagnnnnnnnn

SEQ ID NO: 255081 - DNA, 289 bp, Homo sapiens
  misc_feature: GYAE6OF01BJ1S4.48.12.B01.1.454.CMB.1.raw
  modified_base (280)..(289): a, c, t, g, unknown or other
  misc_feature (280)..(289): n is a, c, g, or t
tcagagtatacatacacgaccggtgctcgatttagtagtgtagattccgcgggcacgaccggtgctcgatttagctgcgtcacgatctctcttgggcccagctctgtcccacaccgcggtcacatggcaccacctctcttgcagcctccaccaagggcccatcggtcttccccctggcaccctcctccaagagcacctctgggggcacagcggccctgggctgcctggtcaaggactacttcctatgtatactctgagcgggctggcaaaggcgcatagnnnnnnnnnn

SEQ ID NO: 255082 - DNA, 335 bp, Homo sapiens
  misc_feature: GYAE6OF01DJQ81.48.12.B01.1.454.CMB.1.raw
  modified_base (323)..(323): a, c, t, g, unknown or other
  misc_feature (323)..(323): n is a, c, g, or t
  modified_base (325)..(325): a, c, t, g, unknown or other
  misc_feature (325)..(325): n is a, c, g, or t
  modified_base (327)..(335): a, c, t, g, unknown or other
  misc_feature (327)..(335): n is a, c, g, or t
tcagagtatacatacacgaccggtgctcgatttagtagtgtagattccgcgggcgacgaccggtgctcgatttagtagtgtagattccgcgggcgacgaccggtgctcgatttagctctacgctcagggcacgaccggtgctcgatttagtagcagtactgttgggttgggaccaagggacaacggtcacgtctcttcagcctcacgaagggccatcggtcttccctggcgcctgctccaggacgcacctcgagagcacgagcgcctgggctgcgtgtcaaggtactacttcctatgtactatcgtgagcggactgcaggcanangnnnnnnnnn

SEQ ID NO: 255083 - DNA, 258 bp, Homo sapiens
  misc_feature: GYAE6OF01EH40Z.48.12.B01.1.454.CMB.1.raw
  modified_base (240)..(258): a, c, t, g, unknown or other
  misc_feature (240)..(258): n is a, c, g, or t
tcagagtatacatacacgaccggtgctcgatttagtagtgtagattccggcgggaggttactactttgactactcggggccagggagtcctggtcaccgtctcctcagcctccaccaagggcccatcggtcttccccctggcaccctcctccaagagcacctctggggcacagcgccctgggctgcctggtcaaggactacttcctatgtatactctgagcgggctggcaagcgcatagnnnnnnnnnnnnnnnnnnn

SEQ ID NO: 255084 - DNA, 322 bp, Homo sapiens
  misc_feature: GYAE6OF01AW9P2.48.12.B01.1.454.CMB.1.raw
  modified_base (152)..(152): a, c, t, g, unknown or other
  misc_feature (152)..(152): n is a, c, g, or t
  modified_base (238)..(243): a, c, t, g, unknown or other
  misc_feature (238)..(243): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (269)..(322): a, c, t, g, unknown or other
  misc_feature (269)..(322): n is a, c, g, or t
tcagagtatacatacacgaccggtgctcgatttagtagtgtagattccgcgggagttactactttgactactggggccagggagtcctggtcaccgtctcctcagcctcaccaagggcccatcggtcttccccctggcaccctcctccaagngcacctctgggggcacagcggccctgggctgcctggtcaaggctacttcctctctcgactctgagcgggctggcaaggcgcatagnnnnnncagtagtnatgcancgntantcatcnnnnnnnnnnnnnnnnnnnnnnnnnnnnnnnnnnnnnnnnnnnnnnnnnnnnnn

SEQ ID NO: 255085 - DNA, 290 bp, Homo sapiens
  misc_feature: GYAE6OF01CQQAV.48.12.B01.1.454.CMB.1.raw
  modified_base (280)..(290): a, c, t, g, unknown or other
  misc_feature (280)..(290): n is a, c, g, or t
tcagagtatacatacacgaccggtgctcgatttagtagtgtagattccgcgggcacgaccggtgctcgatttagctgcgtcacgatctctcttgggcccagctctgtcccacaccgcggtcacatggcaccacctctcttgcagcctccaccaagggcccatcggtcttccccctggcaccctcctccaagagcacctcgtggggcacagcggccctgggctgcctggtcaaggactacttcctctctcgactctgagtcgggctggcaaggcgcatagnnnnnnnnnnn

SEQ ID NO: 255086 - DNA, 347 bp, Homo sapiens
  misc_feature: GYAE6OF01C8ST6.48.12.B01.1.454.CMB.1.raw
  modified_base (341)..(347): a, c, t, g, unknown or other
  misc_feature (341)..(347): n is a, c, g, or t
tcagagtatacatacacgaccggtgctcgatttagtagtgtagattccgcgggcacgaccggtgctcgatttagtagtgtagattccgcgggcacgaccggtgctcgatttagctctacgctcgagggcacgaccggtgctcgatttagtagcatactggttgggttgggccaagggacaacgtcacgtctctcagcctcaccgaagggcccatcggtcttcccctggcgcctgctcgaggacgcacctccgagagcacagccggccgtggggctgccgtggtacaaggtcttacttcctatgtaatactgtgacggcgggctggacgaaggcgacaatgnnnnnnn

SEQ ID NO: 255087 - DNA, 271 bp, Homo sapiens
  misc_feature: GYAE6OF01CMVTY.48.12.B01.1.454.CMB.1.raw
  modified_base (246)..(271): a, c, t, g, unknown or other
  misc_feature (246)..(271): n is a, c, g, or t
tcagagtatacatacacgaccggtgctcgatttagtagtgtagattccgcgggagttactactttgactactggggccagggagtcctggtcaccgtctcctcagcctccaccaagggcccatcgtccttccccctggccaccctcctccaagagccacctcgtgggggcacacgcggccctgggctgcctggtcaaggactacttcctatgtatactctgaggcggcgtggcaaggcgacatagnnnnnnnnnnnnnnnnnnnnnnnnnn

SEQ ID NO: 255088 - DNA, 241 bp, Homo sapiens
  misc_feature: GYAE6OF02HAL90.48.12.B01.1.454.CMB.1.raw
  modified_base (238)..(241): a, c, t, g, unknown or other
  misc_feature (238)..(241): n is a, c, g, or t
tcagagtatacatacacgaccggtgctcgatttagtagtgtagattccgcgggagttactactttgactactggggccagggagtcctggtcaccgtctcctcagcctccaccaagggcccatcggtcttcccctggcaccctcctccaagagcacctctggggcacagcggccctgggctgcctggtcaaggactacttcctatgtatactctgagcgggctggcaaggcgcatagnnnn

SEQ ID NO: 255089 - DNA, 280 bp, Homo sapiens
  misc_feature: GYAE6OF02FMBDC.48.12.B01.1.454.CMB.1.raw
  modified_base (277)..(280): a, c, t, g, unknown or other
  misc_feature (277)..(280): n is a, c, g, or t
tcagagtatacatacacgaccggtgctcgatttagtagtgtagattccgcgggcacgaccggtgctcgatttagctgcgtcacgatctctcttgggcccagctatgtcccacaccgcggtcacatggcaccacctctcttgcagcctccaccaagggcccatcggtcttcccctggcaccctcctccaagagcacctctggggcacagcggccctgggctgcctggtcaaggactacttcctatgtatactctgagcgggctggcaaggcgcatagnnnn

SEQ ID NO: 255090 - DNA, 281 bp, Homo sapiens
  misc_feature: GYAE6OF02JY0FZ.48.12.B01.1.454.CMB.1.raw
  modified_base (240)..(241): a, c, t, g, unknown or other
  misc_feature (240)..(241): n is a, c, g, or t
  modified_base (245)..(246): a, c, t, g, unknown or other
  misc_feature (245)..(246): n is a, c, g, or t
  modified_base (249)..(249): a, c, t, g, unknown or other
  misc_feature (249)..(249): n is a, c, g, or t
  modified_base (253)..(254): a, c, t, g, unknown or other
  misc_feature (253)..(254): n is a, c, g, or t
  modified_base (261)..(281): a, c, t, g, unknown or other
  misc_feature (261)..(281): n is a, c, g, or t
tcagagtatacatacacgaccggtgctcgatttagtagtgtagattccgcggggagttactactttgactactgggccagggagtcctggtcaccgtctcctcagcctccaccaagggcccatcggtcttccccctggcaccctcctccaagagcacctctgggggcacagcggccctgggctgccctggtcaaggctacttcctatgtatactctgagcgggctggcaaggcgcatagnngatnnatnctgnntgaaatnnnnnnnnnnnnnnnnnnnnn

SEQ ID NO: 255091 - DNA, 338 bp, Homo sapiens
  misc_feature: GYAE6OF02HXGN8.48.12.B01.1.454.CMB.1.raw
  modified_base (335)..(338): a, c, t, g, unknown or other
  misc_feature (335)..(338): n is a, c, g, or t
tcagagtatacatacacgaccggtgctcgatttagtagtgtagattccgcgggcacgaccggtgctcgatttagtagtgtagattccgcgggcacgaccggtgctcgatttagctctacgctcagggcacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtcaaggactacttcctatgtatactctgagcgggctgggcaaggcgcatagnnnn

SEQ ID NO: 255092 - DNA, 243 bp, Homo sapiens
  misc_feature: GYAE6OF02HIN23.48.12.B01.1.454.CMB.1.raw
  modified_base (240)..(243): a, c, t, g, unknown or other
  misc_feature (240)..(243): n is a, c, g, or t
tcagagtatacatacacgaccggtgctcgatttagtagtgtagattccgcgggagttactactttgactactggggccagggagtcctggtcaccgtctcctcagcctccaccaagggcccatcggtcttccccctggcaccctcctccaagagcacctctgggggcacagcggccctgggctgcctggtcaaggactacttcctctctcgactctgagcgggctggcaaggcgcatagnnnn

SEQ ID NO: 255093 - DNA, 282 bp, Homo sapiens; identical to SEQ ID NO: 255069
  misc_feature: GYAE6OF02IT93D.48.12.B01.1.454.CMB.1.raw
  modified_base (278)..(282): a, c, t, g, unknown or other
  misc_feature (278)..(282): n is a, c, g, or t

SEQ ID NO: 255094 - DNA, 243 bp, Homo sapiens
  misc_feature: GYAE6OF02HZZUO.48.12.B01.1.454.CMB.1.raw
  modified_base (240)..(243): a, c, t, g, unknown or other
  misc_feature (240)..(243): n is a, c, g, or t
tcagagtatacatacacgaccggtgctcgatttagtagtgtagattccgcgggagttactactttgactactggggccagggagtcctggtcaccgtctcctcagcctccaccaagggcccatcggtcttccccctggcaccctcctccaagagcacctctgggggcacagcggccctgggctgcctggtcaaggactacttcctatgtatactctgagcgggctggcaaggcgcatagnnnn

SEQ ID NO: 255095 - DNA, 811 bp, Homo sapiens
  misc_feature: GYAE6OF02HO6QH.48.12.B01.1.454.CMB.1.raw
  modified_base (303)..(303): a, c, t, g, unknown or other
  misc_feature (303)..(303): n is a, c, g, or t
  modified_base (321)..(321): a, c, t, g, unknown or other
  misc_feature (321)..(321): n is a, c, g, or t
tcagagtatacatacacgaccggtgctcgatttagtagtgtagattaggggtttgggggagacggaaccactggaagccccagtcgcgagcttcctcgttcctcctgccgtactctcggctcccaagatttccacttggacctaaactagtgattcgacgccagtccccaggcccaccctgtcggtgtcgtctccaggggaaagagtcaaccctctcctgctagggccacgtaggagtaggtcttggacctagctaccgttacgtcctaggtaccaacaaaggcctaggccacgccgtaaccnggcctcctcgaatttaanagtagttaacgaattccgaacgtaggggccctaacgtccgggtagtacccaaggtccctagggttccacgtcgggtcgggtacgggtcctaggggtaccaggtacgttcgacgttctacgaaccattcaggccaaggtcccttggcgtaaggttaccgtcgggtaaacgtttactttttaaccaactttttacttaacctaccggttacaacggtaccgtaacgtaagtacgttaaacggtcgggtaaccttccccggtaaccgtttacggaaccgtaacgggtaccctaaggggttacggaaaccgttaccgaaaaccggtaacgtacgggtacggtacgtttacggtaccgaaccgtaacgtaccgttacgggttacctttaccgtaaacgtttacccgtttaccccggtaacccgttaaccgtttacccgtttacggttaactaccgtttaccgggtttaacgttaccccggttacggttaaccggg

SEQ ID NO: 255096 - DNA, 607 bp, Homo sapiens
  misc_feature: GYAE6OF02JB1GC.48.12.B01.1.454.CMB.1.raw
  modified_base (189)..(189): a, c, t, g, unknown or other
  misc_feature (189)..(189): n is a, c, g, or t
  modified_base (280)..(280): a, c, t, g, unknown or other
  misc_feature (280)..(280): n is a, c, g, or t
tcagagtatacatacacgaccggtgctcgatttagtagtgtagatttgggtttagggggagacggaaccatggaagccccagccgcgagcttctcttccttcctgtctactctggctcccagattccactggacaaatagtgatgtacggcagtccccaggccaccctgtctgtgtctccaggggaaangtcaccctctcctgcagggccagtgagagtcttgacagctccttagcctggtaccaacaaggcctggccagcctccaggctcctcatttangatacatccacaggccactggtctcccagccaggttcacgtggcggtggtctgggacagagttcactctcaccatcagcagcctgcagtctgaagtattttactattttattactgtcagtctagtattacgtaagtggtacttccgtacgtttcggaccgaacgggtaccgtaagggtacggtaagtaccgaaacggtacgtggtacggtcgttacggacctaaccgtacgttaccgttcgttccttacgtaacgtttccctttccccggtacccttacttccgttagttactttagttacggttaactttaccgttcgttacggg

SEQ ID NO: 255097 - DNA, 324 bp, Homo sapiens
  misc_feature: GYAE6OF02FPQOD.48.12.B01.1.454.CMB.1.raw
  modified_base (289)..(324): a, c, t, g, unknown or other
  misc_feature (289)..(324): n is a, c, g, or t
tcagagtatacatacacgaccggtgctcgatttagtagtgtagattccggcgggcgacgaccggtgctcgatttagcctgcggtcacgatctcctcttgggcccagctctgtcccacaccgcggtcacatggcaccacctctcttgcagtcctccaccaagggcccatcggtcttccccctggctaccctcctccaaggagcacctcctggggcacagcggccctgggctgcctggtcaaggactacttcctatgtatactctgagcgggcctggcaaggcgcactagnnnnnnnnnnnnnnnnnnnnnnnnnnnnnnnnnnnn

SEQ ID NO: 255098 - DNA, 283 bp, Homo sapiens
  misc_feature: GYAE6OF02H0S78.48.12.B01.1.454.CMB.1.raw
  modified_base (278)..(283): a, c, t, g, unknown or other
  misc_feature (278)..(283): n is a, c, g, or t
tcagagtatacatacacgaccggtgctcgatttagtagtgtagattccgcgggcacgaccggtgctcgatttagctgcgtcacgatctctcttgggcccagctctgtcccacaccgcggtcacatggcaccacctctcttgcagcctccaccaagggcccatcggtcttccccctggcaccctcctccaagagcacctctggggcacagcggccctgggctgcctggtcaaggactacttcctatgtatactctgagcgggctggcaaggcgcatagnnnnnn

SEQ ID NO: 255099 - DNA, 206 bp, Homo sapiens
  misc_feature: GYAE6OF02FKD5C.48.12.B01.1.454.CMB.1.raw
  modified_base (205)..(206): a, c, t, g, unknown or other
  misc_feature (205)..(206): n is a, c, g, or t
tcagagtatacatacacgaccggtgctcgatttagtagtgtagattccgcgggcacgaccggtgctcgatttagtagtgtagattccgcgggcacgaccggtgctcgatttagtcacgcgagaaagggaaggggctggccctgacgtggtttctgttcccgccctcctctatgtatactctgagcgggctggcaaggcgcatagnn

SEQ ID NO: 255100 - DNA, 244 bp, Homo sapiens
  misc_feature: GYAE6OF02F5UG8.48.12.B01.1.454.CMB.1.raw
  modified_base (240)..(244): a, c, t, g, unknown or other
  misc_feature (240)..(244): n is a, c, g, or t
tcagagtatacatacacgaccggtgctcgatttagtagtgtagattccgcgggagttactactttgactactggggccagggagtcctggtcaccgtctcctcagcctccaccaagggcccatcggtcttccccctggcaccctcctccaagagcacctctgggggcacagcggccctgggctgcctggtcaaggactacttcctatgtatactctgagcgggctggcaaggcgcatagnnnnn

SEQ ID NO: 255101 - DNA, 290 bp, Homo sapiens
  misc_feature: GYAE6OF02H0LNU.48.12.B01.1.454.CMB.1.raw
  modified_base (282)..(290): a, c, t, g, unknown or other
  misc_feature (282)..(290): n is a, c, g, or t
tcagagtatacatacacgaccggtgctcgatttagtagtgtagattccgcgggcacgaccggtgctcgatttagctgcgtcacgatctctcttgggcccagctctgtcccacaccgcggtcacatggcaccacctctcttgcagcctccaccaagggcccatcggtccttccccctggccaccctcctccaagacgcacctcgtgggggcacaggcgccctgggctgcctggtcaaggacttactcctatgatactctgagcgggctggcaaggcgcatagnnnnnnnnn

SEQ ID NO: 255102 - DNA, 785 bp, Homo sapiens
  misc_feature: GYAE6OF02HLJB6.48.12.B01.1.454.CMB.1.raw
  modified_base (225)..(225): a, c, t, g, unknown or other
  misc_feature (225)..(225): n is a, c, g, or t
tcagagtatacatacacgaccggtgctcgatttagtagtgtagatttagggtttgggggaggaacgtgcctcacgttagggaccctagacgggaacctatggtaagccccagcgcgagcttactacttcctcctagcctaacctctgggcttcccgagattcactggacttaatagtggatagtaacgcacgtcccagccaccgtgtctgtgtctcgagggaagnggtcacctcgtcctggccgggacggccgagtcgagtacgttcttgacacgccttccgttagccttacggtaacctaacgaaacggcctaggccagtccctcccgaaggcctcccgttcgtacgtttacgaggtactaccgacgtacccgaaccggacgggtacctaacggttcgggttacgtaccccctaggtcccgtaagggttactacggtcgggtcgggttacggtaccgtaagggacctaggacgtttccaccgtcgtaccgacctactaccacgcctacggtcctaggacctacggtttcgtaaccggaaaaggttactttttaacctaacgtttttacgttacgttacgttcgtaaacgtacgttaaacgttaacgtaacgttaacggtacgggtaccgttaccggttacgggtttaccggaccggtaaacgggtacctaagggttaaggtaaacgacgttaaacgtacgtagggtacggttcggtaaggaccgtaccggtacttccgtacgttctttaccggtagtttcccctaccgggtccctagttaccgg

SEQ ID NO: 255103 - DNA, 276 bp, Homo sapiens
  misc_feature: GYAE6OF02JG4CX.48.12.B01.1.454.CMB.1.raw
  modified_base (240)..(276): a, c, t, g, unknown or other
  misc_feature (240)..(276): n is a, c, g, or t
tcagagtatacatacacgaccggtgctcgatttagtagtgtagattccgcgggagttactactttgactactggggccagggagtcctggtcaccgtctcctcagcctccaccaagggcccatcggtcttccccctggcaccctcctccaagagcacctctgggggcacagcggccctgggctgcctggtcaaggctacttcctatgtatactctgagcgggctggcaaggcgacatagnnnnnnnnnnnnnnnnnnnnnnnnnnnnnnnnnnnnn

SEQ ID NO: 255104 - DNA, 599 bp, Homo sapiens
  misc_feature: GYAE6OF01BGN2Q.1.48.E04.1.454.CMB.1.raw
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
  modified_base (414)..(414): a, c, t, g, unknown or other
  misc_feature (414)..(414): n is a, c, g, or t
tcagacgagtgcgtcacgaccggtgctcgatttagagagcgtcacagagagaagggggaatcagtcccactcaggacacagcatggacatgagggtccccgctcagctcctggggctcctgctgctctggttcccaggtgccaggtgtagacatccagatgacccagtctccatccctccctgtctgcatctaggtagganacagactccaccatccacgttcggccgggnagtcgaggggtcttgacaaatgtcgtttggccgttggtttcagctacgacaccgagggaacgcccctaagccgcctgatcctagtggtgcatactacttagacgtaaggtcggggtaccagtactaaggttcaggcggacgtaggtacgtcgtagggactagtacgttcactctactactacncgacgcggccgtgcgacgtcgtagaacgtctagtacgtacttaactttagttacttcgtacctaccgtagtagttcgtagttccgtaccttaccccggttacgtaaccgtttccggaaccggtaacggaccgtaagggtacgtaaacgtacgaaacgtacgtcggtagactcgaccctattaccg

SEQ ID NO: 255105 - DNA, 282 bp, Homo sapiens
  misc_feature: GYAE6OF02G0B15.1.48.E04.1.454.CMB.1.raw
  modified_base (246)..(246): a, c, t, g, unknown or other
  misc_feature (246)..(246): n is a, c, g, or t
  modified_base (263)..(263): a, c, t, g, unknown or other
  misc_feature (263)..(263): n is a, c, g, or t
  modified_base (271)..(282): a, c, t, g, unknown or other
  misc_feature (271)..(282): n is a, c, g, or t
tcagacgagtgcgtcacgaccggtgctcgatttagagagcgtcacagagagaagggggagagaggagccttagccctggattccaaggcctatccacttggtgatcagcactgagcaccgaggattcaccatggaactggggctccgctgggtttcctgttgctattttagaaggtgtccagtgtgaggtgcagctgggtgagtcgtgggggagcctggtcaaggactacttccacgcactcgtcngagcgggctggcaaggngcagtagnnnnnnnnnnnn

SEQ ID NO: 255106 - DNA, 503 bp, Homo sapiens
  misc_feature: GYAE6OF01EGPB5.40.11.A11.1.454.CMB.1.raw
  modified_base (230)..(230): a, c, t, g, unknown or other
  misc_feature (230)..(230): n is a, c, g, or t
  modified_base (479)..(479): a, c, t, g, unknown or other
  misc_feature (479)..(479): n is a, c, g, or t
  modified_base (497)..(497): a, c, t, g, unknown or other
  misc_feature (497)..(497): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtctttanacaactccaacaagcagcactacttagcttggtaccagcagaaaccaggacagcctacctaaactgctcatttactgggcctctacccgggaatcccggggtccctgaccgattcgagtggcagcgggtctgggacagatttcactctgaccatcagcagcctgcaggctagaagatgtgctagtttattactgtacaactaatattatattattccgagtacgtcgacaaggaccaaggtagaaactnaaacgatgtgctgacacntctgtc

SEQ ID NO: 255107 - DNA, 503 bp, Homo sapiens
  misc_feature: GYAE6OF01E39DJ.40.11.A11.1.454.CMB.1.raw
  modified_base (230)..(230): a, c, t, g, unknown or other
  misc_feature (230)..(230): n is a, c, g, or t
  modified_base (402)..(402): a, c, t, g, unknown or other
  misc_feature (402)..(402): n is a, c, g, or t
  modified_base (477)..(477): a, c, t, g, unknown or other
  misc_feature (477)..(477): n is a, c, g, or t
tcagtctagcgactcacgaccggtgctcgatttagctacgactgcaggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttanacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagntgtggcagtttatactgtacaacaatattatattattccgaggtacgttcggccaagggaccaaggtaggaaatnaaacgactgtggctgcaccatctgtc

SEQ ID NO: 255108 - DNA, 524 bp, Homo sapiens
  misc_feature: GYAE6OF01D2K31.40.11.A11.1.454.CMB.1.raw
  modified_base (306)..(306): a, c, t, g, unknown or other
  misc_feature (306)..(306): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttacnggcctctacccgggatccggggtccctgaccgattcagtggcagcgggtctgggacagatttcactctgaccatcagcagcctgcaggctagagaaatgtggctagtttattactgtacaactaattattaattatttattaccgtaggtacgttacggaccgaagggaccgaaggtaggaaatacaaacgaactagtggactgacacactctgttcc

SEQ ID NO: 255109 - DNA, 701 bp, Homo sapiens
  misc_feature: GYAE6OF01B9JOU.40.11.A11.1.454.CMB.1.raw
  modified_base (235)..(235): a, c, t, g, unknown or other
  misc_feature (235)..(235): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctcgtgggcgaggacgggccaccatcaactgacaagtccagccagagttctttanacaactccaacaagcagcactacttagcttggtaccagcagaaccacgacgacgctacctaactagcgtctattacgtcgcgtcctaccggtacgtccggtcccgtcgacgacgtcgtacgtaggcgaggcgggtcgtcggagacgtagttctacgtactcgtaccaactacgtacgcgacgaccgttcggacgtacgggtacgtacgtaagggaattcgggtggtacgttaacgttttaagttttaacctacgttacgtaaaccttaaagttaacgttttaactttaaagttaccttttacgggaacgggttaaccgggttcccggttaaccggaaacggggtaaacccggtaaaggggttaacgggaaaaacgttaacccaaaaccgggttaaaccggttaacgggttcgggtaacctttaccggaacccgtaacccttaaccgttggtttacccgtttacccg

SEQ ID NO: 255110 - DNA, 588 bp, Homo sapiens
  misc_feature: GYAE6OF01BY1DO.40.11.A11.1.454.CMB.1.raw
  modified_base (311)..(311): a, c, t, g, unknown or other
  misc_feature (311)..(311): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagttcttttatacaactccaacaagcagcactacttagcttgtacagacaagaaaccaggacacgcctacctaaactcgctctatttacncgggtcctacgtacccgggaactccggggtcctcgaccgtattcgacgtggcgacgcgggtcgtggacagtacttcactctacgaccagtcacgcgacgtcgtacgcgacggtcgtagaagtacgtggtacgtacgttagtttacttaacgtcgtaactaactaattacttaattagtttacgttacgaggtaccggttacggacgtaacgggaccgaaggtacggaaactacgaaacgtaacgtcggtaggcctagaccaacgtactcgtgttacc

SEQ ID NO: 255111 - DNA, 542 bp, Homo sapiens
  misc_feature: GYAE6OF01AQ4TG.40.11.A11.1.454.CMB.1.raw
  modified_base (231)..(231): a, c, t, g, unknown or other
  misc_feature (231)..(231): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttanacaactccaacaagcagcactacttagcttggtaccagcagaaaccaggacagcctacctaaaactgctcatttactgggccctcgtacccgggaatccggggtccctgaccgattcagtggcagcgggtctgggacagtatttcactctgaccatcagcagcctgcaggctagaagatgtgctagtttattactgtacaactaattattaatattaattccgaaggtacgttcggaccgaagggacctaagggttaggaaactaccgaaaacgtactaggtacgcgtacgacctaactatcgttgttacc

SEQ ID NO: 255112 - DNA, 805 bp, Homo sapiens
  misc_feature: GYAE6OF01D6TQ4.40.11.A11.1.454.CMB.1.raw
  modified_base (174)..(174): a, c, t, g, unknown or other
  misc_feature (174)..(174): n is a, c, g, or t
  modified_base (353)..(353): a, c, t, g, unknown or other
  misc_feature (353)..(353): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagaccctccgngctgtcgtctcggtgggcgaaggacggacccaaccactacctaacgtcgaaccgtaaccgtaccacgaccgtaggttacttttacttttaacaacctaaacccgtaaccaaacgaacgaccgacgaacctaaccttaacgttacgtacgtttacgaccagacaaacgaaccgacggacnccgtacctactaaacgtcgaccttactaacgtttacggcggtaccctacccgggtaaccgggtaccgggttcccccgggtacgtaccggaaccttacgtacggtacgggtcggaccgacgggggtcccggtttacggacgggtaaccctaaggtttacctttaccgaccgtttcgaaccgtaccctataacgcgaacgcgtccgtagacggacgtagacgtaagtcgttggtacgtatttaagttttattaccgtagttaaccaaattaatttaagtttaactttaacgtttaaccgttaccgggaacggttacccgggttaccggaaccgggtaaacggaaaccggttaaagggtaaacgtaaaaccgtaaaccggtaaaaccggtcgtttacgggggtaactaacccggtactaaaccctaaccgtttaattcccggttacgtttaaccc

SEQ ID NO: 255113 - DNA, 592 bp, Homo sapiens
  misc_feature: GYAE6OF01EWL8R.40.11.A11.1.454.CMB.1.raw
  modified_base (231)..(231): a, c, t, g, unknown or other
  misc_feature (231)..(231): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagttctttanaccaactccaaacaagcagcactacttagcttggtaccagcagaaaccaggacagcctcctaaactgctcatttacgtgggcctcgtaccgggaatccggggtccctgaccgattcgagtcggcaggcgggtcgtgggactaggtactttcactctgaccatccagcacgctgacgaggtctaggaacgtgtcggtggaccgtagttttaactacgtgtacaactaattacttaattaacttagttccggagttaccggttacgaccgtaaagggtacccgaagggttacggaaaacttaccgaaacggtaaacgttaggtacgtaccgttaggtaccaacccgtattccgtggttaaccc

SEQ ID NO: 255114 - DNA, 534 bp, Homo sapiens
  misc_feature: GYAE6OF01AYHBU.40.11.A11.1.454.CMB.1.raw
  modified_base (230)..(230): a, c, t, g, unknown or other
  misc_feature (230)..(230): n is a, c, g, or t
  modified_base (403)..(403): a, c, t, g, unknown or other
  misc_feature (403)..(403): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtctttanacaactccaacagcagcactacttagcttggtaccagcagaaaccaggacagcctcctaaactgctcatttactgggcctctacccgggaatcccggggtcctgaccgattcagtggcagcgggtctgggacagatttcactctgacccatcagcagccctgcaggctgaagntgtgctagtttattactgtacaactaattattaagttattattccggaggtaccgttcggacccaagggaccaagggtaggtaaactacaaacgaacgtggtaggtctggaccaaccgctacgttcgtacc

SEQ ID NO: 255115 - DNA, 546 bp, Homo sapiens
  misc_feature: GYAE6OF01DC1MX.40.11.A11.1.454.CMB.1.raw
  modified_base (232)..(232): a, c, t, g, unknown or other
  misc_feature (232)..(232): n is a, c, g, or t
  modified_base (400)..(400): a, c, t, g, unknown or other
  misc_feature (400)..(400): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctcgtgggcgagagggccaccatcaactgcaagtccagccagagttctttanacaactccaacaagcagcactacttagcttggtaccagcaagaaaccaggacagcctacctaaactgctactatttacgtcgggcccttacgtaaccccgggaactccccggggtccctggaccgtcgttcgagtggcgaggcgggtcgtggacagtattccacttcncgaccatcagcacgcctgcaggcagagntgtgntagtttatctgtacaactaattattatattattacgagtacgtcgacgtaacgggacgtaaggtgtaaactagaaacgtaacgtggtacgacgtcgacacctatcgtgttacc

SEQ ID NO: 255116 - DNA, 566 bp, Homo sapiens
  misc_feature: GYAE6OF01AJKQB.40.11.A11.1.454.CMB.1.raw
  modified_base (232)..(232): a, c, t, g, unknown or other
  misc_feature (232)..(232): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagttcttttanacaactccaacaagcagcactacttagcttggtaccagcaagaaaccaggacacgcctacctaaactgctctatttacagggcctcgtacccgggaatccggggtccctggaccgtattcgagtcggcaggcggtcgtggactagatttcactctcgaccatcagcacgcctgcaggctagagtatgtgactagtttatacgtgtacaataattattattattacgttccggtaacggtaccggttacggaccgtaagggaccgtaaagggtacgaaaactacggaaaacgtacgttgggtacgccgtacgacctaaccgattccgtgttaccc

SEQ ID NO: 255117 - DNA, 774 bp, Homo sapiens
  misc_feature: GYAE6OF01D6LI9.40.11.A11.1.454.CMB.1.raw
  modified_base (240)..(240): a, c, t, g, unknown or other
  misc_feature (240)..(240): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatcgacccagtctcagactccctggctgtgtctcgtgggcgaggacgggccaccatcaactgacaacgtccagccagtacgttcttttaanaccaactaccaacagcagcctaacttacttagcgttacggaccagacaaacgaaaccgaggaaccacgtacccttaacctaaacgtcgacttacgttaacttttaccggaccgggtacccttaccggtaccccgggtaacgtccccggggtaccctacggaccgtattaccgaggtcggcgacgggtccgggtacgtacgggactaggtactttacgaccgttcgtacgaccctagtaccgacgaccgtacggtacccgtcggaccgacgggtacctaaggaacgtcgttcgggtacggtactttaacgtttttaacgttacgtacggttaactaaacgtttaatttaacgttttaagtttaaccgtttaaccgggttaccgggtaacggggtttaccgttaaccggggaacccggtaaacgggggttaaaccggaaagggtttaaacgggaaacccttaacgggaaaaccggttacgttaggggtaccgtaacggttaccgaaccgtaccgtacgttttcgtcggtttaaccc

SEQ ID NO: 255118 - DNA, 624 bp, Homo sapiens
  misc_feature: GYAE6OF01AKH46.40.11.A11.1.454.CMB.1.raw
  modified_base (241)..(241): a, c, t, g, unknown or other
  misc_feature (241)..(241): n is a, c, g, or t
  modified_base (613)..(613): a, c, t, g, unknown or other
  misc_feature (613)..(613): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgccgtacggggacatcgtgatcgacccagtcctcagacctccctggctgtgtctcgtgggcgaggacggccaccatacaactgacaacgtccagccagtagttactttanaccaactccaacaacgcagcctaactacttacgtcgttacggtaccagaccaacgaaaccgacggaccacgtaccctacctaaactcgtactctacttacgtcgggtccctaccggtacccgggtaccgtcccggggtccctacggaccgtacttacgacggtcggcgagggtccggggtacgtacgggactacggtactttcgacctcgtacaccgtatcacgctacgcctgacgacgacgtagacgtgtggtacggtactagtttactacgtcgtaacaattaattatattagttacgtcgtacgtcggtacgacgtaaggaccgtaaggtacgaactacgaaacggtctaggacgtcgtacgacacgtntccgttgtccc

SEQ ID NO: 255119 - DNA, 807 bp, Homo sapiens
  misc_feature: GYAE6OF01DVXW8.40.11.A11.1.454.CMB.1.raw
  modified_base (185)..(185): a, c, t, g, unknown or other
  misc_feature (185)..(185): n is a, c, g, or t
  modified_base (237)..(237): a, c, t, g, unknown or other
  misc_feature (237)..(237): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagacctccctggctgtgtctgngggacgaggacgggccaccatcaactgcaacgtccagccagagttctttaanaccaactaccaaactaagcagaccacttactagtcttaggtaccagacaacgaaaccaggacacgtaccctaacctaaaacgtgaccttacgtaacttttaccggtcgggtaccccttaccggtaaaccccggggtacgttaccccgggggtaccccttaggaacccggtactttaccggagggttacggaccgtaagggtccggggttacctagggggacctagggttactttaccaaccgtttcgtacgacccgtaagttaccacggtactacgtcccgtggtaccggaacgggtcgtaacggaacggttgttacgggaccggtttattaacgtttttaacttaaccgtcgttaaccaaaagtttaaacgtttaatttaagttaaacgtttacggttacccgggtaacggttacccggggtttaccggaaaccccggttaaaacggggtaaacccgtaaagggggttaaacgaaaaccggtttaaaccaaaaccgggttaaaccgttagggtaacccgggtccgttaacgaacccgtaacccttacggtttaccgttcggtttaaccc

SEQ ID NO: 255120 - DNA, 724 bp, Homo sapiens
  misc_feature: GYAE6OF01ANMAB.40.11.A11.1.454.CMB.1.raw
  modified_base (231)..(231): a, c, t, g, unknown or other
  misc_feature (231)..(231): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttanacaactccaacaagcagcactacttagcttggtaccagacaagaaaccagacacgtcctacctaaactgctactatttacctcgggtaccctaccgtaacccgggtacgtcccggggtccctacggaccgtacttcgaggtcggacgacggccgggttacgtacggggaactaggtaacgttttcctaaccgttccgttacggtaacccacgttaccgaacgtccgaacgtcccgttagccgtaacggcgttaacggaagtagttacggtacgggttacgtaagtttttaacgttaacgttacggtaacctaaaacgtaatttaactttaagttaactttaaccgtttaccgggtaaccgggtaccggttaaccgggaacccggaaaccggggtaaccgttaaaaggggtacgtaaaacgtaaccgaaaaacggtaccggttacgggttacgaccgttaacggccctaaaccctacgttccgttagttacccg

SEQ ID NO: 255121 - DNA, 714 bp, Homo sapiens
  misc_feature: GYAE6OF01AYT6G.40.11.A11.1.454.CMB.1.raw
  modified_base (239)..(239): a, c, t, g, unknown or other
  misc_feature (239)..(239): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctcgtgggcgaggacgggccaccatcaactggacaagtccagccagtacgttcttttanacaacctccaaacaagcagccactacttagcttacggtaccagacaacgaaaccaggaccacgccctacctaaactcgtactctatttacgcgggtccctaccgtaacccgggacgtccccggggtaccctcggaccgtattcgacggtcggcgtacgggtccggggttactagggggaactacggtacttttaccgaccgttacgtaccggtaacccctagttaccgaacggtaccgtaccggtcccttacgggaccgtacgggtaccgtaaggtaacggtaggttcggtaggttaccttaggttttaacttacgtagttaacaacttaattaactttattaagttacggttaccgaacgggtaccggttacggaaccggtaaacgggtaaccgtaagggttaacggtaaactaaccggaaacggtacgttagggtacgtacgtacgacctaaccgtattccgttcggttaccg

SEQ ID NO: 255122 - DNA, 647 bp, Homo sapiens
  misc_feature: GYAE6OF01C42ZU.40.11.A11.1.454.CMB.1.raw
  modified_base (240)..(240): a, c, t, g, unknown or other
  misc_feature (240)..(240): n is a, c, g, or t
  modified_base (367)..(367): a, c, t, g, unknown or other
  misc_feature (367)..(367): n is a, c, g, or t
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtcgccgtacgggacatcgtgatcgacccagtctcagacctcccgtggctgtgtctcgtgggcgagacgggccaccatcaactgacaacgtccagccagtacttcttttanaccaactccaacaagcagacactacttagccttacggtaccagacaacgaaaccgaggacacgaccctacctaaactgcctctatttacgcggcccttaccgtacccgggtacgtccggggtacccngaccgtattcgaggtcgacgacggtcgggtcgtagggactagtacttcacttcacgacatcgacgcagcctgcgtacggntagacggngttcggtacgtacttaagttttacttacgtagtaactaaacttaagtttaactttacgttaatttaccggttaccgtaacgggttacccggtaccggaaaccggaacgggtaccgtaaagggtaacgtaaccgtaacgtaaaccggtacgtcgggttacgacgtactacccgtactcggttccttgttaccc

SEQ ID NO: 255123 - DNA, 656 bp, Homo sapiens
  misc_feature: GYAE6OF01BO3N0.40.11.A11.1.454.CMB.1.raw
  modified_base (242)..(242): a, c, t, g, unknown or other
  misc_feature (242)..(242): n is a, c, g, or t
  modified_base (639)..(639): a, c, t, g, unknown or other
  misc_feature (639)..(639): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatcgacccagtctccagacctccctggctgtgtctcgtgggcgaggacgggccaccatacaactgacaagtccagccagtacgttcttttaanacaacctccaacaagcagcctacttacttacgcttacggtaccagacgaacgaaaacccgacgggaaccacggtcccttaacctaaacgtcgtaccttactacttttaccggtccggggtaccccttaccggttaaccccggggacgttccccggggtccctacggaacccgtagttcgaggtcggaccgtagggccgggttacgagggtaactacggtactttcaccgttcgtacgacctatccgacgtcacgtccgagcgaggtctagagtgtggtcgtattagtttatcgtagactaataatattagttattacgttacggagtccggtacggacgtacggaacgtaagggtacgaaattaccgaagttacgtggtacgaccgtcgaaccctanacgtttcctgttacccg

SEQ ID NO: 255124 - DNA, 815 bp, Homo sapiens
  misc_feature: GYAE6OF01DAKV2.40.11.A11.1.454.CMB.1.raw
  modified_base (255)..(255): a, c, t, g, unknown or other
  misc_feature (255)..(255): n is a, c, g, or t
tcagtctagcgactcacgaccggtgctcgatttagctacgactgcagggggagctacaacaggcaggcaggggcagcaagatggtgttgcagacccaggtcttctatttttctgttgctctggatctctggtcgccgtacgggacatcgtgatcgacccagtcctccagtacctcccgtggcttggtgttctcgtgggcgaggacgggcccaccatccaacgtgaccaacgtccagccaagtacgttcttttaanaaccaactcaaacgagcacgactactattagccgtttaggaccagacaagaaaccgaggacacgtcctaaccgtaatcgactacttacgtttacgcggtaccttaccggtaacccgggacgtcccgggtccctaggtaccgttacgtaagttccggaaggtccggcgtacggggtccggggttacggtacggggaacgtaacgttaaccgttttcggaacccgtttacgttaccgggaaccccctttagaccggtaacggtccccgtacgggtccttacggggacgtacgggtacttaagggacgttacggttagggttacgggttaacttttaccgttttaaacgtacgttaacgtaaccgttaaaattaaggttttaattttaacccgttaaaggtttttaacccgggttacccggaaggggttaaccccgggtttaccgaaacccggggttaaacgggtaaaccggtaaacgggtaaacggtaaaacccttaccggaaaacggtttacggtggtaccggttacctacccgaactaacccggttagttccggtttccg

SEQ ID NO: 255125 - DNA, 599 bp, Homo sapiens
  misc_feature: GYAE6OF01BP1L0.40.11.A11.1.454.CMB.1.raw
  modified_base (231)..(231): a, c, t, g, unknown or other
  misc_feature (231)..(231): n is a, c, g, or t
  modified_base (309)..(309): a, c, t, g, unknown or other
  misc_feature (309)..(309): n is a, c, g, or t
  modified_base (430)..(430): a, c, t, g, unknown or other
  misc_feature (430)..(430): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttanacaactccaacaagcagcactacttagcttggtaccagcagaaaccaggacagcctacctaaactcgactcatttacncgggcctacgtacccgggaatcccggggtcctgaccgtattcgagtcggcaggcgggtctggggactaggtactttcgaacctcgtacgaaccatcacgcacgcctagcgaggctagaagntggtgctagtttattactgtacaactaatatttaattactttacgttacgtaaggtacgttaccggaccgtaaacgggtacccgtaaagggtacgtaaaacgttaccgaaaacggtaacgttcgggtacggacgttacggaccctaaccgtacttcccgttgttacccg

SEQ ID NO: 255126 - DNA, 605 bp, Homo sapiens
  misc_feature: GYAE6OF01ADXUE.40.11.A11.1.454.CMB.1.raw
  modified_base (231)..(231): a, c, t, g, unknown or other
  misc_feature (231)..(231): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctcgtgggcgagagggccacatcaactgcaagtccagccagagtcttttanacaactccaacaagcagcactacttagcttggtaccagcaacgaaaccaggacagcctacctaaactgctctaatttactcgggcctccgtacccgggagtcccggggtccctggaccgattccagtcggcaggcggtcgtgggacacgtatttcgacttctacgaccatccgagccacgtcctcgcgagggctaggaagtgtcggtggtcttagttttactacgtcgtactaactaattagttaacttaattacgtttaccgaagggtaccggttaccggaccgaacggggtaaccgaaaggggtacgtaaaacgttaccgaaacggtacgttgggtacgccgtacgactaaccgtattccgttagttacccg

SEQ ID NO: 255127 - DNA, 794 bp, Homo sapiens
  misc_feature: GYAE6OF01CPMPS.40.11.A11.1.454.CMB.1.raw
tcagtctagcgactcacgaccggtgctcgatttagctacgactgcagggggagctacaacaggcaggcaggggcagcaagatggtgttgcagacccaggtcttcatttttctgttgctctggatctcgtggtcgccgtacgggacatcgtgatcgacccagtcctccagtacctcccgtggctgtgtctcgtgggcgaggacggccaccagtaccaacgtcgacgaacgtccgacgccgagtacgtttacttttacaaccaacctaccgaaactaaggcctaacggtacctaacttaccgtttacgtccgtttacggtaaccacgtaccgaaaacgaaacccgtacggaacctaccggtaccccttaacctaaaccgtcgtacctaccgttaagtttacccggcgggtaccccttaccggtaaccccggggtaacgtccccggggttaccctacggtacccgtgtttaccgaggttcgggacccgtacgggtccggggttcgaacgggtaaccgtatttaaccgtttacaccgttacgtaccgaacctcgtacggacgaccgtacgtcccgtaggaccggtagtaccgtaaggtacgtaggttacggtaccggtacgttttaacgttaccgttagtaccgtaagtaacttaagttatttacgttaagtttaccggtacggtaacgggtccgttaaccggtaaccggaagggtaaaccggtaggtaaacgtaaccgtaaccgtaaacggttcgtacgggtagccgtaccgacgtacctgttaccgttcttacccg

SEQ ID NO: 255128 - DNA, 768 bp, Homo sapiens
  misc_feature: GYAE6OF01D17PI.40.11.A11.1.454.CMB.1.raw
  modified_base (134)..(134): a, c, t, g, unknown or other
  misc_feature (134)..(134): n is a, c, g, or t
  modified_base (269)..(269): a, c, t, g, unknown or other
  misc_feature (269)..(269): n is a, c, g, or t
  modified_base (756)..(756): a, c, t, g, unknown or other
  misc_feature (756)..(756): n is a, c, g, or t
tcagtctagcgactcacgaccggtgctcgatttagctacgactgcagggggagctacaacaggcaggcaggggcagcaagatggtgttgcagacccaggtcttctatttttctgttgctctggatctctggtcnccgtacgggacatcgtgatcgacccagtcctaccgacgtacctcccgtggcctgtcgtcctcggtgggacgaggacgggcccaaccgtataccaactgactaacgtccgacgccgtaaggtactttacttttaanaaccgaacctaccaaacgaagccacgacctaacttacgttcgcgtttacggaaccagacgtaaacggaaaccgaccggacgtaaccgaccttaaccctaaacgtacgtcgtaccttacgtttaccgtacggtcccgttacccgtaccgggtaccggttcccgggtccgtacgaccgtacgttacgtacgtcgggccgtaggtaccggtcggtaggtacgtacgttcgttaccgttcgtaccgtcgaacgtctacgacgtcgaccgtccgtgacgacggtgtaaccggtagagttcggtcgttacgttaacgttttacgttaacggttacctaaacttaacgttaaatttacgttttaaatttaacgtttaacccggtttaacgggaccggtttaaccgggcccgggttaaaccgaaacggggtaaccgtaaaggtaacggtaaacaacggtaaacggttagtccggtgcgttagacccaacgtttcncgttcggttacc

SEQ ID NO: 255129 - DNA, 726 bp, Homo sapiens
  misc_feature: GYAE6OF01CHV15.40.11.A11.1.454.CMB.1.raw
  modified_base (235)..(235): a, c, t, g, unknown or other
  misc_feature (235)..(235): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctcgtgggcgaggacgggccaccatcaactgcaagtccagccagagttcttttanacaactccaacaagcagcacttacttagcttgtaaccagcaacgaaaccgaggacacgacctacctaaactgcctactaacgttttaccgcgggtacccttaccggtaaccccggggaacgttccccgggggttacccctacggtaaccccgtaagtttcccgacgggttacgggaccgtagggtcccgggggttacgtcggggaactaggttaacttttaccgacgttccgtacggtaacctacttaccgaacggtaccgtaacggcccgttacggacgtaacgggtacgttaagggtaacggtagttcggttacgggtacgttaacgttttaacgttaacgttacgttactaaactaattaagtttaacttaatttacgtacggtacggtacggtttaccggaccggtaaacggtaccgtaaagggtacggtaaacgtaacgtaaacgaacgttggtaggtacgtcgaacaccgtactcgttgttaccg

SEQ ID NO: 255130 - DNA, 922 bp, Homo sapiens
  misc_feature: GYAE6OF01DJXWJ.40.11.A11.1.454.CMB.1.raw
tcagtctagcgactcacgaccggtgctcgatttagctacgactgcagggggagctacaacaggcaggcaggggcagcaagatgggtgttgcacgacccaggtcttctatttttctgttgctctggactctcgtggtcgaccgtacggggacatcggtgactcgacccagttcctaccgacgtaccttcccgtggtcttggtcgttcgtcggtcggggacgacggacgggacccactactaccgtaacgtcgaaccgtaacggtcccacgtacccgtaaggtacgttttaccttttaacaaacctaaaccctaccaaaacgaacgaccgtaacgtaccttaaccgtttaacgtttacgggtaccgtttaaccggggtaaccaacggtaaccggaaaacggtaaaacccgacggggaaacccttaccggtacccccttaaccgttaaaacggtcctaccgtttacttaacggtttccgaccgggtcccttaaccggtaccgggtaccggtcccgggtacctagggaccctattacggaggtcgcggtacgggtccgggttcgacgggtactacgttaccgttacgtaccgtactaccgacgtacgacgtacggtaccgaggtccgtaccggacggtaacggtacgtaaggttacggttaaggtccggtaacggtacgtttttaacggtttaacgttaccgtaacggttaaacgtttaaacttaatttaacgtttaaagtttaaccggtttaacccggtaacggttaacccggggttaccgggtaacccgggttaaacgggtaacccgggttaaaccggttaaacgggtaaccgttaaaaacccggtaccggtaaaacggtccgtaacggggttccaaccggttacgtacccgttaaccgtaacttccggtaaccttttaaccgg

SEQ ID NO: 255131 - DNA, 683 bp, Homo sapiens
  misc_feature: GYAE6OF01CPHO7.40.11.A11.1.454.CMB.1.raw
  modified_base (198)..(198): a, c, t, g, unknown or other
  misc_feature (198)..(198): n is a, c, g, or t
  modified_base (302)..(302): a, c, t, g, unknown or other
  misc_feature (302)..(302): n is a, c, g, or t
  modified_base (675)..(675): a, c, t, g, unknown or other
  misc_feature (675)..(675): n is a, c, g, or t
tcagtctagcgactcacgaccggtgctcgatttagctacgactgcagggggagctacaacaggcaggcaggggcagcaagatggtgttgcagacccaggtcttctatttttctgttgctctggatctcgtggtcgccgtacggggactagtcgtgatcgaccctagtcctaccagtacctccgtggctgtcgtctcgngggcgaggacggccaacatacaactgactacgccagccagtacgtttactttaacaaccaaccgtacaacgagtcacgacctactactacgtcgttacgaaccnaacgaacgaacgaggacacgtacctaactactcgtctacttacgttcgccggacctaccggtaaccggccggtaccggtccctaggaaccgttgtaccgtggcggtacggacggtccggtaagtcggactaagttactttcgaccttacgcgttaaccgactacgcgtaccgacgtcctaggacggtaacgtacgtacggtaacgtaggttacggccgtttatttaaacggtttctaagtaccgtaactaaattacgtttatttaaacgttcgttaaccggtacgtaacggtcgtaaccggaacggttaaacggaacggttaggtaaaccactaaccgacgtaagttcgacgatcgaaccttagtccttggtnttaacccg

SEQ ID NO: 255132 - DNA, 732 bp, Homo sapiens
  misc_feature: GYAE6OF01CFGN2.40.11.A11.1.454.CMB.1.raw
  modified_base (514)..(514): a, c, t, g, unknown or other
  misc_feature (514)..(514): n is a, c, g, or t
  modified_base (558)..(558): a, c, t, g, unknown or other
  misc_feature (558)..(558): n is a, c, g, or t
tcagtctagcgactcacgaccggtgctcgatttagctacgactgcagggggagctacaacaggcaggcaggggcagcaagatggtgttgcagacccaggtcttctattttctgttgctctggatctctggtgccgtacggggacagtcgtgatcgacccgagtcctccagacctcccgtggtctgtgtctcgtgggcgaggacgggccaccagtcaactgacaacgtccacgccagtacgttcttttactaaccaacctccaaacaacgacacacctaacttaacgttagtcgttacggaacctacgacgaaacgaaaccgaaggaaccgaccgacctaacctaacgtcgtacctaccgtaacgtttaccgtcgggtaccccttaccgggtaaccccgggtacgttaccccggggtacccgtacggtacccgtacgttcgaaggtcggaccggtacgggtccgggttacggtagggtacgtacggttactttaccgtaacgtcgtacgtaaccngttaccgacggtacacgtccgtagaccgaggtcctaaggtaagngttacggtacgtacgtttaagtttaacgttacgtacgaactaaagtactttaaagtttacttaagtttaccgtacggttaacggtacgttaccgggacgtaaacggaaccgtaaggtaaacgaacgtacgaaaacggttcgcggtgtaccgtcaaccacgtacttcgtccgtac

SEQ ID NO: 255133 - DNA, 673 bp, Homo sapiens
  misc_feature: GYAE6OF01CCHL0.40.11.A11.1.454.CMB.1.raw
  modified_base (238)..(238): a, c, t, g, unknown or other
  misc_feature (238)..(238): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatcgacccagtctccagacctcccgtggctgtgtctcgtgggcgaggacgggccacatcaactgacaagtccagccagtgttcttttanacactcaacagcagctactacttagcttacggaccagacaacgaaaccgaggaccacgtccctaacctaaaccgtctacctctactttacgcgggtaccctaccgtaacccgggtacgttcccggggtacctacggaccgtacttacgaggtcggacgtacggcgggtcaggggtactagttactttaccacgtccgacgaacccgtataccgagccgacgtccgtacgccgaaggtactaggacgtaggtcggtacgtacgtttaagtttacgttactcgtaactaacttaactttaagttattaacgtttacgtaccggtaacggttacggtaccggtaaccggtaaagggaccgttaaaggaacggttaacaacggtaaaccgtaggtaccggtaggccgtacgtaaccgtaccgtacgtcgttacgttacc

SEQ ID NO: 255134 - DNA, 707 bp, Homo sapiens
  misc_feature: GYAE6OF01COCLW.40.11.A11.1.454.CMB.1.raw
  modified_base (183)..(183): a, c, t, g, unknown or other
  misc_feature (183)..(183): n is a, c, g, or t
  modified_base (249)..(249): a, c, t, g, unknown or other
  misc_feature (249)..(249): n is a, c, g, or t
  modified_base (271)..(271): a, c, t, g, unknown or other
  misc_feature (271)..(271): n is a, c, g, or t
  modified_base (477)..(477): a, c, t, g, unknown or other
  misc_feature (477)..(477): n is a, c, g, or t
  modified_base (507)..(507): a, c, t, g, unknown or other
  misc_feature (507)..(507): n is a, c, g, or t
tcagtctagcgactcacgaccggtgctcgatttagctacgactgcagggggagctacaacaggcaggcaggggcagcaagatggtgttgcagacccaggtcttctattttctgttgctctggatctctgggtgccgtaacggggactatcgtgatgacccagtctaccgaagctcctgctgtntctctgggcgagacgggccacatacaactgactaacggtaccagaccgagtagttactttttaaanaacctaaacctccaaaacgaanccagactaactacttaacgtactttacggaaccagacaaacgaaaccaaggtacacggtaccctactaaacgtctactactaagttttacgcgggtaccctacgtaaccccgggtagtcccggggtccctaggacctacgttcgaggtcggacgtagggcgggttcgagggtaacaacggttaacttttcccgaaactttccgganaccgtaactacgagaaccgtactacccggngacgaacggcgttaaggaagtaggtacggtacgtagtttaagttttaacgtacttaaccggtactaaaacgtatttaattaatttaacttaggttaccggtacgggtacgttccggaaccaaagggtacctaaagggtacggtaaaactaacgtaaacggtaaacgtcgtagacgtactactaactacttctcggtttac

SEQ ID NO: 255135 - DNA, 783 bp, Homo sapiens
  misc_feature: GYAE6OF01BFCKA.40.11.A11.1.454.CMB.1.raw
  modified_base (104)..(104): a, c, t, g, unknown or other
  misc_feature (104)..(104): n is a, c, g, or t
  modified_base (175)..(175): a, c, t, g, unknown or other
  misc_feature (175)..(175): n is a, c, g, or t
  modified_base (182)..(182): a, c, t, g, unknown or other
  misc_feature (182)..(182): n is a, c, g, or t
  modified_base (203)..(203): a, c, t, g, unknown or other
  misc_feature (203)..(203): n is a, c, g, or t
tcagtctagcgactcacgaccggtgctcgatttagctacgactgcgaggggagctacaacaggcaggcaggggcagcaagatggtgttgcagacccaggtcttnatttttctgttgctctggatctctggtcgccgtacggggacatcgtgatcgacccagtctcagacctcccnggctgtntctcgtggcgagcggccaccntacaactgaccgagtccacgccgagtacgtttcttttagaccaacctccgaaacagccagacctaacttaccgttacgtcgttacggtaccagacaacgaaaccgaggaaccacgtaccctaaccttaaacgtcgtccttactacgtttaccgccgggtaccctaccgggtaaccccgggtacggtttccccggggtaccctaccggtaaccgttacgttccggtaaggtcgggaccgtacgggtccggggttaccgtagggtacctaaggttacctttaccgtaccggttacctacggtaacccttgtacccgaccgtaccgtaccgtcccgtacgaccgtacggacgttacgggaagtcggttaggtccgttaactttacggttttacgtttaaccgtacgttaacggtaaactttaacgtttagtttaacgttaaccgtttaacggttacccggtaaggttacccggttacggaaccggttaaccggtaaacggtaacggtaaacgtaaaccgttaacggaaacggttcgtagggtaggtaaacgtcgaacccgtagtcgttacccgttgtaacccg

SEQ ID NO: 255136 - DNA, 829 bp, Homo sapiens
  misc_feature: GYAE6OF01AK5QR.40.11.A11.1.454.CMB.1.raw
tcagtctagcgactcacgaccggtgctcgatttagctacgactgcagggggagctacaacaggcaggcaggggcagcaagatggtgttgcagacccaggtcttcatttttctgttgctctggatctctggtgccgtacggggacatcgtgatgacccagtcctccagacctcccgtggctgtgtctcgtgggcgaggacgggcccaccataccgaactcgacgaacgtccgacgccagtacgttaccttttaacaacctaacctaccaaacgaacgaccacgacctaaccttaccgttaacgtcgtttacggtaacccaagtaccgaaacggaaaccccgaacggtaacaccgtaccccttaacccttaaacgtcggcccttaaccgttaacgttttaccggtccgggtaccccgttaccggtaaacccccggggtaacgttcccccgggggttacccctacggtaaccccgttacgttacccggtaggttccgggacgtaacggggtcccggggttacgtacggggtaacctaggtttacctttcccgaaccgttccgtaccggtaaccctcgtaaccgacgtacgtaaccgtcccgtacggacggtacggtcgtaacggtaaacggttgtacggggtacgttaggtttaagttttaactttacggtaacgttaacctaaaactaagttaactttacgttacgttaccttacccgggtaggttaccccggtacggaaccgtaaggggtaacctaaggggtacgtaaaaccgtcggaaaacgttcgtaggtacccgtcgtacctcgtaaaccctgttccgttcgttacc

SEQ ID NO: 255137 - DNA, 509 bp, Homo sapiens
  misc_feature: GYAE6OF02HNFQK.40.11.A11.1.454.CMB.1.raw
  modified_base (231)..(231): a, c, t, g, unknown or other
  misc_feature (231)..(231): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttanacaactccaacaagcagcactacttagcttggtaccagcagaaaccaggacagcctcctaaaactgctcatttactgggcctctacccgggaatccggggtccctgaccgattcagtggcagcgggtctgggacagatttcactctgaccatcagcagcctgcaggctgaagatgtggctagtttattactgtacaactaatattatattattccgaggtacttcggaccaagggaccaaggtaggaaatcaaacgaactgtggctgcaccatctgtc

SEQ ID NO: 255138 - DNA, 533 bp, Homo sapiens
  misc_feature: GYAE6OF02H4TW6.40.11.A11.1.454.CMB.1.raw
  modified_base (231)..(231): a, c, t, g, unknown or other
  misc_feature (231)..(231): n is a, c, g, or t
  modified_base (306)..(306): a, c, t, g, unknown or other
  misc_feature (306)..(306): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttanacaactccaacaagcagcactacttagcttggtaccagcagaaaccaggacagcctcctaaactgctcatttacnggcctctacccgggaatccggggtcctgaccgattcagtgcagcgggtctgggacagatttcactctgaccatcagcagcctgcaggctagaagatgtggctagtttatactgtacaactaattattaatatttacttccgaggtacgttacggaccgaagggacctaagggtaggaaatccgaaaacgaacttagaggtctacggaccaaccagtcctagttaccg

SEQ ID NO: 255139 - DNA, 652 bp, Homo sapiens
  misc_feature: GYAE6OF02H1PG8.40.11.A11.1.454.CMB.1.raw
  modified_base (245)..(245): a, c, t, g, unknown or other
  misc_feature (245)..(245): n is a, c, g, or t
tcagtctagcgactcacgaccggtgctcgatttagctacgactgcgagggggagctacaacaggcaggcgaggggcagcaagatggtgttgcagacccaggtcttctatttttctgttgctctggatctctggtgccgtacggggacatcgtgatcgacccagtctccagacctccctggctgtgtctcgtgggcgaggacgggccaccatcaactgacaacgtccagccagacgttcttttaanacaactaccaacaagcagcaactactagcttcggtaccagacaacgaaaccaggacacgtcctacctaaactgcctactactttacgtcgggacctaccgtaacccgggaactccccgggggtaccctaggaccgtattccgaggtcggcgaggtcgggtcgtacggggactagttactttccaacttcgtacgaacctatccacgtcacgtccgtaggcgacggtctaggaaagtattgggtagtaccgttaagttttacttacgtagtactaaaactaattaattaattaattacgttaccggtaaggtacgttccggacgtaacggaaccgtagggtaacgaaaacttacggaaaacgtacggttagtcggtacgtacgaccaaccgtaattccgtagttaccc

SEQ ID NO: 255140 - DNA, 527 bp, Homo sapiens
  misc_feature: GYAE6OF02JSLHQ.40.11.A11.1.454.CMB.1.raw
  modified_base (231)..(231): a, c, t, g, unknown or other
  misc_feature (231)..(231): n is a, c, g, or t
  modified_base (309)..(309): a, c, t, g, unknown or other
  misc_feature (309)..(309): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttanacaactccaacaagcagcactacttaacttggtaccagcaagaaaccaggacagccctacctaaactgctcatttacncgggcctcgtacccgggaatccggggtccctgaccgattcagtgcagcgggtctgggacagactttcactctgaccatcagcagcctgcaggctagaagatgtgctagtttactactgactaactaattattatattattaccgagtacgttcggaccgaagggacctaggtagaaactcgaaacgtactggtagactagaccacatctgtacttacg

SEQ ID NO: 255141 - DNA, 502 bp, Homo sapiens
  misc_feature: GYAE6OF02FRBZT.40.11.A11.1.454.CMB.1.raw
  modified_base (231)..(231): a, c, t, g, unknown or other
  misc_feature (231)..(231): n is a, c, g, or t
  modified_base (405)..(405): a, c, t, g, unknown or other
  misc_feature (405)..(405): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttanacaactccaacaagcagcactacttagcttggtaccagcagaaaccaggacagcctacctaaactgctcatttactgggcctctacccgggaatcccggggtcctgaccgattcagtggcagcggtctgggacagatttcactctgaccatcagcacgcctgcaggctagaagntgtgctagtttatactgtacaactatattatattagttccgagtacgttcgacgaaggacaaggtagaaatacaaacgatgtgctgacacatctgtc

SEQ ID NO: 255142 - DNA, 516 bp, Homo sapiens
  misc_feature: GYAE6OF02GQ3TZ.40.11.A11.1.454.CMB.1.raw
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctctaaactgctcatttactgggcctctaccccgggaatcccgggggtccctgacccgattcagtggcagcgggtctgggacagatttcactctgaccatcagcagcctgcaggctgaagntgngcagtttatactgtcaacaatattatattattccgaggtacgttcggaccaagggaccaaggtacggaaaatcgaaaacgaactagtaggcttgccaccatctgtcc

SEQ ID NO: 255143 - DNA, 545 bp, Homo sapiens
  misc_feature: GYAE6OF02JDS8I.40.11.A11.1.454.CMB.1.raw
  modified_base (230)..(230): a, c, t, g, unknown or other
  misc_feature (230)..(230): n is a, c, g, or t
  modified_base (308)..(308): a, c, t, g, unknown or other
  misc_feature (308)..(308): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtctttanacaactccaacaagcagcactacttagcttggtaccagcaagaaaccaggacacgcctacctaaactgctcatttacnggcctcgtacccggatcccgggtcctgaccgtatcagtggcagcggtctgggacagtatttcactctgaccatcagcagcctgcgaggctagaagtagtgtggctagtttacttactgtacaataattattatattacgttaccgtaggtaccgttacggaccgtaaggtaccgaaggtacggaaataaccgaaacgtaacgtggtaggtacgtagacctaccgtattctgttaccg

SEQ ID NO: 255144 - DNA, 592 bp, Homo sapiens
  misc_feature: GYAE6OF02G7SNT.40.11.A11.1.454.CMB.1.raw
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
  modified_base (352)..(352): a, c, t, g, unknown or other
  misc_feature (352)..(352): n is a, c, g, or t
  modified_base (406)..(406): a, c, t, g, unknown or other
  misc_feature (406)..(406): n is a, c, g, or t
  modified_base (438)..(438): a, c, t, g, unknown or other
  misc_feature (438)..(438): n is a, c, g, or t
  modified_base (446)..(446): a, c, t, g, unknown or other
  misc_feature (446)..(446): n is a, c, g, or t
  modified_base (464)..(464): a, c, t, g, unknown or other
  misc_feature (464)..(464): n is a, c, g, or t
tcagtctagcgactcacgaccggtgctcgatttagctacgactgcaggggaggctacaacaggcaggcaggggcgagcaagatggtgttgcagacccaggtcttcatttttctgttgctctggatctctggtgcctacggggacatcgtgatgacccagtctccagacctccctggctgtgtctcgtgggcgagagggccacctatcaactgacaagtccagccagacgtcttttanacaactccgaanaagcagcactacttagcttacggtaccagcaagaaaccaggtacagccctacctaaatgctcaatttacgcgggccttcgaaccgggtaactccccggggtcngaccgtattcaggtgcaggcggtactgggactagtctttcacttcgtgacctancacgtacacggcctgacgacggtctaggaacngttacggnggacttaggtttattacncgtacaaactagttaacttattaattacgttaccgagggtacgttaccgacgaaggtaccgaaggttggaaaacttaacgaacggtaacttggtaggttaccaggtaccacctacgtcgtattacccg

SEQ ID NO: 255145 - DNA, 558 bp, Homo sapiens
  misc_feature: GYAE6OF02HD92V.40.11.A11.1.454.CMB.1.raw
  modified_base (231)..(231): a, c, t, g, unknown or other
  misc_feature (231)..(231): n is a, c, g, or t
  modified_base (307)..(307): a, c, t, g, unknown or other
  misc_feature (307)..(307): n is a, c, g, or t
  modified_base (420)..(420): a, c, t, g, unknown or other
  misc_feature (420)..(420): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttanacaactccaacaagcagcactacttagcttggtaccagcaagaaccaggacagcctacctaaactgctcatttacncgggcctcgtacccgggatcccggggtccctcgaccgattcgaggtgcaggcgggtcgtgggacagtactttcacgtctcgaccatcagcacgcctgccgaggctaggaagtntggtggtacgtagtttattacgtgttacaaactaattattaatattacgttccgaaggtaccgttcggaccgtaagggaccgtaaggtacggaaactaccgaaacggtactggtgacgtcgaccacctactactgttc

SEQ ID NO: 255146 - DNA, 760 bp, Homo sapiens
  misc_feature: GYAE6OF02IPPM4.40.11.A11.1.454.CMB.1.raw
  modified_base (230)..(230): a, c, t, g, unknown or other
  misc_feature (230)..(230): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccacatcaactgcaagtccagccagagtcttttanacaactccaacagcagcactacttagcttaggtaccagcaagaaaccaggacacgcctacctaaaactgacctactatttacgcgggtcccttacgtaacccgggtaacgttccccgggggtaccctacggaaccgtacgtttccgaacggttcgggacctaacgggtccggggttacgtacgggggaacctaacgggttactttttaccgacccgttacgttaccggaaccctaagtaccgtaaggcccgtaacggtaccccgttagaccggtaacgggtcgttaacggaaaacggtcgttacgggttacggtaccgttaaggtttttaactaccgttacggttaaccaaaacttaaagtttaacgtttaacgttaacgtttaaccgttaccgggtaacggttaccgtttaaccggggacccgttaaaaggggtacccgttaaagggtaggtaaaacgttaccggtaaaacgtaaccggttaggtaccggtactacggtaccaaccgttattccggttacgtttaaccg

SEQ ID NO: 255147 - DNA, 559 bp, Homo sapiens
  misc_feature: GYAE6OF02GRMLB.40.11.A11.1.454.CMB.1.raw
  modified_base (232)..(232): a, c, t, g, unknown or other
  misc_feature (232)..(232): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctcgtgggcgagagggccaccatcaactgcaagtccagccagagtcttttanacaactccaacaagcagcactacttagcttggaccagcagaaccaggacagcctacctaaactgctctatttacgcgggccttccgtaacccgggaacgttccccggggtccctcgtaacccgattcgagtggcacggcgggtcgtgggactagtactttcacttctacgacctagtccacgcacgcctgcgacggctagaagtgtggtgtactagtttatactgtacaaataattattatattactcgtaggtacgttcgaccgaagggactaaggtagaaactacgaaacgtacgtggtgacgtcgacactacttcgtcgttacc

SEQ ID NO: 255148 - DNA, 620 bp, Homo sapiens
  misc_feature: GYAE6OF02FZVOZ.40.11.A11.1.454.CMB.1.raw
  modified_base (230)..(230): a, c, t, g, unknown or other
  misc_feature (230)..(230): n is a, c, g, or t
  modified_base (341)..(341): a, c, t, g, unknown or other
  misc_feature (341)..(341): n is a, c, g, or t
tcagtctagcgactcacgaccggtgctcgatttagctacgactgcagggggagctacaacaggcaggcagggcagcaagatggtgttgcagacccaggtcttcatttttctgttgctctggatctctggtgcctacggggacatcgtgatgacccagtctccagactccctggctgtgtctctgggcagagggccaccatcaactgcaagtccagccagagttcttttanacaactccaacaagcagcactacttagcttggtaccagccaagaaaccaggacagccctacctaaatgctcatttacgcggcctcgtaccgggatccggggtcctgaccgnttcagtggcaggtcgggtctgggaactgtactttccgacttcgtagaccatcgacgcacgcctgactacggacctaggaaacgtcgtagtacggacgtaaggttttaactaccgttaggttacctaaactaaagttactttacgttaactttaacgttaccgtaaggtaccggtttacgggacccgtaaacggggtaccgtaaggtaacggtaaaaccttaggaaaaccgtacgttacgtaagggtcctagtaccgaccctaagttacgtgttaacccg

SEQ ID NO: 255149 - DNA, 652 bp, Homo sapiens
  misc_feature: GYAE6OF02GRXWK.40.11.A11.1.454.CMB.1.raw
  modified_base (233)..(233): a, c, t, g, unknown or other
  misc_feature (233)..(233): n is a, c, g, or t
  modified_base (300)..(300): a, c, t, g, unknown or other
  misc_feature (300)..(300): n is a, c, g, or t
  modified_base (371)..(371): a, c, t, g, unknown or other
  misc_feature (371)..(371): n is a, c, g, or t
  modified_base (385)..(385): a, c, t, g, unknown or other
  misc_feature (385)..(385): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctcgtgggcgagagggccaccatcaactgacaagtccagccagacgtctttanacaactccaacaagcagcactacttagcttggaccagacaagaaaccaggacagcctacctaaactnctcatttactcgggcctccgtaaccggaacgtcccggggtcctgaccgatcagtggcaggcggtctggganagtacttcactctnacctatcagcaacgccctgacgacggtacgtagaagtagttcggtacggtacgttagtttaacttacgttagtaaccgtaaaacttaagtttaatttaaactttacgtttaacgttacccggttaacgggttaacccggtttaccggggaaccgtaaaacgggggttaaccgtaaaggggttaacgggtaaaacttaaccggtaaaaacggttaaccgtagggttaccgacgttaccggaacctaacctagttcccttaggttaccc

SEQ ID NO: 255150 - DNA, 836 bp, Homo sapiens
  misc_feature: GYAE6OF02HE98R.40.11.A11.1.454.CMB.1.raw
  modified_base (232)..(232): a, c, t, g, unknown or other
  misc_feature (232)..(232): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctcgtgggcgagacgggccacatcaatgcaagtccagccagagtcttttaanacaactaccaacaagcagacacttaacttagcttaggtaccagacaagaaaccaggaacacgcctacctaaaactgaccttactaacttttaccgtacggggtacccttaccggtaaaccccgggggtaagttcccccggggggttacccctacggaacccgtacgtttaccgaaggttcgggacctaacgggtccggggttacgtacggggtaactaagggttacttttaccgaaccttaccgtacggaaccctaagttccgaaggacctaacggtcccgtacggaccgtaacgggtccttaagggaaacgttacggtagggttacgggtaccgtttaaggtttttaacttaaccggttagttaaccgtaaaacgttaaacttttaagttttaaactttaaacgttttaaccggttaaccgggtaaacggggtttaacccggtttaacccggggaaaccggtaaaacgggggttaacccgtaaaacggggttaacggtaaaaaccgttaaaccggtaaaaaccggttaaccgttacggggttaaccggtaccggttaaccggtaacctaacccggttaacttacccggtttaacggtttaccc

SEQ ID NO: 255151 - DNA, 604 bp, Homo sapiens
  misc_feature: GYAE6OF02GLDJM.40.11.A11.1.454.CMB.1.raw
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctcgtgggcgagacgggccaccatcaactgcaagtccagccagagtctttatacaactccaacaagcagcactacttagcttagtaccagcagaaaccagggggacagacctacctaaactcgcctactactttacgtcgggtccctaccgtaacccgggtaacgtcccggggtccctcggacccgtacttcgtaggtcggcaggtcgggtcgtcgggactagtattcactctcgaccatcagcagcctgcaggtctagaagngtgngacgttagtttacgttactcgtactaaactaattaatttattaatttacgttaccggtaagtaccgttacggaccgtaagggacctaagggtacggtaaactaacgaaaccgtaacgttcggtcgtacgtcgaccaccgtacttacgttagttaccg

SEQ ID NO: 255152 - DNA, 635 bp, Homo sapiens
  misc_feature: GYAE6OF02GB0YQ.40.11.A11.1.454.CMB.1.raw
  modified_base (233)..(233): a, c, t, g, unknown or other
  misc_feature (233)..(233): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaacgtccagccagtagtcttttanacactcaacagcagcactactagcttggtaccagcaagaaaccaggaacacgccctacctaaactcgacctactatttaccgtcgggtccctaccgtaacccgggacgttccccgggggtaccctcggtaacccgtattcgaggtcgcgaggtcgggtcgtagggactacggtactttcgacgttccgtacgaacctagtacacgcgtacgcctacgcgagggtcctaagggaacgtagttgggtacgtccgttaagtttacgttacgtacggtacttaaataagttactttaaagttacttttacgaccgtacggtaccgttaccggacgtaacgggactagggtaacgtaaagtacgaaacgtacgtaggtcgacgtcaccgactacgtctagttacccg

SEQ ID NO: 255153 - DNA, 688 bp, Homo sapiens
  misc_feature: GYAE6OF02HKT8A.40.11.A11.1.454.CMB.1.raw
  modified_base (237)..(237): a, c, t, g, unknown or other
  misc_feature (237)..(237): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctcgtgggcgagacgggcccaccatccaactgacaagtccagccagagttcttttanacaactccaacaagcagcactacttagcttggtaccagcaagaaacccaggacagccctacctaaactgcctactacttttacgcgggtcctaccgtaacccgggaacgttccccggggtccctagaccgtattccgaggtcggccgtagggccgggttcgtaggggaactaggttaactttccgaccttcgtacgtaccctagtccgagcctacgtcccgtgaccgaggtctagaagtgttggtacggtactttaagtttacttaccgtacggttaactaaaacgttaatttagttttaacttaacgttttaccgttacccgggtaacgggttaccggttacccgggaaccgtaaccggggaccgttaaagggttacggtaaacgtaaccgaaaacggtaacgttacgggtacgtacgttacgacctaccgtagttccgtacgtttcccg

SEQ ID NO: 255154 - DNA, 692 bp, Homo sapiens
  misc_feature: GYAE6OF02ITDU0.40.11.A11.1.454.CMB.1.raw
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (265)..(265): a, c, t, g, unknown or other
  misc_feature (265)..(265): n is a, c, g, or t
tcagtctagcgactcacgaccggtgctcgatttagctacgactgcgagggggagctacaacaggcaggcaggggcagcaagatggtgttgcagacccaggtcttcatttttctgttgctctggatctctggtgcctacgggacatcgtgactgacccagtcctcagctcctggctgtgtctgtgggcgagacgggccaccgtatccaactgcaagtccagccagagttctttanacaactcaanagcagcatactagctagtacngcagaacaggacagcctacgtaactcgactctaacgtttacgtcgggtacctaacgttaaccccggggaagttcccccgggggtacctaggtaacccgaatttcccggaaaggtcgggtacaacggggtccgggttactacggggacctagtaatttccgaacctcggtacggacctaacgtccgtaagccgaacggtccgtacggcgtaacgggaccgtagaacggttagtacgggttacgtcgttaacgttttagtaccggtagtaacctaagtaacttagttacgttaatttaccggtcgaacggttcgttaccgggaacgtaaccgggtaccgtaagggtacggtaaaactacggtaaaaccgggttataggggttacccgtacggtaccgtaccgtaaaccgtcttaccgtaccgtttaccg

SEQ ID NO: 255155 - DNA, 678 bp, Homo sapiens
  misc_feature: GYAE6OF02GKUIO.40.11.A11.1.454.CMB.1.raw
  modified_base (233)..(233): a, c, t, g, unknown or other
  misc_feature (233)..(233): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctcgtgggcgagagggccaccatcaactgcaagtccagccagagttcttttanacaactaccaacaagcagcactacttagcttggtaccagcaagaaaccaggacacgaccctacctaaactgacctactaactttaccgtcggggtacccttacccggtaaccccggggtaacgttccccggggggttcccctcggtaaccccgtagtttccgacggttcgggaccgtacggggtccgggttcgtacggggaacaaggttacttttccacgttccgtacgaacccgtatccgacgccgacgtccctgacgacggtctaggaagtagttggtcggtacgttagtttaacttcgtacgtacaaacttaattaagtttaattaatttacgtaccgtaacggttacgttacggaccgtaacgggtacgtaaggtaaggtaaacaaccgtaaaccggtactacggtacggcgtacgtacctaccgtacgttcgtattaccg

SEQ ID NO: 255156 - DNA, 741 bp, Homo sapiens
  misc_feature: GYAE6OF02GQKHK.40.11.A11.1.454.CMB.1.raw
  modified_base (239)..(239): a, c, t, g, unknown or other
  misc_feature (239)..(239): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgccgtacggggacagtcgtgatcgacccagtctccagacctccctggctgtgtctcgtgggcgagacggccacatcaactcgacaagtccagcagtacgttcttttanaacaacctaccaacaagcagctactacgtacgcttacggaccagacaacgaaaccgaggaacacgcctaccgtaactgtacttacgtactttacgcgggtacctaccggtaaccggggtaacgtccggggttaccacggaccgtcttacgacggtcggactacggggtcgggtcgtacgggaactacggtactttacgacttccgacgacctagtcgaacgtctacggtccgttaggaccgtacggtacgtacggtaaacggtagttccgggttacggtacgtttaacgtttaaacgttacggttacgtaacctaaaagtttaactttaatttaacgtttacgtttaacgttaaccgggtaacgggtttaacccgggtaacgggaaacccggtaaacggggtaaccgttaaacgggtaacggttaaacgtaaaccgtaaacgttaaccgggtacggttacggtacgtacggtaacccgtaacgtcttaccggttacgttccg

SEQ ID NO: 255157 - DNA, 733 bp, Homo sapiens
  misc_feature: GYAE6OF02G6BAJ.40.11.A11.1.454.CMB.1.raw
  modified_base (245)..(245): a, c, t, g, unknown or other
  misc_feature (245)..(245): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatcgacccagtcctccagacctccctggctgtgtctcgtgggacgaggacggcccaccatacaactgaccaagtccagccaggtacttacttttanaacctaacctaccaaacgaagcagacctaacgttacttacgtcttacggtaccagacaagaaaccaggaacacgcctaacctaactcgacctctacgtttaccgtcggtacccttaccggtaacccgggacgttccccggggtaccctcggaccgtacttcgacggtcggcgtacggtccgggtactagggactagttaactttccgacctttccgtaacgtaaccagttacccgaaggtaccaccgtccgtaggtccgagggtcctaggtaaaggtagttcgggaacgttacgtttaaacgttttacttaaccgtttcgtaaacctaaacgttaaagttactttaacgtttacgtttaaccgttaccgggtaaccggtaccgtttaccgggaaacgtaccgggtaacgtaagggtaacgtaaacgttaaccgaacgtaaccggtaggtaccgtactacgacccgtacctagttcgttacgttacccg

SEQ ID NO: 255158 - DNA, 702 bp, Homo sapiens
  misc_feature: GYAE6OF02GYMQU.40.11.A11.1.454.CMB.1.raw
  modified_base (289)..(289): a, c, t, g, unknown or other
  misc_feature (289)..(289): n is a, c, g, or t
  modified_base (322)..(322): a, c, t, g, unknown or other
  misc_feature (322)..(322): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctcgtgggcgagacgggccaccatccaactgacaacgtccagcccagtacgttcttttatacaacctaccaacaagcagcactacttagcttggtaccagcagaaaccnggacacgcctacctaactgctactatttaccgngggtacccttcgtaaccccggggtattccccggggggtcccctaggaacccgtacgtttccaggttcggcgacggtccgggtcgtagggacagtactttcactcgtacgacccatacagcctacgcccgtagcgacggtctaggaagtacgttggtacggcgtttaaggttttattaccgttcgttaacctaaacgttaactttaatttaattaagttttaccgttaacccggttaaacgggttaccggtttaaaccgggcccgtaaaacggggtacccttaaaggggtaacggtaaaccgtaacgtaaaaaccggtacgttacgggtaacggttccgttaacgggaccctaacccgtacgttaccgttgtttaaccccg

SEQ ID NO: 255159 - DNA, 692 bp, Homo sapiens
  misc_feature: GYAE6OF02IZVRZ.40.11.A11.1.454.CMB.1.raw
tcagtctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctcgtggcgagagggccaccgatcaactcgacaacgtccaggcctaggacgttctttataacaacctaccaacacgacagcaactaccttaagcttaggtaccagcaagaacaggacaagccctacctaaacgtcgactactaacgtttcgtcggggtacccttaccggtaacccgggtaacgtcccgggggtaccctacggtaacccgtattcgacggtcggacgacggtccgggtactacgggacctagtacgtttcgaacgttcgtaacgacctacgttaccgaggactacggacctcggtacgacggtgttaccgaaagtcgttaggtcggacgttaaggttttactacgtttacgaacgtaacttaacgttaatttaacgttaacgtttacgttaccggtaacggttaccgttaccggtaccgtaaacgggacccggttaaggtaacggaacttaacggaaacgtacgttcgaggtaccttacgactaccgacgttacgtcggttac

SEQ ID NO: 255160 - DNA, 955 bp, Homo sapiens
  misc_feature: GYAE6OF02JALRK.40.11.A11.1.454.CMB.1.raw
tcagtctagcgactcacgaccggtgctcgatttagctacgactgcagggggagctacaacaggcaggcaggggcagcaagatggtgttgcagacccaggtcttcattttctgttgctctggatctctggtcgccgtacggggacatcgtgatcgacccagtcctccagtacctcccgtggcttgtgtctcgtgggcgaggacgggaccaccactccaactcgacaacgtccagccgagtacgttcttttaacaacctaacctaccaaacgaacgcaacgacctaacttacgttacgtacgttaccggtaacctacgaaccgtaaacggaaaaacccgaacggggtaaacctaacccggtaacccccgttaaaccccttaaaaaccggttccgtaacccgtttaacccttaaaccggtttttaacccggtacccgggggtacccccgtttaaccccgggttaaaacccccgggggtaaaccggtttacccccccgggggggttacccctaccggggtaaaccccggttaaccgttttaccggaaaccggggtttcgggacccgggtaacgggttaccccgggggttacggttaaaccggggaacgttaacgttaacccgtttttacccgaaccgttacccggtacgtaaaccccgtaagtcccgtaacgtaccccggtaacgtcccggttacgaccggtaacggggtacctaacgggtaaacgttacggttacgggttaccggttaacgtttaacgttttacgttacgttaaccggtaaactaaacgttaaacgtttactttaacgtttaacgtttaacgttaccgggtaaccggttacgttaaccgggaaccgtaaacggggtacgtaagggtaaacgtaaaccgtaaccgtaaacggttacgtaggtaaccggtcgttaaccgaacccgtacgtacgttaccgttgttaacccg

SEQ ID NO: 255161 - DNA, 671 bp, Homo sapiens
  misc_feature: GYAE6OF02I3KID.40.11.A11.1.454.CMB.1.raw
  modified_base (240)..(240): a, c, t, g, unknown or other
  misc_feature (240)..(240): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (311)..(311): a, c, t, g, unknown or other
  misc_feature (311)..(311): n is a, c, g, or t
tcagtctagcgactcacgaccggtgctcgatttagctacgactgcaggggggagctacaacaggcaggcaggggcagcaagatggtgtgcagacccaggtcttctatttttctgttgctctggatctctgggtcgccgtacggggacagtcgtagatcgacccagtctccagcctccgtggctgtgtctcgtgggcgagcgggccacatcaacgtgacagtccagcagtacgttctttanacactaccaanaancagacactactagtcttcggacagacgaacgaaccaggaccacgtacctaccgtaancgtctactagtttaccgcggtaccctacgtaaccgggacggtccccggttaccaggaacctgttaccgaggtcgggaccgtaggtccgggtagtacggggactaacgtacgtttaccaccgtttcgacggacctataccgtagacgacgtcgcggtacacgggtacaggaacgtgtcggtagtacgtttacgttaccgtttagttacgtaacgtaaacttaagttaactttaacgttaacgtttaaccgtacgggtaaacggttacggttaacccggaacgggttaaaccggacgttaacgggtagtaaacgtaacgtaacgaacgttgacggtactacggaccaatcgtacggtacttc

SEQ ID NO: 255162 - DNA, 701 bp, Homo sapiens
  misc_feature: GYAE6OF02JP2V6.40.11.A11.1.454.CMB.1.raw
  modified_base (357)..(357): a, c, t, g, unknown or other
  misc_feature (357)..(357): n is a, c, g, or t
  modified_base (536)..(536): a, c, t, g, unknown or other
  misc_feature (536)..(536): n is a, c, g, or t
  modified_base (564)..(564): a, c, t, g, unknown or other
  misc_feature (564)..(564): n is a, c, g, or t
  modified_base (671)..(671): a, c, t, g, unknown or other
  misc_feature (671)..(671): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgccgtacggggacatcgtgagtcgacccagtcctccagacctccctggtctgtgtcctcgtggggcgaggacgggaccaccgatactaaccgtgaccaacgtcccgacgaccgagtacgttctttttaactaaccaacctaccctaaacaacggcaacgcctaacgtacctttaggcctttacggaccagaccaacgaaaccgacgacaccgtactacctaacgtnacttacgtatttacggaccggtacctaccggtaacccggtacggtcccgggtccctagtaccgtattccgaggtcgcagggtccggacgtacggtacgtagtactttccgaccttcgtacgaccctagtaccgcgtaaccggtggcccctagggaagccggttaactacgggaacggtntaaacgggttctaacggttttaccgttntacgtttacctaacaagttaacttaactttagtttacctagggtaccgtaggtccgtagtaaccgagggtaacctaggacggttaacacgtaacgaacggtttgacncgttaccgataacctcgtagttcgtaaccc

SEQ ID NO: 255163 - DNA, 803 bp, Homo sapiens
  misc_feature: GYAE6OF02FKJ00.40.11.A11.1.454.CMB.1.raw
  modified_base (132)..(132): a, c, t, g, unknown or other
  misc_feature (132)..(132): n is a, c, g, or t
  modified_base (244)..(244): a, c, t, g, unknown or other
  misc_feature (244)..(244): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtnccgtacggggacagtcgtgatgacccagtctccagactcccgtggctgtgtctgtcgggcgaggacggccacataccaactcgacaacgtccagaccagtagttactttaanacctaactaccaaacaagccagccacttaacttacgacttacggtacctagacaagaaaccgaggaccaacggtcccttaacctaaacgtcgtaccgttactaacgttttaccgtcgggtacccttaccggtaaccccggggtacgttcccccgggggtaccctacgggtaacccgttagttaccgtacggttcgaccggtagggtccgggtacgtagggaacctaggttacttcgaccgttacgacgtaaccgtaattaccgaaggtacgacggtcccgtaggtacgaacgggtaccgttaggtaaacgtcgttacgggtacgggttaccttaaacggttttaacgtacgttaaggttaaccctaaaagtaaacttttaacgttaagttaagtttaccggttaacggaaccgggttaaccggttaccgggtaaaccggtaaacggggtaacccgtaagggtaacggttaaaaaccgtaaccggtaaaacggtaccggttagggtaccggtacttacccggaaaccttacccggtaacgtttacccgtagtttaccccg

SEQ ID NO: 255164 - DNA, 714 bp, Homo sapiens
  misc_feature: GYAE6OF02JZ0LX.40.11.A11.1.454.CMB.1.raw
  modified_base (309)..(309): a, c, t, g, unknown or other
  misc_feature (309)..(309): n is a, c, g, or t
tcagtctagcgactcacgaccggtgctcgatttagctacgactgcagggggagctacaacaggcaggcaggggcagcaagatggtgttgcagacccaggtcttcattttctgttgctctggatctctggtcgccgtacggggacatcgtagatcgacccagtcctccagacctcctggctgtcgtctcgtgggcgaggacggccacctatcaacgtcgactaacgtccgagccagtacggttctttttaaacaacctaacctaccaaacgtaagcctagactaacttaactacgtcgttacgtaccgancgaaacgaaaccgacggtaacacgcctaaccgtaactgcctactaactttcggcggtacctacccggtaacccgggtacggtccccggggtcctacggtacccgtactttcggaacgtcgggaccaggggccgggtttacggaccggaacgttacgtactttaccggacttaccgttacgaccgtaatacggacgttacgcgtccgtagccagggtactacgagtagttcgcggtactaggtttactacgtcgtaacctaagtaagttaacttagttaaaccgttacggttaacccggtaggttacgtacccggtaacggaacggtacggaaaggtacggtaaacgaaccttaaacgcgtaacggttacgaccgttagaacccgtatacgttcctacgtttaccg

SEQ ID NO: 255165 - DNA, 801 bp, Homo sapiens
  misc_feature: GYAE6OF02HAUQM.40.11.A11.1.454.CMB.1.raw
  modified_base (239)..(239): a, c, t, g, unknown or other
  misc_feature (239)..(239): n is a, c, g, or t
tcagtctagcgactcacgaccggtgctcgatttagctacgactgcaggggggagctacaacaggcaggcaggggcagcaagatggtgttgcagacccaggtcttctatttttctgttgctctggatctctggtgccgtacggggacatcgtgatcgacccagtcctccgagacctccctggctgtgtctgtgggcgaggcggccacatcatgacaagtccagccagtagtttactttanaccaacctaccaacaagcacgctactaacttacgtacgttacggtaccacgacgaagaacccgaggaccacgcctacctaaactcgccttactactttacggtcggaccttacccggtaccgggtaaccggtccccgggggttcctacgggacctacgttacgacggtagggccgtagggtccgggttcgtacggggactaagggtactttacccgacttaccgtacgtaacccgtatccggtaacgtacccggtaccgtacccgttcggaaccggtacgggtaacgttacgggaaagttaacgttcgggttaagttacgtttacgttttaaacgtttcgttagtaaacctaaacgttaaactttagttttaaagttacgtttaaccgggttaaccgggttacggggttaccgggttaccccggaaggggttaacccgggaacgggttaaacgggtaacgggttaaacggtaaacccgtaaaacgggtttaaaccggtaggtttaaccggttacccggtaacggtaccgttaaacctttacggttaccggtttcttaacccg

SEQ ID NO: 255166 - DNA, 684 bp, Homo sapiens
  misc_feature: GYAE6OF02FPP0P.40.11.A11.1.454.CMB.1.raw
  modified_base (247)..(247): a, c, t, g, unknown or other
  misc_feature (247)..(247): n is a, c, g, or t
  modified_base (473)..(473): a, c, t, g, unknown or other
  misc_feature (473)..(473): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgccgtacggggacatcgtgatcgacccagtctccgagcctcccgtggctgtgtctcgtgggcgaggacggccaccatcaacgtgaccaacgtccagccaagtacgtttcttttaanacctaacctaccaaacgaagcacgacctaacttacgttagtctttacggtaaccaggacaacgtaaaccgaggacacgtccctaaccgtaactcgacctacgtactttacggcggtaccctaccgtacccgggtacgtccccggggtcctacggacgtacttacgacgggtcggacgacgggtcggtcgtacgggaacgtacgtatttccacgtctacgaccgtancgacgacgacgtccgtcgacgtacggcgtaagacgtagtggtagtacgtttagtttcttacgtacgtaactaactaattagtttaacttagtttacgtacgtaacggtacgttaaccggacggtaacggtacgtaggtaacggtaacgtaacggtaaacgtacgtacggtacgtaccgtacgtacccgtacggtcttaccgttgttacccg

SEQ ID NO: 255167 - DNA, 831 bp, Homo sapiens
  misc_feature: GYAE6OF02HJD2K.40.11.A11.1.454.CMB.1.raw
  modified_base (245)..(245): a, c, t, g, unknown or other
  misc_feature (245)..(245): n is a, c, g, or t
tcagtctagcgactcacgaccggtgctcgatttagctacgactgcagggggagctacaacaggcaggcaggggcagcaagatggtgttgcagacccaggtcttcatttttctgttgctctggatctctggtgccgtacgggacatcgtgatcgacccagtctccagtacctcccgtggctgtgtctgtgggcgaggacggccacatacaactgacaacgtccacgaccagtacgttacttttaanaacctaacctaccaaacaacgcaagtacctaaccgttacttagtccgttacggtaaccctagaccaaacgaaaaccgagggtaccacggtaccccttaaccttaaaacgtcgtaccttacctaatttacccggtcgggtaccccttaccgggtaaccccggggtaaccggttccccccggggttaccctacgggtaacccttacgttccggtacgggtacggaccggtacggggtccgggttacggtaacggggcttaacggttaccttttaccgacccgtttcgaaccgtaccgtaacgtaccgtacggtaccgaccggtccgtacggaccggtaacgggtacgtaacgggtaagtacgggttacgggtaccggttagtttaaccggttttaaacgttaccgttaacggttaactaaaccgttaaatttaacgtttaaactttaacgttaccggttaacgttaaccgggttaacccgtaccgggttaaacgaacggggtaaccggtaaggtaaccgtaaacgtaaccggtaaacgtaccgtaaggtcggtactaccggacctaccgtacgttccgtccgttaccg

SEQ ID NO: 255168 - DNA, 179 bp, Homo sapiens
  misc_feature: GYAE6OF01BHR9W.25.50.E06.1.454.CMB.1.raw
  modified_base (178)..(179): a, c, t, g, unknown or other
  misc_feature (178)..(179): n is a, c, g, or t
tcagactgtacagtcacgaccggtgctcgatttagatctactgacaacacacaagggcccatcggtcttcccctggcgccctgctccaggagcacctccgagagcacagcggccctgggctgcctggtcaaggactacttccactgtacagtctgagcgggctggcaaggcgcatagnn

SEQ ID NO: 255169 - DNA, 181 bp, Homo sapiens
  misc_feature: GYAE6OF01D5HUV.25.50.E06.1.454.CMB.1.raw
  modified_base (178)..(181): a, c, t, g, unknown or other
  misc_feature (178)..(181): n is a, c, g, or t
tcagactgtacagtcacgaccggtgctcgatttagatctactgacaacacacaagggcccatcggtcttcccctggcgccctgctccaggagcacctccgagagcacagcggccctgggctgcctggtcaaggactacttccactgtacagtctgagcgggctggcaaggcgcatagnnnn

SEQ ID NO: 255170 - DNA, 328 bp, Homo sapiens
  misc_feature: GYAE6OF01E0GW3.25.50.E06.1.454.CMB.1.raw
  modified_base (324)..(328): a, c, t, g, unknown or other
  misc_feature (324)..(328): n is a, c, g, or t
tcagactgtacagtcacgaccggtgctcgatttagatctactgacaacacacaagggcactgatttatggtgcaactaaaaacactcttggacccctgcccggttctcaggctccctccttgggggcaaagctgccctgacactgtcagatgtgcagcctgaggacgaggctgactaccactgcctgctctcctctggtggtgcttgggtgttcggcggagggaccaaactgaccgtcctgggtcagcccaaggctgccccctcggtcactctgttcccgccctcctcactgtacagtctgagcgggctggcaaggcgcatagnnnnn

SEQ ID NO: 255171 - DNA, 178 bp, Homo sapiens
  misc_feature: GYAE6OF01CV4MJ.25.50.E06.1.454.CMB.1.raw
  modified_base (178)..(178): a, c, t, g, unknown or other
  misc_feature (178)..(178): n is a, c, g, or t
tcagactgtacagtcacgaccggtgctcgatttagatctactgacaacacacaagggcccatcggtcttcccctggcgccctgctccaggagcacctccgagagcacagcggccctgggctgcctggtcaaggactacttccactgtacagtctgagcgggctggcaaggcgcatagn

SEQ ID NO: 255172 - DNA, 325 bp, Homo sapiens
  misc_feature: GYAE6OF01APWIG.25.50.E06.1.454.CMB.1.raw
  modified_base (321)..(325): a, c, t, g, unknown or other
  misc_feature (321)..(325): n is a, c, g, or t
tcagactgtacagtcacgaccggtgctcgatttagatctactgacaacacacaagggcactgatttatggtgcaactaaaaacactcttggacccctgcccggttctcaggctccctccttggggcaaagctgccctgacactgtcagatgtgcagcctgaggacgaggctgactaccactgcctgctctcctctggtggtgcttgggtgttcggcggagggaccaaactgaccgtcctgggtcagcccaaggctgcccctcggtcactctgttcccgccctcctcactgtacagtctgagcggctggcaaggcgcatagnnnnn

SEQ ID NO: 255173 - DNA, 182 bp, Homo sapiens
  misc_feature: GYAE6OF01DOOZY.25.50.E06.1.454.CMB.1.raw
  modified_base (178)..(182): a, c, t, g, unknown or other
  misc_feature (178)..(182): n is a, c, g, or t
tcagactgtacagtcacgaccggtgctcgatttagatctactgacaacacacaagggcccatcggtcttcccctggcgccctgctccaggagcacctccgagagcacagcggccctgggctgcctggtcaaggactacttccactgtacagtctgagcgggctggcaaggcgcatagnnnnn

SEQ ID NO: 255174 - DNA, 329 bp, Homo sapiens
  misc_feature: GYAE6OF01DPAMZ.25.50.E06.1.454.CMB.1.raw
  modified_base (324)..(329): a, c, t, g, unknown or other
  misc_feature (324)..(329): n is a, c, g, or t
tcagactgtacagtcacgaccggtgctcgatttagatctactgacaacacacaagggcactgatttatggtgcaactaaaaaacactcttggacccctgcccggttctcaggctccctccttgggggcaaagctgccctgacactgtcagatgtgcagcctgaggacgaggctgactaccactgcctgctctcctctggtggtgcttgggtgttcggcggagggaccaaactgaccgtcctgggtcagcccaaggctgccccctggtcactctgttcccaccctcctcactgtacagtctgagcgggctggcaaggcgcatagnnnnnn

SEQ ID NO: 255175 - DNA, 330 bp, Homo sapiens
  misc_feature: GYAE6OF01DB6HS.25.50.E06.1.454.CMB.1.raw
  modified_base (320)..(320): a, c, t, g, unknown or other
  misc_feature (320)..(320): n is a, c, g, or t
  modified_base (326)..(330): a, c, t, g, unknown or other
  misc_feature (326)..(330): n is a, c, g, or t
tcagactgtacagtcacgaccggtgctcgatttagatctactgacaacacacaagggcactgatttatggtgcaactaaaaaacactcttggacccctgcccggttctcaggctccctccttgggggcaaagctgccctgacactgtcagatgtgcagcctgaggacgaggctgactaccactgcctgctctcctctggtggtgcttgggtgttcggcggagggaccaaactgaccgtcctgggtcagcccaaggctgccccctggtcactctcgttcccgccctcctcactgtacagtctgagcgggctgggcaaggcncatagnnnnn

SEQ ID NO: 255176 - DNA, 332 bp, Homo sapiens
  misc_feature: GYAE6OF01A3AMD.25.50.E06.1.454.CMB.1.raw
  modified_base (326)..(332): a, c, t, g, unknown or other
  misc_feature (326)..(332): n is a, c, g, or t
tcagactgtacagtcacgaccggtgctcgatttagatctactgacaacacacaagggcactgatttatggtgcaactaaaaaacactcttggacccctgcccggttctcaggctccctccttgggggcaaagctgccctgacactgtcagatgtgcagcctgaggacgaggctgactaccactgcctgctctcctctggtggtgcttgggtgttcggcggagggaccaaactgaccgtcctgggtcagcccaaggctcgccccctcggtcactctgttcccaccctcctcactgtacagtctgagcgggctggcaaggcgcatagnnnnnnn

SEQ ID NO: 255177 - DNA, 339 bp, Homo sapiens
  misc_feature: GYAE6OF01C8SYC.25.50.E06.1.454.CMB.1.raw
  modified_base (321)..(321): a, c, t, g, unknown or other
  misc_feature (321)..(321): n is a, c, g, or t
  modified_base (328)..(339): a, c, t, g, unknown or other
  misc_feature (328)..(339): n is a, c, g, or t
tcagactgtacagtcacgaccggtgctcgatttagatctactgacaacacacaagggcactgatttatggtgcaactaaaaaacacttcttggacccctgcccggttctcaggctccctccttgggggcaaagctgccctgacactgtcagatgtgcagcctgaggacgaggctgactaccactgcctgctctcctctgggtggtgcttggggtgttcgggcggagggaccaaatgaccgtcctgggtcagcccaaggctgcccctcggtcactctgttcccaccctcctcactgtacagtctgagcgggctggcaaggcncatagcnnnnnnnnnnnn

SEQ ID NO: 255178 - DNA, 345 bp, Homo sapiens
  misc_feature: GYAE6OF01AD9AE.25.50.E06.1.454.CMB.1.raw
  modified_base (335)..(345): a, c, t, g, unknown or other
  misc_feature (335)..(345): n is a, c, g, or t
tcagactgtacagtcacgaccggtgctcgatttagatctactgacaacacacaagggcactgatttatggtgcaactaaaaaacactcttggacccctgcccggttctcaggctccctccttgggggcaaagctgccctgacactgtcagatgtgcagcctgaggacgaggctgactaccactgcctgctctcctctggtggtgcgttgggtgttcgggcggagggaccaaacgtgaccgtccgtgggtcacgcccgaaggcctcgccccctcggtcactctacgttcccaccctcctcactgtacagtctgaggcggctggcaaggcgcatagnnnnnnnnnnn

SEQ ID NO: 255179 - DNA, 331 bp, Homo sapiens
  misc_feature: GYAE6OF01C6KHR.25.50.E06.1.454.CMB.1.raw
  modified_base (325)..(331): a, c, t, g, unknown or other
  misc_feature (325)..(331): n is a, c, g, or t
tcagactgtacagtcacgaccggtgctcgatttagatctactgacaacacacaagggcactgatttatggtgcaactaaaaaacactcttggacccctgcccggttctcaggctccctccttgggggcaaagctgccctgacactgtcagatgtgcagcctgaggacgaggctgactaccactgcctgctctcctctggtggtgcttgggtgttcggcggagggaccaaactgaccgtcctgggtcagcccaaggctgccccctggtcactctcgttcccacctcctcactgtacagtctgacgcgggctggcaaggcgcatagnnnnnnn

SEQ ID NO: 255180 - DNA, 351 bp, Homo sapiens
  misc_feature: GYAE6OF01CSTJF.25.50.E06.1.454.CMB.1.raw
  modified_base (343)..(351): a, c, t, g, unknown or other
  misc_feature (343)..(351): n is a, c, g, or t
tcagactgtacagtcacgaccggtgctcgatttagatctactgacaacacacaagggcactgatttatggtgcaaactaaaaaacactcttggacccctgcccggttctcaggctccctccttgggggcaaagctgccctgacactgtcagatgtgcagcctgaggacgaggctgactaccactgcctgctctcctctggtggtgcttgggtgttcgggcggagggaccaaaacgtgtaccgtccgtgggtcacggcccgaaggcctcgccccctggtcactcttcgttcccgcccttcctcacctgtacagtctggacgcgggtctggcaagggcgcatagnnnnnnnnn

SEQ ID NO: 255181 - DNA, 333 bp, Homo sapiens
  misc_feature: GYAE6OF01BYIJN.25.50.E06.1.454.CMB.1.raw
  modified_base (326)..(333): a, c, t, g, unknown or other
  misc_feature (326)..(333): n is a, c, g, or t
tcagactgtacagtcacgaccggtgctcgatttagatctactgacaacacacaagggcactgatttatggtgcaactaaaaaacactcttggacccctgcccggttctcaggctccctccttgggggcaaagctgccctgacactgtcagatgtgcagcctgaggacgaggctgactaccactgcctgctctcctctggtggtgcttgggtgttcggcggagggaccaaacgtgaccgtcctgggtcagcccaaggctcgccccctggtcactctgttccccacctcctcactcgtacagtctgagcggctggcaaggcgcatagnnnnnnnn

SEQ ID NO: 255182 - DNA, 340 bp, Homo sapiens
  misc_feature: GYAE6OF01DX0SI.25.50.E06.1.454.CMB.1.raw
  modified_base (194)..(194): a, c, t, g, unknown or other
  misc_feature (194)..(194): n is a, c, g, or t
  modified_base (211)..(211): a, c, t, g, unknown or other
  misc_feature (211)..(211): n is a, c, g, or t
  modified_base (330)..(340): a, c, t, g, unknown or other
  misc_feature (330)..(340): n is a, c, g, or t
tcagactgtacagtcacgaccggtgctcgatttagatctactgacaacacacaagggcactgatttatggtgcaaactaaaaaacactcttggacccctgcccggttctcaggctccctcttgggtcaagctgccctgacactgtcagatgtgcagcctgaggacgaggctgactaccactgcctgctctcctntggtggtgcttggggtnttcgggacggagggaccaaactgaccgtccgtgggtcagcccaaggctcgccccctggtccactctcgttccccgcctcctcgactgtacagtctgacgcggctggcgaagcgcatagnnnnnnnnnnn

SEQ ID NO: 255183 - DNA, 327 bp, Homo sapiens
  misc_feature: GYAE6OF01DGQLP.25.50.E06.1.454.CMB.1.raw
  modified_base (322)..(327): a, c, t, g, unknown or other
  misc_feature (322)..(327): n is a, c, g, or t
tcagactgtacagtcacgaccggtgctcgatttagatctactgacaacacacaagggcactgatttatggtgcaactaaaaaacactcttggacccctgcccggttctcaggctccctccttgggggcaaagctgccctgacactgtcagatgtgcagcctgaggacgaggctgactaccactgcctgctctcctctggtggtgcttgggtgttcggcggagggaccaaactgaccgtcctgggtcagcccaaggctgcccctggtcactctgttcccgccctctcactgtacagtctgagcgggctggcaaggcgcatagnnnnnn

SEQ ID NO: 255184 - DNA, 385 bp, Homo sapiens
  misc_feature: GYAE6OF01BAYV9.25.50.E06.1.454.CMB.1.raw
  modified_base (369)..(385): a, c, t, g, unknown or other
  misc_feature (369)..(385): n is a, c, g, or t
tcagactgtacagtcacgaccggtgctcgatttagatctactgacaacacacaagggcactgatttatggtgcaaactaaaaaaacactcttggacccctgcccggttctcaggctccctccttgggggcaaagctgccctgacactgtcagatgtgcagcctgaggacgagctgactaccatcgcctgctctcctcgtgggtggtgtcgttggggtgttcgggcggacgggaccaaacgtcgaccggtccgtgggtcacgcccgaaggcctccggcccccttcggccacttctccggttccccgcccctcctaccacttgtaccgacgttcgtggacggcgggtcgtcggacgaacggctcgaatagnnnnnnnnnnnnnnnnn

SEQ ID NO: 255185 - DNA, 189 bp, Homo sapiens
  misc_feature: GYAE6OF01DACF4.25.50.E06.1.454.CMB.1.raw
  modified_base (180)..(189): a, c, t, g, unknown or other
  misc_feature (180)..(189): n is a, c, g, or t
tcagactgtacagtcacgaccggtgctcgatttagatctactgacaacacacaagggcccatcggtcttcccctggcgccctgctccaggagcacctccgagagcacagccggccctggggctgcctggtcaaggactacttccactgtacagtctgagcgggctggcaaggcgcatagnnnnnnnnnn

SEQ ID NO: 255186 - DNA, 417 bp, Homo sapiens
  misc_feature: GYAE6OF01CU4FC.25.50.E06.1.454.CMB.1.raw
  modified_base (356)..(356): a, c, t, g, unknown or other
  misc_feature (356)..(356): n is a, c, g, or t
  modified_base (359)..(417): a, c, t, g, unknown or other
  misc_feature (359)..(417): n is a, c, g, or t
tcagactgtacagtcacgaccggtgctcgatttagatctactgacaacacacaagggcactgatttatggtgcaaactaaaaaacactcttggacccctgcccggttctcaggcctccctccttgggggcaaagctgccctgacactgtcagatgtgcagcctgaggacgaggctgactaccatgcctgctctcctctggtggtgcgttgggtgtcggcggaggaccaacgtcgaccgtccgtggcacgccgaggcctcgcccccgtcgtctaccgtccgtccgttccccgccccttccgtcacgttgtacgagtcgtggacgtcgggtctggaccgaaggtccgatacgtagctncgnnnnnnnnnnnnnnnnnnnnnnnnnnnnnnnnnnnnnnnnnnnnnnnnnnnnnnnnnnn

SEQ ID NO: 255187 - DNA, 335 bp, Homo sapiens
  misc_feature: GYAE6OF01BCT4C.25.50.E06.1.454.CMB.1.raw
  modified_base (326)..(326): a, c, t, g, unknown or other
  misc_feature (326)..(326): n is a, c, g, or t
  modified_base (329)..(335): a, c, t, g, unknown or other
  misc_feature (329)..(335): n is a, c, g, or t
tcagactgtacagtcacgaccggtgctcgatttagatctactgacaacacacaagggcactgatttatggtgcaaactaaaaaacactcttggacccctgcccggttctcaggctccctccgttggggcaaagctgccctgacactgtcagatgtgcagcctgaggacgaggctagactaccactgcctgctctcctctggtgtgtcgttgggtgttcggcggaggaccaaactcgaccgtccgtgggtcagcccaaggctccgccccctcggtcactcctgtccgccctctcactcgtacagtctgagcggctggcaaggcgcanagnnnnnnn

SEQ ID NO: 255188 - DNA, 388 bp, Homo sapiens
  misc_feature: GYAE6OF01AH2RZ.25.50.E06.1.454.CMB.1.raw
  modified_base (345)..(345): a, c, t, g, unknown or other
  misc_feature (345)..(345): n is a, c, g, or t
  modified_base (351)..(352): a, c, t, g, unknown or other
  misc_feature (351)..(352): n is a, c, g, or t
  modified_base (354)..(355): a, c, t, g, unknown or other
  misc_feature (354)..(355): n is a, c, g, or t
  modified_base (357)..(388): a, c, t, g, unknown or other
  misc_feature (357)..(388): n is a, c, g, or t
tcagactgtacagtcacgaccggtgctcgatttagatctactgacaacacacaagggcactgatttatggtgcaaactaaaaaacactcttggacccctgcccggttctcaggctccctccttgggggcaaagctgaccctgacactgtcagatgtgcagcctggaggacgaggctgacctaccactgcctgctctcctcgtggtggtgtcgttgggtgtcgggacggaggtaccaacgtcgaccgtccgtgggtcacgaccgaggcctccgccccgtcgtcaccgtctccgtccccgccctcctctactgtcagtcctggacggtccggcgtcggacgacggcncgatgnngnncnnnnnnnnnnnnnnnnnnnnnnnnnnnnnnnn

SEQ ID NO: 255189 - DNA, 180 bp, Homo sapiens
  misc_feature: GYAE6OF02JBVKO.25.50.E06.1.454.CMB.1.raw
  modified_base (178)..(180): a, c, t, g, unknown or other
  misc_feature (178)..(180): n is a, c, g, or t
tcagactgtacagtcacgaccggtgctcgatttagatctactgacaacacacaagggcccatcggtcttcccctggcgccctgctccaggagcacctccgagagcacagcggccctgggctgcctggtcaaggactacttccactgtacagtctgagcgggctggcaaggcgcatagnnn

SEQ ID NO: 255190 - DNA, 181 bp, Homo sapiens
  misc_feature: GYAE6OF02ITGOX.25.50.E06.1.454.CMB.1.raw
  modified_base (177)..(181): a, c, t, g, unknown or other
  misc_feature (177)..(181): n is a, c, g, or t
tcagactgtacagtcacgaccggtgctcgatttagatctactgacaacacacaaggcccatcggtcttcccctggcgccctgctccaggagcacctccgagagcacagcggccctgggctgcctggtcaaggactacttccactgtacagtctgagcgggctggcaaggcgcatagnnnnn

SEQ ID NO: 255191 - DNA, 326 bp, Homo sapiens
  misc_feature: GYAE6OF02INPES.25.50.E06.1.454.CMB.1.raw
  modified_base (324)..(326): a, c, t, g, unknown or other
  misc_feature (324)..(326): n is a, c, g, or t
tcagactgtacagtcacgaccggtgctcgatttagatctactgacaacacacaagggcactgatttatggtgcaactaaaaacactcttggacccctgcccggttctcaggctccctccttggggcaaagctgccctgacactgtcagatgtgcagcctgaggacgaggctgactaccactgcctgctctcctctggtggtgcttgggtgttcggcggagggaccaaactgaccgtcctgggtcagcccaaggctgccccctcggtcactctcgttccccgcctcctcactgtacagtctgagcgggctggcaaggcgcatagnnn

SEQ ID NO: 255192 - DNA, 200 bp, Homo sapiens
  misc_feature: GYAE6OF02IZ0C4.25.50.E06.1.454.CMB.1.raw
  modified_base (179)..(200): a, c, t, g, unknown or other
  misc_feature (179)..(200): n is a, c, g, or t
tcagactgtacagtcacgaccggtgctcgatttagatctactgacaacacacaagggcccatcggtcttcccccgtggcaccctcctccaagagcacctctggggcacagcggccctgggctgcctggtcaaggactacttccactgtacagtctgagcgggctggcaaggcgcatagnnnnnnnnnnnnnnnnnnnnnn

SEQ ID NO: 255193 - DNA, 182 bp, Homo sapiens; identical to SEQ ID NO: 255173
  misc_feature: GYAE6OF02G19W0.25.50.E06.1.454.CMB.1.raw
  modified_base (178)..(182): a, c, t, g, unknown or other
  misc_feature (178)..(182): n is a, c, g, or t

SEQ ID NO: 255194 - DNA, 326 bp, Homo sapiens
  misc_feature: GYAE6OF02GWVJ8.25.50.E06.1.454.CMB.1.raw
  modified_base (321)..(326): a, c, t, g, unknown or other
  misc_feature (321)..(326): n is a, c, g, or t
tcagactgtacagtcacgaccggtgctcgatttagatctactgacaacacacaagggcactgatttatggtgcaactaaaaacactcttggacccctgcccggttctcaggctccctccttggggcaaagctgccctgacactgtcagatgtgcagcctgaggacgaggctgactaccactgcctgctctcctctggtggtgcttgggtgttcggcggagggaccaaactgaccgtcctgggtcagcccaaggctgccccctggtcactctgttcccgcctcctcactgtacagtctgagcgggctggcaaggcgcatagnnnnnn

SEQ ID NO: 255195 - DNA, 183 bp, Homo sapiens
  misc_feature: GYAE6OF02JRS01.25.50.E06.1.454.CMB.1.raw
  modified_base (177)..(183): a, c, t, g, unknown or other
  misc_feature (177)..(183): n is a, c, g, or t
tcagactgtacagtcacgaccggtgctcgatttagatctactgacaacacacaaggcccatcggtcttcccctggcgccctgctccaggagcacctccgagagcacagcggccctgggctgcctggtcaaggactacttccactgtacagtctgagcgggctggcaaggcgcatagnnnnnnn

SEQ ID NO: 255196 - DNA, 336 bp, Homo sapiens
  misc_feature: GYAE6OF02J1WK8.25.50.E06.1.454.CMB.1.raw
  modified_base (324)..(336): a, c, t, g, unknown or other
  misc_feature (324)..(336): n is a, c, g, or t
tcagactgtacagtcacgaccggtgctcgatttagatctactgacaacacacaagggcactgatttatggtgcaactaaaaaacactcttggacccctgcccggttctcaggctccctccttgggggcaaagctgccctgacactgtcagatgtgcagcctgaggacgaggctgactaccactgcctgctcttctctggtggtgctttgggtgttcggcggagggaccaaactgaccgtcctgggtcagcccaaggctcgccccctggtcactctgttccccaccctcctcactgtacagtctgagcggctggcagcgcatagnnnnnnnnnnnnn

SEQ ID NO: 255197 - DNA, 329 bp, Homo sapiens
  misc_feature: GYAE6OF02H7KSQ.25.50.E06.1.454.CMB.1.raw
  modified_base (320)..(320): a, c, t, g, unknown or other
  misc_feature (320)..(320): n is a, c, g, or t
  modified_base (326)..(329): a, c, t, g, unknown or other
  misc_feature (326)..(329): n is a, c, g, or t
tcagactgtacagtcacgaccggtgctcgatttagatctactgacaacacacaagggcactgatttatggtgcaactaaaaaacactcttggacccctgcccggttctcaggctccctccttgggggcaaagctgccctgacactgtcagatgtgcagcctgaggacgaggctgactaccactgcctgctctcctctggtggtgcttgggtgttcggcggagggaccaaactgaccgtcctgggtcagcccaaggctcgccccctcggtcacgtctgttcccacctcctcactgtacagtctgagcgggctggcaaggcncatagnnnn

SEQ ID NO: 255198 - DNA, 527 bp, Homo sapiens
  misc_feature: GYAE6OF02JTESF.25.50.E06.1.454.CMB.1.raw
  modified_base (481)..(481): a, c, t, g, unknown or other
  misc_feature (481)..(481): n is a, c, g, or t
  modified_base (486)..(486): a, c, t, g, unknown or other
  misc_feature (486)..(486): n is a, c, g, or t
  modified_base (494)..(494): a, c, t, g, unknown or other
  misc_feature (494)..(494): n is a, c, g, or t
  modified_base (497)..(497): a, c, t, g, unknown or other
  misc_feature (497)..(497): n is a, c, g, or t
  modified_base (499)..(527): a, c, t, g, unknown or other
  misc_feature (499)..(527): n is a, c, g, or t
tcagactgtacagtcacgaccggtgctcgatttagatctactgacaacacacaaggcactgatttatggtgcaactaaaaaacactacttaggaccctgcccggttctcaggctcctccttggggcaaagctgccctgacactgtcagatgtgcagcctgaggacgaggctgactaccactcgcctgctctccctactcgggtggtgtaccgtttggggtcgtttccgggacgggtagggggtaaccctaaacgttggtaaaccccggtcccttaaggggtccaggcccccgtaaaggtccgtccggtaccccccctggggtccaacccttcgttccggttttccccaacccccgtttcctcctaaccgttcggtaacctacgttcccgtggaacgtcccgggggtccttagggcccgtaaaccgggtccgtacccgagtttaacgggcctgtccccgagtcccgagtactcgcgcctggnttcgncttgaacnttncnnnnnnnnnnnnnnnnnnnnnnnnnnnnn

SEQ ID NO: 255199 - DNA, 331 bp, Homo sapiens
  misc_feature: GYAE6OF02FNN68.25.50.E06.1.454.CMB.1.raw
  modified_base (324)..(331): a, c, t, g, unknown or other
  misc_feature (324)..(331): n is a, c, g, or t
tcagactgtacagtcacgaccggtgctcgatttagatctactgacaacacacaagggcactgatttatggtgcaactaaaaaacactcttggacccctgcccggttctcaggctccctccttggggcaaagctgccctgacactgtcagatgtgcagcctgaggacgaggctgactaccactgcctgctctcctctggtggtgcttgggtgttcggcggagggaccaaactgaccgtcctgggtcagcccaaggctgccccctggtcactctgttccccgccctcctcactgtacagtctgagcgggctggcaaggcgcatagnnnnnnnn

SEQ ID NO: 255200 - DNA, 329 bp, Homo sapiens
  misc_feature: GYAE6OF02HVP7M.25.50.E06.1.454.CMB.1.raw
  modified_base (326)..(329): a, c, t, g, unknown or other
  misc_feature (326)..(329): n is a, c, g, or t
tcagactgtacagtcacgaccggtgctcgatttagatctactgacaacacacaagggcactgatttatggtgcaactaaaaaacactcttggacccctgcccggttctcaggctccctccttgggggcaaagctgccctgacactgtcagatgtgcagcctgaggacgaggctgactaccactgcctgctctcctctggtggtgcttgggtgttcggcggagggaccaaactgaccgtcctgggtcagcccaaggctcgccccctcggtcactctgttccccaccctcctcactgtacagtctgagcgggctggcaggcgcatagnnnn

SEQ ID NO: 255201 - DNA, 380 bp, Homo sapiens
  misc_feature: GYAE6OF02JB1TD.25.50.E06.1.454.CMB.1.raw
  modified_base (306)..(306): a, c, t, g, unknown or other
  misc_feature (306)..(306): n is a, c, g, or t
  modified_base (314)..(314): a, c, t, g, unknown or other
  misc_feature (314)..(314): n is a, c, g, or t
  modified_base (352)..(380): a, c, t, g, unknown or other
  misc_feature (352)..(380): n is a, c, g, or t
tcagactgtacagtcacgaccggtgctcgatttagatctactgacaacacacaagggcactgatttatggtgcaaactaaaaaacactcttggacccctgcccggttctcaggcctccctccgttgggggcaaagctgccctgacactgtcagatgtgcagcctgaggacgaggctgactaccatgcctgctctcctcgtggtggtgcgttgggtcgttcgggcggagggaaccaaacgtcgaccgtccgtgggtaccacgacccgaggctccgccccctggtcactctcgttccccacctcctcncgtgtacngtactggagccgggtctggacgtaacggcgacatacgnnnnnnnnnnnnnnnnnnnnnnnnnnnnn

SEQ ID NO: 255202 - DNA, 340 bp, Homo sapiens
  misc_feature: GYAE6OF02GREMC.25.50.E06.1.454.CMB.1.raw
  modified_base (330)..(340): a, c, t, g, unknown or other
  misc_feature (330)..(340): n is a, c, g, or t
tcagactgtacagtcacgaccggtgctcgatttagatctactgacaacacacaagggcactgatttatggtgcaaactaaaaaacactcttggacccctgcccggttctcaggctccctccttggggcaaagctgccctgacactgtcagatgtgcagcctgaggacgaggctgactaccactgcctgctctcctctggtggtgcttgggtgttcgggcggacgggaccaaactggaccgtcctgggtcagcccaaggctcgccccctggtccactctcgttccccacctcctcactgtacagtctgagcgggctggcaaggcgcatagnnnnnnnnnnn

SEQ ID NO: 255203 - DNA, 172 bp, Homo sapiens
  misc_feature: GYAE6OF01C60Y9.37.1.A01.1.454.CMB.1.raw
  modified_base (171)..(172): a, c, t, g, unknown or other
  misc_feature (171)..(172): n is a, c, g, or t
tcagtagtgtagatcacgaccggtgctcgatttagacgtctcatcaagggcccatcggtcttcccctggcgccctgctccaggagcacctccgagagcacagcggccctgggctgcctggtcaaggactacttccatctacactactgagcgggctggcaaggcgcatagnn

SEQ ID NO: 255204 - DNA, 179 bp, Homo sapiens
  misc_feature: GYAE6OF01DX0D6.37.1.A01.1.454.CMB.1.raw
  modified_base (171)..(179): a, c, t, g, unknown or other
  misc_feature (171)..(179): n is a, c, g, or t
tcagtagtgtagatcacgaccggtgctcgatttagacgtctcatcaagggcccatcggtcttcccctggcgccctgctccaggagcacctccgagagcacagcggccctgggctgcctggtcaaggactacttccatctacactactgagcgggctggcaaggcgcatagnnnnnnnnn

SEQ ID NO: 255205 - DNA, 171 bp, Homo sapiens
  misc_feature: GYAE6OF01B0AGK.37.1.A01.1.454.CMB.1.raw
  modified_base (171)..(171): a, c, t, g, unknown or other
  misc_feature (171)..(171): n is a, c, g, or t
tcagtagtgtagatcacgaccggtgctcgatttagacgtctcatcaagggcccatcggtcttcccctggcgccctgctccaggagcacctccgagagcacagcggccctgggctgcctggtcaaggactacttccatctacactactgagcgggctggcaaggcgcatagn

SEQ ID NO: 255206 - DNA, 177 bp, Homo sapiens
  misc_feature: GYAE6OF01DAENM.37.1.A01.1.454.CMB.1.raw
  modified_base (171)..(177): a, c, t, g, unknown or other
  misc_feature (171)..(177): n is a, c, g, or t
tcagtagtgtagatcacgaccggtgctcgatttagacgtctcatcaagggcccatcggtcttcccctggcgccctgctccaggagcacctccgagagcacagcggccctgggctgcctggtcaaggactacttccatctacactactgagcgggctggcaaggcgcatagnnnnnnn

SEQ ID NO: 255207 - DNA, 606 bp, Homo sapiens
  misc_feature: GYAE6OF01CMRAY.37.1.A01.1.454.CMB.1.raw
  modified_base (391)..(391): a, c, t, g, unknown or other
  misc_feature (391)..(391): n is a, c, g, or t
  modified_base (556)..(556): a, c, t, g, unknown or other
  misc_feature (556)..(556): n is a, c, g, or t
  modified_base (563)..(563): a, c, t, g, unknown or other
  misc_feature (563)..(563): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
  modified_base (573)..(573): a, c, t, g, unknown or other
  misc_feature (573)..(573): n is a, c, g, or t
  modified_base (575)..(576): a, c, t, g, unknown or other
  misc_feature (575)..(576): n is a, c, g, or t
  modified_base (579)..(579): a, c, t, g, unknown or other
  misc_feature (579)..(579): n is a, c, g, or t
  modified_base (583)..(583): a, c, t, g, unknown or other
  misc_feature (583)..(583): n is a, c, g, or t
  modified_base (589)..(589): a, c, t, g, unknown or other
  misc_feature (589)..(589): n is a, c, g, or t
  modified_base (594)..(606): a, c, t, g, unknown or other
  misc_feature (594)..(606): n is a, c, g, or t
tcagtagtgtagatcacgaccggtgctcgatttagacgtctcatcaagggaaggaagggacctggagtgggtctcaggtattggtggcagtggtgagaccacgactacgtacgcaggactccgtgaagggccggttcaccatcgtccagagacaaattccaaggaacaccctgtctctgcaaatgaacaacctgagagccggagacaccggaccctatattactgtacgaaaatggacctaggatatgacgtactattgggactggtacttcgatctcgtggggccgtggccacctggtccactgtcctcctcacgccgtccaaccgaaggggccccaagtccgggttcctttcccccgtgggcccgtcccctggccttccgaacgggacnccgtaccctccggagaacgcaacgacggccggcccgtggggccttggccgttgggtaccaaacgggtaccttaccgtttacccgaacttccgttaaccaaccttaacgttaggaacgggtccggggacctacggggaccctaaacgggccgacgtaacttacggntcgtccncncncnctcncnncgngcgngcgcgngcgcnnnnnnnnnnnnn

SEQ ID NO: 255208 - DNA, 172 bp, Homo sapiens; identical to SEQ ID NO: 255203
  misc_feature: GYAE6OF01AV91W.37.1.A01.1.454.CMB.1.raw
  modified_base (171)..(172): a, c, t, g, unknown or other
  misc_feature (171)..(172): n is a, c, g, or t

SEQ ID NO: 255209 - DNA, 180 bp, Homo sapiens
  misc_feature: GYAE6OF01DT6N0.37.1.A01.1.454.CMB.1.raw
  modified_base (170)..(180): a, c, t, g, unknown or other
  misc_feature (170)..(180): n is a, c, g, or t
tcagtagtgtagatcacgaccggtgctcgatttagacgtctcatcagggcccatcggtcttcccctggcgccctgctccaggagcacctccgagagcacagcggccctgggctgcctggtcaaggactacttccatctacactactgagcgggctggcaaggcgcatagnnnnnnnnnnn

SEQ ID NO: 255210 - DNA, 177 bp, Homo sapiens
  misc_feature: GYAE6OF01C20MF.37.1.A01.1.454.CMB.1.raw
  modified_base (171)..(177): a, c, t, g, unknown or other
  misc_feature (171)..(177): n is a, c, g, or t
tcagtagtgtagatcacgaccggtgctcgatttagacgtctcatcgagggcccatcggtcttcccctggcgccctgctccaggagcacctccgagagcacagcggccctgggctgcctggtcaaggactacttccatctacactactgagcgggctggcaaggcgcatagnnnnnnn

SEQ ID NO: 255211 - DNA, 381 bp, Homo sapiens
  misc_feature: GYAE6OF01D94C5.37.1.A01.1.454.CMB.1.raw
  modified_base (351)..(351): a, c, t, g, unknown or other
  misc_feature (351)..(351): n is a, c, g, or t
  modified_base (373)..(381): a, c, t, g, unknown or other
  misc_feature (373)..(381): n is a, c, g, or t
tcagtagtgtagatcacgaccggtgctcgatttagacgtctcatcagggccaatcagagtgttaatagtaacttagcctggtaccagcagaaacctgcccaggctcccaggctcctcatgtatggtgcatccaccagggccactggtatcccagccaggttcagtggcagtgggactgggacagagttcagtctaaccatcagcagcctgcagtctgaagtattttggagttttatttctgtcagcagtatagttcctggcctcggacgttcggcccagggaccaaggtggaaatcaaacgactgtggctgcaccatctgtctcatctccgcatctgaatctacactacgngcggctggacaaggcgcatagnnnnnnnnn

SEQ ID NO: 255212 - DNA, 183 bp, Homo sapiens
  misc_feature: GYAE6OF01CTAWF.37.1.A01.1.454.CMB.1.raw
  modified_base (171)..(183): a, c, t, g, unknown or other
  misc_feature (171)..(183): n is a, c, g, or t
tcagtagtgtagatcacgaccggtgctcgatttagacgtctcatcaagggcccatcggtcttcccctggcgccctgctccaggagcacctccgagagcacagcggccctgggctgcctggtcaaggactacttccatctacactactgagcgggctggcaaggcgcatagnnnnnnnnnnnnn

SEQ ID NO: 255213 - DNA, 480 bp, Homo sapiens
  misc_feature: GYAE6OF01D18WV.37.1.A01.1.454.CMB.1.raw
  modified_base (346)..(346): a, c, t, g, unknown or other
  misc_feature (346)..(346): n is a, c, g, or t
  modified_base (453)..(480): a, c, t, g, unknown or other
  misc_feature (453)..(480): n is a, c, g, or t
tcagtagtgtagatcacgaccggtgctcgatttagacgtctcatcaagggaagggaagggactggaggtgggtctcacggtattggtggcagtggtgagtaccacatactacgcagactccgtgaagggccggttcaccatctccagagacaattccaagaacaccctgtctctgtcaaatgtaaacaacctgagagccgaggacacggccctatattactgtacgaaaagtggccttacgggatatgactactattgggactggtacttcgatcgtctggggcctggcaccctggtcactgtctcctcagcctccacaagggcccagtcggtcttcccctggccnccctgctccgaggacgcacctccgagagcacgagcggcctgggctgcctggtcaaggctacttccatcgtacacgtactgacgcgggctgggcaaggcgctatagcnnnnnnnnnnnnnnnnnnnnnnnnnnnn

SEQ ID NO: 255214 - DNA, 220 bp, Homo sapiens
  misc_feature: GYAE6OF01A84UR.37.1.A01.1.454.CMB.1.raw
  modified_base (172)..(220): a, c, t, g, unknown or other
  misc_feature (172)..(220): n is a, c, g, or t
tcagtagtgtagatcacgaccggtgctcgatttagacgtctcatcaagggcccatcggtcttcccctggcgccctgctccaggagcacctccgagagcacagcggccctgggctgcctggtcaagggactacttccatctacactactgagcgggctggcaaggcgcatagnnnnnnnnnnnnnnnnnnnnnnnnnnnnnnnnnnnnnnnnnnnnnnnnn

SEQ ID NO: 255215 - DNA, 516 bp, Homo sapiens
  misc_feature: GYAE6OF01CO2GR.37.1.A01.1.454.CMB.1.raw
  modified_base (223)..(223): a, c, t, g, unknown or other
  misc_feature (223)..(223): n is a, c, g, or t
  modified_base (352)..(352): a, c, t, g, unknown or other
  misc_feature (352)..(352): n is a, c, g, or t
  modified_base (487)..(516): a, c, t, g, unknown or other
  misc_feature (487)..(516): n is a, c, g, or t
tcagtagtgtagatcacgaccggtgctcgatttagacgtctcatcaagggtaagggaagggacgtggaggtgggtctcaggtatttgggtggccagtggtgagaccacatactacgcagactccgtgaagggccggttcaccatctccagagtacgaattccaagaacacccttgtctctgctaaatgaacaactgagagccgagacacggcctatattacgngtacgaaaatcggacctacgggactatgactactattgggactggtacttcgatcgtctggggccgtggccaccgtggtcacgtgtctcctcaggccctccacgaacgggccacgtcggtccttccccnggcgccctgcctaccgaaggacaccaccgtacgagacgcacgagtccggccctggggcctggccgtgggacaagggcttaacgttccattacctactactaacgtggaacgcgggctgggcaaagggcagactgnnnnnnnnnnnnnnnnnnnnnnnnnnnnnn

SEQ ID NO: 255216 - DNA, 386 bp, Homo sapiens
  misc_feature: GYAE6OF01DNOVQ.37.1.A01.1.454.CMB.1.raw
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
  modified_base (371)..(371): a, c, t, g, unknown or other
  misc_feature (371)..(371): n is a, c, g, or t
  modified_base (377)..(386): a, c, t, g, unknown or other
  misc_feature (377)..(386): n is a, c, g, or t
tcagtagtgtagatcacgaccggtgctcgatttagacgtctcatcagggccaatcagagtgttaatagtaacttagcctggtaccagcagaaacctgcccaggctcccaggctcctcatgtatggtgcatccaccagggccactggtatcccagccaggttcagtggcagtgggactgggacagagttcagtctaaaccatcagcagcctgcagtctgaagattttggattttatttctgtcagcagtatagttcctggcctcggacgttcggcccagggaccaaggtggaaatcaaaacgactgtggctgcaccatctgtctcatcttcccgcatctgaatctanactactgagcgggntggacaaggcncatagnnnnnnnnnn

SEQ ID NO: 255217 - DNA, 188 bp, Homo sapiens
  misc_feature: GYAE6OF01EM4UY.37.1.A01.1.454.CMB.1.raw
  modified_base (172)..(188): a, c, t, g, unknown or other
  misc_feature (172)..(188): n is a, c, g, or t
tcagtagtgtagatcacgaccggtgctcgatttagacgtctcatcagggcccatcggtcttcccctggcgccctgctccaggagcacctccgagagcacagcggccctgggctgcctggtcaaggactacttccatctacacgtactgagcgggcttggcaaggcgcatagnnnnnnnnnnnnnnnnn

SEQ ID NO: 255218 - DNA, 520 bp, Homo sapiens
  misc_feature: GYAE6OF01D8SBB.37.1.A01.1.454.CMB.1.raw
  modified_base (487)..(488): a, c, t, g, unknown or other
  misc_feature (487)..(488): n is a, c, g, or t
  modified_base (490)..(520): a, c, t, g, unknown or other
  misc_feature (490)..(520): n is a, c, g, or t
tcagtagtgtagatcacgaccggtgctcgatttagacgtctcatcaaggaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgagagactcagacggagtatagcagcagctctgactacgtggggccacggaaccctggtcaccgtctcctcacgcctccaccaacgggcccagtccggtccttccccctggccctacccctccctaccaaagacgcctacccgtcgtacgggggccaacgacggccggcccgtgggctcggccgtcgggtacaacggtacctaccttccacttacctaacacttacgtggacggcgggtctcgggactaacgggccactagttagctgnngnnnnnnnnnnnnnnnnnnnnnnnnnnnnnnn

SEQ ID NO: 255219 - DNA, 447 bp, Homo sapiens
  misc_feature: GYAE6OF01CRC26.37.1.A01.1.454.CMB.1.raw
  modified_base (442)..(447): a, c, t, g, unknown or other
  misc_feature (442)..(447): n is a, c, g, or t
tcagtagtgtagatcacgaccggtgctcgatttagacgtctcatcaaggaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtgcacctggtcactgtctcctcagcctccaccaagggcccatccggtccttccccctggccgcccctgcctccaggacgccacctccgagacgcacagccggcctgggctgcctggtcaaggactacttccatctacactactgagcgggctggcaaggcgcatagnnnnnn

SEQ ID NO: 255220 - DNA, 382 bp, Homo sapiens
  misc_feature: GYAE6OF01DPL0C.37.1.A01.1.454.CMB.1.raw
  modified_base (373)..(373): a, c, t, g, unknown or other
  misc_feature (373)..(373): n is a, c, g, or t
  modified_base (379)..(382): a, c, t, g, unknown or other
  misc_feature (379)..(382): n is a, c, g, or t
tcagtagtgtagatcacgaccggtgctcgatttagacgtctcatcagggccaatcagagtgttaatagtaacttagcctggtaccagcagaaacctgcccaggctcccaggctcctcatgtatggtgcatccaccagggccactggtatcccagccaggttcagtggcagtgggactgggacagagttcagtctaaccatcagcagcctgcagtctgaagtattttggagttttatttctgtcagcagtatagttcctggcctcggacgttcggcccagggaccaaggtggaaatcaaaacgaactgtggctgcaccatctgtcttcatcttcccgcatctgaatctacactactgagcgggctggcaaggcncatagnnnn

SEQ ID NO: 255221 - DNA, 173 bp, Homo sapiens
  misc_feature: GYAE6OF01BZ9X1.37.1.A01.1.454.CMB.1.raw
  modified_base (171)..(173): a, c, t, g, unknown or other
  misc_feature (171)..(173): n is a, c, g, or t
tcagtagtgtagatcacgaccggtgctcgatttagacgtctcatcaagggcccatcggtcttcccctggcgccctgctccaggagcacctccgagagcacagcggccctgggctgcctggtcaaggactacttccatctacactactgagcgggctggcaaggcgcatagnnn

SEQ ID NO: 255222 - DNA, 676 bp, Homo sapiens
  misc_feature: GYAE6OF01C5U7S.37.1.A01.1.454.CMB.1.raw
  modified_base (188)..(188): a, c, t, g, unknown or other
  misc_feature (188)..(188): n is a, c, g, or t
  modified_base (327)..(327): a, c, t, g, unknown or other
  misc_feature (327)..(327): n is a, c, g, or t
tcagtagtgtagatcacgaccggtgctcgatttagacgtctcatcaaggaagggaagggactggagtgggtctcaggtattggtggcagtggtgagaccacatactacgcagactccgtgaaggccggttcaccatctccagagacaattccaagaacaccctgtctctgcaatgaacaacctgaganccgaggacacggccctagtattactgtgtgaagggacctctagccccttatagcagcggctggtcctggtactttgacgactgggcaggaccctgtcacgtctctcagcctccaccaagggcccatccggtctccccgnggccgccctgcctccgaggacgcctacctccggagacgccaacgacgccggaccctgggccttcgccgttggtaccaaacgggtaccttacgttcccaagttccctaacgtaccgttacgtcggtaacggtccggggtacctcggggacccgtaaacgggtcccgtaaccgtaacgttaccggcgtacgtaccgtacggtaccgtaacgttacgtccggtacgtaccgtacgttaccgacgttaccgtaacgtccgtacgtaccggaaccggtttcgaaccggttaccgtttaaaccgcgaaccgtttaccgcggttaccgtaaccgtcgtttaaccgaccgttaccgg

SEQ ID NO: 255223 - DNA, 171 bp, Homo sapiens; identical to SEQ ID NO: 255205
  misc_feature: GYAE6OF01AKGKL.37.1.A01.1.454.CMB.1.raw
  modified_base (171)..(171): a, c, t, g, unknown or other
  misc_feature (171)..(171): n is a, c, g, or t

SEQ ID NO: 255224 - DNA, 511 bp, Homo sapiens
  misc_feature: GYAE6OF01C1KGP.37.1.A01.1.454.CMB.1.raw
  modified_base (357)..(357): a, c, t, g, unknown or other
  misc_feature (357)..(357): n is a, c, g, or t
  modified_base (476)..(476): a, c, t, g, unknown or other
  misc_feature (476)..(476): n is a, c, g, or t
  modified_base (483)..(511): a, c, t, g, unknown or other
  misc_feature (483)..(511): n is a, c, g, or t
tcagtagtgtagatcacgaccggtgctcgatttagacgtctcatcaagggaaggaagggactggagtgggtctcaggtattggtggcagtggtgagaccacatactacgcagactcccgtgaagggccggttcaccatctccagagacaattccaagaaccaccctgtctctgcaaatgaacaacctgagagccgaggacacggccctatattactgtacgaaaatggcctacggatatgactactattgggactggtacttcgatctcgtggggccgtggccaccctggtcactgtctcctcagcctccacgagggcccatccggtccttcccctggccgtccctgctccaggacnccaccgtccgagagcacgacggccggccctggggcctcggcccgttgggtaccaaggtacctaccgttcccagttcctaaccacttaccgtgacggtcgggctaggggactaagggccncaatagnnnnnnnnnnnnnnnnnnnnnnnnnnnnn

SEQ ID NO: 255225 - DNA, 399 bp, Homo sapiens
  misc_feature: GYAE6OF01CHLO4.37.1.A01.1.454.CMB.1.raw
  modified_base (239)..(239): a, c, t, g, unknown or other
  misc_feature (239)..(239): n is a, c, g, or t
  modified_base (318)..(318): a, c, t, g, unknown or other
  misc_feature (318)..(318): n is a, c, g, or t
  modified_base (327)..(327): a, c, t, g, unknown or other
  misc_feature (327)..(327): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (376)..(376): a, c, t, g, unknown or other
  misc_feature (376)..(376): n is a, c, g, or t
  modified_base (381)..(399): a, c, t, g, unknown or other
  misc_feature (381)..(399): n is a, c, g, or t
tcagtagtgtagatcacgaccggtgctcgatttagacgtctcatcagggccaatcagagtgttaatagtaacttagcctggtaccagcagaaacctgcccaggctcccaggctcctcatgtatggtgcatccaccagggccactggtatcccagccaggttcagtggcagtgggactgggacagagttcagtctaaccatcagcagcctgcagtctgaagtatttttggattttattcngtcagcagttatagttccctggcctcggacgttcggcccaagggaccaaggtggaaatcaaacgactgtggctgccacntctgtcttnatccttcccgcatctgaactctacnctacnggagcggctggcaaggcanatagnnnnnnnnnnnnnnnnnnn

SEQ ID NO: 255226 - DNA, 561 bp, Homo sapiens
  misc_feature: GYAE6OF01EW4YA.37.1.A01.1.454.CMB.1.raw
  modified_base (304)..(304): a, c, t, g, unknown or other
  misc_feature (304)..(304): n is a, c, g, or t
  modified_base (362)..(362): a, c, t, g, unknown or other
  misc_feature (362)..(362): n is a, c, g, or t
  modified_base (525)..(525): a, c, t, g, unknown or other
  misc_feature (525)..(525): n is a, c, g, or t
  modified_base (528)..(528): a, c, t, g, unknown or other
  misc_feature (528)..(528): n is a, c, g, or t
  modified_base (532)..(532): a, c, t, g, unknown or other
  misc_feature (532)..(532): n is a, c, g, or t
  modified_base (536)..(537): a, c, t, g, unknown or other
  misc_feature (536)..(537): n is a, c, g, or t
  modified_base (539)..(557): a, c, t, g, unknown or other
  misc_feature (539)..(557): n is a, c, g, or t
  modified_base (559)..(561): a, c, t, g, unknown or other
  misc_feature (559)..(561): n is a, c, g, or t
tcagtagtgtagatcacgaccggtgctcgatttagacgtctcatcaagggaagggaagggactggagtgggtctcaggtattggtggcagtggtgagaccacatactacgcagactccgtgaagggccggttcaccatctccagagacaattccaaagaacacccttgtctctgcaaatgaacaacctgagagccgaggacacggcctatattactgtacgaaaatggcctacggatatgactactagttgggactggtacttcgatctctggggccgtggcaccctggtcaactgtctcctcngcctccgaccaagggcccatccggtccttcccccgtggccgcccgtgctccgaggacnccacctccgagacgcacgagccggtcccgtgggtcctcggccgtggtacccaaagggtaccttaccgtttacccaacttaccgtaacctaccgttaacgtcggaacgggaccggggaccgttacgggaccggtaaacgggtccgacctaaagttacggatcgnaancgancgcnngnnnnnnnnnnnnnnnnnnngnnn

SEQ ID NO: 255227 - DNA, 560 bp, Homo sapiens
  misc_feature: GYAE6OF01BFO18.37.1.A01.1.454.CMB.1.raw
  modified_base (258)..(258): a, c, t, g, unknown or other
  misc_feature (258)..(258): n is a, c, g, or t
  modified_base (316)..(316): a, c, t, g, unknown or other
  misc_feature (316)..(316): n is a, c, g, or t
  modified_base (325)..(325): a, c, t, g, unknown or other
  misc_feature (325)..(325): n is a, c, g, or t
  modified_base (536)..(560): a, c, t, g, unknown or other
  misc_feature (536)..(560): n is a, c, g, or t
tcagtagtgtagatcacgaccggtgctcgatttagacgtctcatcaaggaagggaaggggactgggagtggggtctcaggtattgggtggcagtgggtgagaccacatactacgcagactcccgttcggaaggggacccgggttccgtaccaactcttcccacgaaggacaattaccaagaaacaaccctcgtctcctgcaaatagaacaaacctgaggagccgaggacgaccggccctactattactgtacgaaaanaggctacgatatgactactatgggacgtggtacttcgatctcgtggggccggtcggcnccctcggtnactgtctcctcacgcctcccaccaaggggccccactcggtcccttccccctcggccgccctcgctccaggagccacccgtccgagagccaccgacggccggcccgtggggctcgtccgtcgggtacaacggaccgtacctttcccgatacctaactacccttagtcggtaagggccgggtcggtagggaccgaaacgggcgtacgatacgnnnnnnnnnnnnnnnnnnnnnnnnn

SEQ ID NO: 255228 - DNA, 174 bp, Homo sapiens
  misc_feature: GYAE6OF01AGHQL.37.1.A01.1.454.CMB.1.raw
  modified_base (172)..(174): a, c, t, g, unknown or other
  misc_feature (172)..(174): n is a, c, g, or t
tcagtagtgtagatcacgaccggtgctcgatttagacgtctcatcaagggcccatcggtcttccccctggcgccctgctccaggagcacctccgagagcacagcggccctgggctgcctggtcaaggactacttccatctacactactgagcgggctggcaaggcgcatagnnn

SEQ ID NO: 255229 - DNA, 231 bp, Homo sapiens
  misc_feature: GYAE6OF01C1J2M.37.1.A01.1.454.CMB.1.raw
  modified_base (180)..(231): a, c, t, g, unknown or other
  misc_feature (180)..(231): n is a, c, g, or t
tcagtagtgtagatcacgaccggtgctcgatttagacgtctcatcaaggggtcccgatcggtcttccccctggccgccctgctccaggagcacctccgagagcacgacgcggccctgggctgccgtggtcaaggactacttccatctacactactgagcgggctggacaaggcgcatagnnnnnnnnnnnnnnnnnnnnnnnnnnnnnnnnnnnnnnnnnnnnnnnnnnnn

SEQ ID NO: 255230 - DNA, 406 bp, Homo sapiens
  misc_feature: GYAE6OF01A577H.37.1.A01.1.454.CMB.1.raw
  modified_base (392)..(392): a, c, t, g, unknown or other
  misc_feature (392)..(392): n is a, c, g, or t
  modified_base (397)..(406): a, c, t, g, unknown or other
  misc_feature (397)..(406): n is a, c, g, or t
tcagtagtgtagatcacgaccggtgctcgatttagacgtctcatcagggccaatcagagtgttaatagtaacttagcctggtaccagcagaaacctgcccaggctcccaggctcctcatgtatggtgcatccaccagggccactggtatcccagccaggttcagtggcagtgggactgggacagagttcagtctaaccatcagcagcctgcagtctagaagtattttggagttttatttctgtcagcagttatagttcctggcctcggacgttccggcccaaggggaccaagggtacgaaatcgaaacgactggtggctgcaccatctgtcttcattccttcccgctatctagtaactctaactactacgtgacgcgggctggacgaggcanatagnnnnnnnnnn

SEQ ID NO: 255231 - DNA, 487 bp, Homo sapiens
  misc_feature: GYAE6OF01CLHQ0.37.1.A01.1.454.CMB.1.raw
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (359)..(359): a, c, t, g, unknown or other
  misc_feature (359)..(359): n is a, c, g, or t
  modified_base (378)..(378): a, c, t, g, unknown or other
  misc_feature (378)..(378): n is a, c, g, or t
  modified_base (426)..(426): a, c, t, g, unknown or other
  misc_feature (426)..(426): n is a, c, g, or t
  modified_base (441)..(441): a, c, t, g, unknown or other
  misc_feature (441)..(441): n is a, c, g, or t
  modified_base (462)..(487): a, c, t, g, unknown or other
  misc_feature (462)..(487): n is a, c, g, or t
tcagtagtgtagatcacgaccggtgctcgatttagacgtctcatcaaggaagggaagggactggagtgggtctcaggtattggtggcagtggtgagaccacatactacgcagactccgtgaagggccggttcaccatctccagagacaattccaagaacaccctgtctctgacaatgaacaacctgagagccgagacacggcctatatactgtaacgaaaatggacctaggatatgactactagttggactggtacttcgatctcgtggggcctggcacctggtcactgtctcctcacgcctaccaacgacgggccctagtccggtcccttccccgnggccnccctgcctccgaggacnccaccgtcgagcgaccacncggccggccctgggctacgcgtggtacaagtcttacttcatcctaacnctacgcgaggccggntcgggacaaggccagatacgnnnnnnnnnnnnnnnnnnnnnnnnnn

SEQ ID NO: 255232 - DNA, 633 bp, Homo sapiens
  misc_feature: GYAE6OF01EV9MH.37.1.A01.1.454.CMB.1.raw
  modified_base (212)..(212): a, c, t, g, unknown or other
  misc_feature (212)..(212): n is a, c, g, or t
  modified_base (407)..(407): a, c, t, g, unknown or other
  misc_feature (407)..(407): n is a, c, g, or t
  modified_base (435)..(435): a, c, t, g, unknown or other
  misc_feature (435)..(435): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (596)..(596): a, c, t, g, unknown or other
  misc_feature (596)..(596): n is a, c, g, or t
  modified_base (598)..(599): a, c, t, g, unknown or other
  misc_feature (598)..(599): n is a, c, g, or t
  modified_base (602)..(602): a, c, t, g, unknown or other
  misc_feature (602)..(602): n is a, c, g, or t
  modified_base (605)..(605): a, c, t, g, unknown or other
  misc_feature (605)..(605): n is a, c, g, or t
  modified_base (607)..(607): a, c, t, g, unknown or other
  misc_feature (607)..(607): n is a, c, g, or t
  modified_base (609)..(609): a, c, t, g, unknown or other
  misc_feature (609)..(609): n is a, c, g, or t
  modified_base (611)..(611): a, c, t, g, unknown or other
  misc_feature (611)..(611): n is a, c, g, or t
  modified_base (613)..(614): a, c, t, g, unknown or other
  misc_feature (613)..(614): n is a, c, g, or t
  modified_base (616)..(619): a, c, t, g, unknown or other
  misc_feature (616)..(619): n is a, c, g, or t
  modified_base (621)..(621): a, c, t, g, unknown or other
  misc_feature (621)..(621): n is a, c, g, or t
  modified_base (623)..(624): a, c, t, g, unknown or other
  misc_feature (623)..(624): n is a, c, g, or t
  modified_base (626)..(626): a, c, t, g, unknown or other
  misc_feature (626)..(626): n is a, c, g, or t
  modified_base (628)..(633): a, c, t, g, unknown or other
  misc_feature (628)..(633): n is a, c, g, or t
tcagtagtgtagatcacgaccggtgctcgatttagacgtctcatcaaggaaggaacgggactggagtgggtctcaggtattggtggcagtggtgaggaccacgatacgtacgcagactccggtaggaacgggtccggttccaccactctccagagactaactccaacgaaccacctgtctctcgacaatgaaccaactgagacgcgaggacnccggcctatacttactacgtaaacgaaaagtcggtaccgtaacggtatactagacttaacttaggttcgggtacgttcggttacttacgtattctcggtcggggtccggtgggacctaccgttcggtcctacgttcggtcctccttcgacgtcctaccgaacggtaaccgggcctagttccggtcccttccccgnggtccgccttacgcctaccggacggacnccgtaccgtccgagcgccacgacggcccggtccggtcggggcctcggtccgtacggtacgaacggtaacctttacgttacctacttaccgtaacaaccgttacgtacggacgggtccggggtctcgggacgaacggtcgacgagtacggcagngntcagtncnncgnacncncncncnncnnnncncnncncnnnnnn

SEQ ID NO: 255233 - DNA, 551 bp, Homo sapiens
  misc_feature: GYAE6OF01C1WNU.37.1.A01.1.454.CMB.1.raw
  modified_base (356)..(356): a, c, t, g, unknown or other
  misc_feature (356)..(356): n is a, c, g, or t
  modified_base (522)..(522): a, c, t, g, unknown or other
  misc_feature (522)..(522): n is a, c, g, or t
  modified_base (524)..(551): a, c, t, g, unknown or other
  misc_feature (524)..(551): n is a, c, g, or t
tcagtagtgtagatcacgaccggtgctcgatttagacgtctcatcaagggaaggaagggactggagtgggtctcaggtattggtggcagtggtgataccacatactacgcagactccgtgaagggccggttcaccatctccagggacaattccaagaacacactgtctctgcaaatgaacagcctgagagtcgaggacacggcttatattactgtgtgaagggacctctacgccccttatagcagcggatggtcctggttacttttgacgacgtggggccagggaaccctggtccaccggtcctcctcagcccctaccaccgaacgggcccagtccggtcccttcccctcgggccncccctcgccgtccgaggacgccaccgtccgagacgccacgacggcccggcccgtcggggtctacgccgttcgggtaccaaacgggtaccttaaccgttcccaagttcctaacctacgtaacttgggacggtacggggctacgggacgaacgggccacgtataggcngnnnnnnnnnnnnnnnnnnnnnnnnnnnn

SEQ ID NO: 255234 - DNA, 523 bp, Homo sapiens
  misc_feature: GYAE6OF01EI22N.37.1.A01.1.454.CMB.1.raw
  modified_base (214)..(214): a, c, t, g, unknown or other
  misc_feature (214)..(214): n is a, c, g, or t
  modified_base (495)..(495): a, c, t, g, unknown or other
  misc_feature (495)..(495): n is a, c, g, or t
  modified_base (497)..(523): a, c, t, g, unknown or other
  misc_feature (497)..(523): n is a, c, g, or t
tcagtagtgtagatcacgaccggtgctcgatttagacgtctcatcaaggaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattacngtacgaaaatggcctacggatatgactactagttgggactgtacttcgatctctgggcgtggcaccctggtcactgtctcctcacgcctccaccgaacgggcccagtccggtcttcccccgtggccgccctgcctccgagagcccaccgtccgagacgcaccgacggcccggcccgtggggcctcggtccgtcgggtacgaacgggtaaccttacctttacccagttacctaacaccgttacgtggacggtccgggcttgggaccaaggtccgacatagcngnnnnnnnnnnnnnnnnnnnnnnnnnnn

SEQ ID NO: 255235 - DNA, 525 bp, Homo sapiens
  misc_feature: GYAE6OF01DZ4ZC.37.1.A01.1.454.CMB.1.raw
  modified_base (347)..(347): a, c, t, g, unknown or other
  misc_feature (347)..(347): n is a, c, g, or t
  modified_base (390)..(390): a, c, t, g, unknown or other
  misc_feature (390)..(390): n is a, c, g, or t
  modified_base (499)..(515): a, c, t, g, unknown or other
  misc_feature (499)..(515): n is a, c, g, or t
  modified_base (517)..(525): a, c, t, g, unknown or other
  misc_feature (517)..(525): n is a, c, g, or t
tcagtagtgtagatcacgaccggtgctcgatttagacgtctcatcaagggaagggaagggactggagtgggtctcaggtattggtggcagtggtgagaccacatactacgcagactccgtgaagggccggttcaccatctccagagacaattccaagaaccaccctgtctctgcaaatgaaacaacctgagagccgaggaccacggccctaatacttactgtacgaaaatcggacctacggatatgactactattgggactggtacttcgatctctggggcctggccaccctggcactgtctcctcacgccctccaccaacgggcccagttccggtccttcccccgnggccgtcccctgcctccgaggacgccacctccgagacgcaacncgccggcccgtgggcctacgcctgggtacaacgtccttacttcccattcctacaaccgttacgtcggaacggtccggggtctgggacctaaagggccctacgatggacnnnnnnnnnnnnnnnnngnnnnnnnnn

SEQ ID NO: 255236 - DNA, 555 bp, Homo sapiens
  misc_feature: GYAE6OF01AUC5L.37.1.A01.1.454.CMB.1.raw
  modified_base (528)..(528): a, c, t, g, unknown or other
  misc_feature (528)..(528): n is a, c, g, or t
  modified_base (531)..(555): a, c, t, g, unknown or other
  misc_feature (531)..(555): n is a, c, g, or t
tcagtagtgtagatcacgaccggtgctcgatttagacgtctcatcaaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggcctacggaatatgactactagtgggactggtacttcgatcgtcgtggggccgtgccacccgtggtcactgtcctcctcacgccctccaccgacgggccctagtcggtccctccccgtcggccgccctggctccgaggaccgccacccgtccgagacgccacgacgggccggcccgtacggggtcctacggtccccgtgggtacccgtaacgggtacccttaaccggttccaacgttcctaacctaccttaaccgtggacgggtccggggtctacgggtaccgaacgggcaccgtagtagcngcnnnnnnnnnnnnnnnnnnnnnnnnn

SEQ ID NO: 255237 - DNA, 609 bp, Homo sapiens
  misc_feature: GYAE6OF01CET2M.37.1.A01.1.454.CMB.1.raw
  modified_base (582)..(583): a, c, t, g, unknown or other
  misc_feature (582)..(583): n is a, c, g, or t
  modified_base (585)..(609): a, c, t, g, unknown or other
  misc_feature (585)..(609): n is a, c, g, or t
tcagtagtgtagatcacgaccggtgctcgatttagacgtctcatcaaggaagggaagggactggagtggggtctcaggtattggtgggcagtggtgagaccacatactacgcagactccgtgaagggccggttcaccatctccagagacaattccaaagaacaccctgtctctgcaaatgaacaacctgagagccgaggacacggccctatattactagtaacgaaaagtcggacctacggatatagacctactagttgggacttggttacttcgatctacgtgggggccgtggccacccgtggtcctactgtcctcctcacgtccctccaaccgacgggccctacgttcggtccccttccccgtgggcccgtacccctggtccctccgaacggacgtcccgacccgtaccggaagacggcccaacgacgggtacccgggtcccgttcggggacccgttcggtcccggttcgggtaacctaaccgggtaccctttaccgttacccaccttacctacgtaaccttaccggtggaaccgggcgggtaccgttacggggcctaaagggcccaagtataggatcgnnannnnnnnnnnnnnnnnnnnnnnnnn

SEQ ID NO: 255238 - DNA, 565 bp, Homo sapiens
  misc_feature: GYAE6OF01EJY2G.37.1.A01.1.454.CMB.1.raw
  modified_base (534)..(536): a, c, t, g, unknown or other
  misc_feature (534)..(536): n is a, c, g, or t
  modified_base (538)..(565): a, c, t, g, unknown or other
  misc_feature (538)..(565): n is a, c, g, or t
tcagtagtgtagatcacgaccggtgctcgatttagacgtctcatcaagggaaggaagggggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggacctacggatatgactactagttgggactggtacttcgattctcgtggggccgtggccacccgtggtcactgtcctcctcagccctccaccgaacggggccccagttccggtccttcccccgtggcccgccctggcctccgaggacgcctacccgtcggacgacgccgacgacggcccgggtacccgtgggcctcgggtcccgtcggggttaccaaacgggtccttaaccgttcccgactttaccgtactaaccgttacctgggaacggtcggggaccgtgggaccaagggcctacgtagtacgnnngnnnnnnnnnnnnnnnnnnnnnnnnnnnn

SEQ ID NO: 255239 - DNA, 475 bp, Homo sapiens
  misc_feature: GYAE6OF01CQJZ8.37.1.A01.1.454.CMB.1.raw
  modified_base (347)..(347): a, c, t, g, unknown or other
  misc_feature (347)..(347): n is a, c, g, or t
  modified_base (371)..(371): a, c, t, g, unknown or other
  misc_feature (371)..(371): n is a, c, g, or t
  modified_base (385)..(385): a, c, t, g, unknown or other
  misc_feature (385)..(385): n is a, c, g, or t
  modified_base (397)..(397): a, c, t, g, unknown or other
  misc_feature (397)..(397): n is a, c, g, or t
  modified_base (441)..(441): a, c, t, g, unknown or other
  misc_feature (441)..(441): n is a, c, g, or t
  modified_base (452)..(452): a, c, t, g, unknown or other
  misc_feature (452)..(452): n is a, c, g, or t
  modified_base (454)..(454): a, c, t, g, unknown or other
  misc_feature (454)..(454): n is a, c, g, or t
  modified_base (456)..(475): a, c, t, g, unknown or other
  misc_feature (456)..(475): n is a, c, g, or t
tcagtagtgtagatcacgaccggtgctcgatttagacgtctcatcaaaggaaggaagggactggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctacgtccccttatacgcagcggtctggtcctggtactttgacgacgtgggccagggaaccctggtccaccgtctcctcagcctccaaccgacggccctagtcccggtccttcccccgnggccccgccctgccgtccgaggcnccacctccgagacncacgcgcggccnggctgacctggtcaagtctaccttcatctacactatgagcggcnggcgagcgcangncnnnnnnnnnnnnnnnnnnnn

SEQ ID NO: 255240 - DNA, 652 bp, Homo sapiens
  misc_feature: GYAE6OF01BVR88.37.1.A01.1.454.CMB.1.raw
  modified_base (326)..(326): a, c, t, g, unknown or other
  misc_feature (326)..(326): n is a, c, g, or t
  modified_base (508)..(508): a, c, t, g, unknown or other
  misc_feature (508)..(508): n is a, c, g, or t
  modified_base (592)..(592): a, c, t, g, unknown or other
  misc_feature (592)..(592): n is a, c, g, or t
  modified_base (595)..(595): a, c, t, g, unknown or other
  misc_feature (595)..(595): n is a, c, g, or t
  modified_base (597)..(600): a, c, t, g, unknown or other
  misc_feature (597)..(600): n is a, c, g, or t
  modified_base (602)..(602): a, c, t, g, unknown or other
  misc_feature (602)..(602): n is a, c, g, or t
  modified_base (604)..(605): a, c, t, g, unknown or other
  misc_feature (604)..(605): n is a, c, g, or t
  modified_base (610)..(610): a, c, t, g, unknown or other
  misc_feature (610)..(610): n is a, c, g, or t
  modified_base (612)..(613): a, c, t, g, unknown or other
  misc_feature (612)..(613): n is a, c, g, or t
  modified_base (615)..(615): a, c, t, g, unknown or other
  misc_feature (615)..(615): n is a, c, g, or t
  modified_base (617)..(617): a, c, t, g, unknown or other
  misc_feature (617)..(617): n is a, c, g, or t
  modified_base (619)..(619): a, c, t, g, unknown or other
  misc_feature (619)..(619): n is a, c, g, or t
  modified_base (621)..(621): a, c, t, g, unknown or other
  misc_feature (621)..(621): n is a, c, g, or t
  modified_base (623)..(623): a, c, t, g, unknown or other
  misc_feature (623)..(623): n is a, c, g, or t
  modified_base (625)..(626): a, c, t, g, unknown or other
  misc_feature (625)..(626): n is a, c, g, or t
  modified_base (628)..(629): a, c, t, g, unknown or other
  misc_feature (628)..(629): n is a, c, g, or t
  modified_base (631)..(635): a, c, t, g, unknown or other
  misc_feature (631)..(635): n is a, c, g, or t
  modified_base (637)..(638): a, c, t, g, unknown or other
  misc_feature (637)..(638): n is a, c, g, or t
  modified_base (640)..(647): a, c, t, g, unknown or other
  misc_feature (640)..(647): n is a, c, g, or t
  modified_base (649)..(649): a, c, t, g, unknown or other
  misc_feature (649)..(649): n is a, c, g, or t
  modified_base (651)..(652): a, c, t, g, unknown or other
  misc_feature (651)..(652): n is a, c, g, or t
tcagtagtgtagatcacgaccggtgctcgatttagacgtctcatcagggccaatcagagtgttaatagtaacttagcctggtaccagcagaaacctgcccaggctcccaggctcctcatgtatcggtgacactcccaccgaggggcccacttcggtaactccccgaggcccaagggtttccaaggttggctaggtcggggacctggggaaccaggtacgtttcaggttcctaaacccagttcgaggccaggcctggacctaggttacctaggtaaaagttgtttttaccgggtatttttactttcgacgtactagacttaagggtnttaccggttttcccgtcggggccccgtttaccggggaaccgggtttacccgggaccccgggtaaaggggtaaccccgtaagggggttaaccgaaaacttacccgaaaacggtacctttggggacggaccgttcgaccgtaaccctggttaccttgttccttacaccgttccttaccccgganacgtttcagtaaaccttccgtaactaccgtagtccgggtacggccggggaacttcggggactaagggcctcgtaaagtgcagcncancnnnnananngacgngnngncngngngncnncnncnnnnngnnannnnnnnncngnn

SEQ ID NO: 255241 - DNA, 579 bp, Homo sapiens
  misc_feature: GYAE6OF01B1O2I.37.1.A01.1.454.CMB.1.raw
  modified_base (209)..(209): a, c, t, g, unknown or other
  misc_feature (209)..(209): n is a, c, g, or t
  modified_base (231)..(231): a, c, t, g, unknown or other
  misc_feature (231)..(231): n is a, c, g, or t
  modified_base (508)..(508): a, c, t, g, unknown or other
  misc_feature (508)..(508): n is a, c, g, or t
  modified_base (519)..(519): a, c, t, g, unknown or other
  misc_feature (519)..(519): n is a, c, g, or t
  modified_base (524)..(524): a, c, t, g, unknown or other
  misc_feature (524)..(524): n is a, c, g, or t
  modified_base (541)..(543): a, c, t, g, unknown or other
  misc_feature (541)..(543): n is a, c, g, or t
  modified_base (547)..(547): a, c, t, g, unknown or other
  misc_feature (547)..(547): n is a, c, g, or t
  modified_base (549)..(549): a, c, t, g, unknown or other
  misc_feature (549)..(549): n is a, c, g, or t
  modified_base (551)..(556): a, c, t, g, unknown or other
  misc_feature (551)..(556): n is a, c, g, or t
  modified_base (558)..(559): a, c, t, g, unknown or other
  misc_feature (558)..(559): n is a, c, g, or t
  modified_base (562)..(564): a, c, t, g, unknown or other
  misc_feature (562)..(564): n is a, c, g, or t
  modified_base (566)..(571): a, c, t, g, unknown or other
  misc_feature (566)..(571): n is a, c, g, or t
  modified_base (573)..(579): a, c, t, g, unknown or other
  misc_feature (573)..(579): n is a, c, g, or t
tcagtagtgtagatcacgaccggtgctcgatttagacgtctcatcagggccaatcagagtgttaatagtaacttagcctggtaccagcagaaacctgcccaggctcccaggctcctcatgtatggtgcactccaccgagggccacgtggtactcccagcctaggttcagtggcaggtgggactgggacagtacgttcacgtcctaaccntcagcagctgcagtctagaatntttgacttacttttatacgtgtacagtacgtaagttaataacgtaccggtccgggtaaccccggtaccggttacggaacccgaaacggggaccgaaagggtacggtaaaactaacgaaaaccggtacgtttgggcggtacctacggacctacctaggttcctttaggtcctttaccgtaccgtttcccgtcccgacttagttcgtaagtactaccttaacaccgttagtacggcggtccggtacgaggtaaccgtaaggccgtaacgtatacggacngcgacacgtancgacncacgcgtcgagtcgcgnnngcanangnnnnnngnncgnnngnnnnnncnnnnnnn

SEQ ID NO: 255242 - DNA, 644 bp, Homo sapiens
  misc_feature: GYAE6OF01CPG3G.37.1.A01.1.454.CMB.1.raw
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
  modified_base (583)..(583): a, c, t, g, unknown or other
  misc_feature (583)..(583): n is a, c, g, or t
  modified_base (643)..(643): a, c, t, g, unknown or other
  misc_feature (643)..(643): n is a, c, g, or t
tcagtagtgtagatcacgaccggtgctcgatttagacgtctcatcaaggaagggaagggactggagtgggtctcaggtattggtggcagtggtgagaccacatactacgcagactccgtgaagggccggttcaccatctccagagacaattccaagaacaccctgtctctgcaaatgaacaactgagagccgagacacggtcctatatactgtaacgaaaatggcctacggatatgactactagttggactggtacttcgatctcgtggggccgtggcacccgtggtcactgtcctctcacgcctaccaccgaacgggccctacgtcggttccttccccgngggccnccccgttgcccttccgacggacgtcctaccgtccggaagacgaccgacgacggcccggtcccgtcggggtctcggtcccgtaggtaccgaacgggtaccttaaccgttaccgacttaccctaacctaaccgttaccgttacgggaacgggtccgggggtaccgtacggggaacccggtaagggacccggtacgtaaccgttaacgggcgactagcacgacgcgtcgtagtcgtacncgcgtacgacgacgtagacgtcgactacgcgtacgtacgacgtcgacgacgcgtcgtcgng

SEQ ID NO: 255243 - DNA, 643 bp, Homo sapiens
  misc_feature: GYAE6OF01ETIA7.37.1.A01.1.454.CMB.1.raw
  modified_base (229)..(229): a, c, t, g, unknown or other
  misc_feature (229)..(229): n is a, c, g, or t
  modified_base (611)..(612): a, c, t, g, unknown or other
  misc_feature (611)..(612): n is a, c, g, or t
  modified_base (614)..(615): a, c, t, g, unknown or other
  misc_feature (614)..(615): n is a, c, g, or t
  modified_base (617)..(629): a, c, t, g, unknown or other
  misc_feature (617)..(629): n is a, c, g, or t
  modified_base (631)..(635): a, c, t, g, unknown or other
  misc_feature (631)..(635): n is a, c, g, or t
  modified_base (637)..(643): a, c, t, g, unknown or other
  misc_feature (637)..(643): n is a, c, g, or t
tcagtagtgtagatcacgaccggtgctcgatttagacgtctcatcaaagggaaggaagggactggagtgggtctcaggtattggtggcagtggtgagaccacatactacgcagactccgtgagggccgttcaccatctcagagacaattccaagaacaccctgtctctgacaaatgaaccaactgagacgcgagaccacggtccctatacttactgtgacgagacgtanacgaaggacggtagtaaatgcgaacggcagtcctacgtagtacctacggtacggggacccgaacccgtaaccgttcggtaccaccggttcctccctaccacgtaccccgtacccaaccggtaacccggtacccgtacgttccccggttccctttacccccgtcgggaccccttaccccccgtacctaacccgaagtaccgtaccctaacccgttcggacgggtaccaacggaccgggccggcccgtggcccgttcggtacccgtacggtactaaaacggtccctttaaccgtaccctaacgtaccctaaccgtaacgttacgagggtaccggtccgggtaccgtaacgggaccgaaacgggtcgtaacgagtaagcagatgnncnngnnnnnnnnnnnnngnnnnncnnnnnnn

SEQ ID NO: 255244 - DNA, 523 bp, Homo sapiens
  misc_feature: GYAE6OF01BV39W.37.1.A01.1.454.CMB.1.raw
  modified_base (353)..(353): a, c, t, g, unknown or other
  misc_feature (353)..(353): n is a, c, g, or t
  modified_base (450)..(450): a, c, t, g, unknown or other
  misc_feature (450)..(450): n is a, c, g, or t
  modified_base (482)..(482): a, c, t, g, unknown or other
  misc_feature (482)..(482): n is a, c, g, or t
  modified_base (489)..(489): a, c, t, g, unknown or other
  misc_feature (489)..(489): n is a, c, g, or t
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
  modified_base (496)..(523): a, c, t, g, unknown or other
  misc_feature (496)..(523): n is a, c, g, or t
tcagtagtgtagatcacgaccggtgctcgattttagacgtctcatcaagggaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggcctacggatatgactactagttgggactggtacttcgatctcgtcggggccgtggccaccctggtcactgtcctcctcacgccctccaccgacgggccccagtccggtccctcccccgtggccnccccgtgcctccgaggcgccaccgtcgagacgccacacggccgccgtggctcggccgtggacaacggtaccttacttccgatccgtaacacttacgnggacggcgggtctcgggacgtaacggccgtanaagtcgngntncgnnnnnnnnnnnnnnnnnnnnnnnnnnnn

SEQ ID NO: 255245 - DNA, 461 bp, Homo sapiens
  misc_feature: GYAE6OF01EYJIV.37.1.A01.1.454.CMB.1.raw
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
  modified_base (247)..(247): a, c, t, g, unknown or other
  misc_feature (247)..(247): n is a, c, g, or t
  modified_base (410)..(410): a, c, t, g, unknown or other
  misc_feature (410)..(410): n is a, c, g, or t
  modified_base (429)..(429): a, c, t, g, unknown or other
  misc_feature (429)..(429): n is a, c, g, or t
  modified_base (435)..(461): a, c, t, g, unknown or other
  misc_feature (435)..(461): n is a, c, g, or t
tcagtagtgtagatcacgaccggtgctcgatttagacgtctcatcagggccaatcagagtgttaatagtaacttagcctggtaccagcagaaacctgcccaggctcccaggctcctcatgtatggtgcatccaccagggccactggtatcccagccaggttcagtgcaggtgggactgggacagagttcagtctaaccntacagcagcctgcagtctagtaagtnttttggtatttatttctgtacngtcattattacgttcctcggccgtcggcgttcggcccgtaagggaccaagggtagaaactacgaaaacgacgtgcgtctgaccacattctcgttcttacaccttccttcccgacctattctaacgtaacctccttaccgtaacgtacgtggacgggtccgggngtacggacgtacggaccgntaatgnnnnnnnnnnnnnnnnnnnnnnnnnnn

SEQ ID NO: 255246 - DNA, 624 bp, Homo sapiens
  misc_feature: GYAE6OF01A3EB4.37.1.A01.1.454.CMB.1.raw
  modified_base (514)..(514): a, c, t, g, unknown or other
  misc_feature (514)..(514): n is a, c, g, or t
  modified_base (545)..(545): a, c, t, g, unknown or other
  misc_feature (545)..(545): n is a, c, g, or t
  modified_base (550)..(550): a, c, t, g, unknown or other
  misc_feature (550)..(550): n is a, c, g, or t
  modified_base (555)..(555): a, c, t, g, unknown or other
  misc_feature (555)..(555): n is a, c, g, or t
  modified_base (561)..(561): a, c, t, g, unknown or other
  misc_feature (561)..(561): n is a, c, g, or t
  modified_base (571)..(571): a, c, t, g, unknown or other
  misc_feature (571)..(571): n is a, c, g, or t
  modified_base (573)..(575): a, c, t, g, unknown or other
  misc_feature (573)..(575): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (585)..(586): a, c, t, g, unknown or other
  misc_feature (585)..(586): n is a, c, g, or t
  modified_base (588)..(589): a, c, t, g, unknown or other
  misc_feature (588)..(589): n is a, c, g, or t
  modified_base (591)..(591): a, c, t, g, unknown or other
  misc_feature (591)..(591): n is a, c, g, or t
  modified_base (593)..(595): a, c, t, g, unknown or other
  misc_feature (593)..(595): n is a, c, g, or t
  modified_base (597)..(597): a, c, t, g, unknown or other
  misc_feature (597)..(597): n is a, c, g, or t
  modified_base (602)..(604): a, c, t, g, unknown or other
  misc_feature (602)..(604): n is a, c, g, or t
  modified_base (606)..(606): a, c, t, g, unknown or other
  misc_feature (606)..(606): n is a, c, g, or t
  modified_base (609)..(611): a, c, t, g, unknown or other
  misc_feature (609)..(611): n is a, c, g, or t
  modified_base (613)..(615): a, c, t, g, unknown or other
  misc_feature (613)..(615): n is a, c, g, or t
  modified_base (617)..(617): a, c, t, g, unknown or other
  misc_feature (617)..(617): n is a, c, g, or t
  modified_base (619)..(622): a, c, t, g, unknown or other
  misc_feature (619)..(622): n is a, c, g, or t
tcagtagtgtagatcacgaccggtgctcgatttagacgtctcatcagggccaatcagagtgttaatagtaacttagcctggtaccagcagaaacctgcccaggctcccaggctcctcatgtatggtgcatccaccagggccactggtactccccagccaggttcagtggcaggtgggactgggacaggagttcagtacctaaccatcagcacgcctgcagtctgaaagtattttgaccttaactttattactagtactaacgaagtattaacctaactttaccctcgttaccgggttccggaaccgtaagggggaaccaaggggttacggaaattaccgaaaaacggtaaccgtgggttacggacttacggaccgaaccttacgttaccgttagggtttaccctttaacgtacccgtttacccttttaccccccgggaccttaaactttcccgttaagtaaacctttcccgttaaacgtaaccctaacggtacggtaagggccccgggggttanacggggaaccaacgggggtaccacttaacgngtagntactnagactnagctaggatnannnananananannannanannnanagagnnnanagnnncnnnanannnntc

SEQ ID NO: 255247 - DNA, 171 bp, Homo sapiens; identical to SEQ ID NO: 255205
  misc_feature: GYAE6OF02G4JCE.37.1.A01.1.454.CMB.1.raw
  modified_base (171)..(171): a, c, t, g, unknown or other
  misc_feature (171)..(171): n is a, c, g, or t

SEQ ID NO: 255248 - DNA, 381 bp, Homo sapiens
  misc_feature: GYAE6OF02I4P8V.37.1.A01.1.454.CMB.1.raw
  modified_base (371)..(371): a, c, t, g, unknown or other
  misc_feature (371)..(371): n is a, c, g, or t
  modified_base (377)..(381): a, c, t, g, unknown or other
  misc_feature (377)..(381): n is a, c, g, or t
tcagtagtgtagatcacgaccggtgctcgatttagacgtctcatcagggccaatcagagtgttaatagtaacttagcctggtaccagcagaaacctgcccaggctcccaggctcctcatgtatggtgcatccaccagggccactggtatcccagccaggttcagtggcagtgggactgggacagagttcagtctaaccatcagcagcctgcagtctgaagattttggagttttatttctgtcagcagtatagttcctggcctcggacgttcggcccagggaccaaggtggaaatcaaacgactgtggctgcaccatctgtcttcatcttcccgcatctgaatctacactactgagcgggctggcaagggcncatagnnnnn

SEQ ID NO: 255249 - DNA, 172 bp, Homo sapiens; identical to SEQ ID NO: 255203
  misc_feature: GYAE6OF02H1BEJ.37.1.A01.1.454.CMB.1.raw
  modified_base (171)..(172): a, c, t, g, unknown or other
  misc_feature (171)..(172): n is a, c, g, or t

SEQ ID NO: 255250 - DNA, 170 bp, Homo sapiens
  misc_feature: GYAE6OF02IXMDU.37.1.A01.1.454.CMB.1.raw
  modified_base (170)..(170): a, c, t, g, unknown or other
  misc_feature (170)..(170): n is a, c, g, or t
tcagtagtgtagatcacgaccggtgctcgatttagacgtctcatcagggcccatcggtcttcccctggcgccctgctccaggagcacctccgagagcacagcggccctgggctgcctggtcaaggactacttccatctacactactgagcgggctggcaaggcgcatagn

SEQ ID NO: 255251 - DNA, 169 bp, Homo sapiens
  misc_feature: GYAE6OF02G0N3T.37.1.A01.1.454.CMB.1.raw
  modified_base (169)..(169): a, c, t, g, unknown or other
  misc_feature (169)..(169): n is a, c, g, or t
tcagtagtgtagatcacgaccggtgctcgatttagacgtctcatcagggcccatcggtcttcccctggcgccctgctccaagagcacctctggggcacagcggccctgggctgcctggtcaaggactacttccatctacactactgagcgggctggcaaggcgcatagn

SEQ ID NO: 255252 - DNA, 171 bp, Homo sapiens; identical to SEQ ID NO: 255205
  misc_feature: GYAE6OF02IMHAV.37.1.A01.1.454.CMB.1.raw
  modified_base (171)..(171): a, c, t, g, unknown or other
  misc_feature (171)..(171): n is a, c, g, or t

SEQ ID NO: 255253 - DNA, 444 bp, Homo sapiens
  misc_feature: GYAE6OF02JAJ0B.37.1.A01.1.454.CMB.1.raw
  modified_base (435)..(444): a, c, t, g, unknown or other
  misc_feature (435)..(444): n is a, c, g, or t
tcagtagtgtagatcacgaccggtgctcgatttagacgtctcatcaaggaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacagcggcctgggctgcctggtcaaggactacttccatctacactactgagcgggctggcaaggcgcatagnnnnnnnnnn

SEQ ID NO: 255254 - DNA, 172 bp, Homo sapiens
  misc_feature: GYAE6OF02G5RD3.37.1.A01.1.454.CMB.1.raw
  modified_base (170)..(172): a, c, t, g, unknown or other
  misc_feature (170)..(172): n is a, c, g, or t
tcagtagtgtagatcacgaccggtgctcgatttagacgtctcatcagggcccatcggtcttcccctggcgccctgctccaggagcacctccgagagcacagcggccctgggctgcctggtcaaggactacttccatctacactactgagcgggctggcaaggcgcatagnnn

SEQ ID NO: 255255 - DNA, 172 bp, Homo sapiens; identical to SEQ ID NO: 255254
  misc_feature: GYAE6OF02GJFAH.37.1.A01.1.454.CMB.1.raw
  modified_base (170)..(172): a, c, t, g, unknown or other
  misc_feature (170)..(172): n is a, c, g, or t

SEQ ID NO: 255256 - DNA, 376 bp, Homo sapiens
  misc_feature: GYAE6OF02IDAXO.37.1.A01.1.454.CMB.1.raw
  modified_base (366)..(366): a, c, t, g, unknown or other
  misc_feature (366)..(366): n is a, c, g, or t
  modified_base (372)..(376): a, c, t, g, unknown or other
  misc_feature (372)..(376): n is a, c, g, or t
tcagtagtgtagatcacgaccggtgctcgatttagacgtctcatcagggccaatcagagtgttaatagtaacttagcctggtaccagcagaaacctgcccaggctcccaggctcctcatgtatggtgcatccaccagggccactggtatcccagccaggttcagtggcagtgggactgggacagagttcagtctaaccatcagcagcctgcagtctgaagattttggagtttattctgtcagcagtatagttcctggcctcggacgttcggcccagggaccaaggtgaaatcaaacgactgtggctgcaccatctgtcttcatcttccgcatctgaatctacactactgagcgggctggcaaggcncatagnnnnn

SEQ ID NO: 255257 - DNA, 444 bp, Homo sapiens
  misc_feature: GYAE6OF02FQ8Q2.37.1.A01.1.454.CMB.1.raw
  modified_base (437)..(444): a, c, t, g, unknown or other
  misc_feature (437)..(444): n is a, c, g, or t
tcagtagtgtagatcacgaccggtgctcgatttagacgtctcatcaaggaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacagcggccctgggctgcctggtcaagggactacttccatctacactactgagcgggctggcaaggcgcatagnnnnnnnn

SEQ ID NO: 255258 - DNA, 171 bp, Homo sapiens; identical to SEQ ID NO: 255205
  misc_feature: GYAE6OF02HA919.37.1.A01.1.454.CMB.1.raw
  modified_base (171)..(171): a, c, t, g, unknown or other
  misc_feature (171)..(171): n is a, c, g, or t

SEQ ID NO: 255259 - DNA, 480 bp, Homo sapiens
  misc_feature: GYAE6OF02J0VSA.37.1.A01.1.454.CMB.1.raw
  modified_base (302)..(302): a, c, t, g, unknown or other
  misc_feature (302)..(302): n is a, c, g, or t
  modified_base (339)..(339): a, c, t, g, unknown or other
  misc_feature (339)..(339): n is a, c, g, or t
  modified_base (361)..(361): a, c, t, g, unknown or other
  misc_feature (361)..(361): n is a, c, g, or t
  modified_base (378)..(378): a, c, t, g, unknown or other
  misc_feature (378)..(378): n is a, c, g, or t
  modified_base (460)..(460): a, c, t, g, unknown or other
  misc_feature (460)..(460): n is a, c, g, or t
  modified_base (464)..(467): a, c, t, g, unknown or other
  misc_feature (464)..(467): n is a, c, g, or t
  modified_base (469)..(480): a, c, t, g, unknown or other
  misc_feature (469)..(480): n is a, c, g, or t
tcagtagtgtagatcacgaccggtgctcgatttagacgtctcatcaaggaagggaagggacgtggagtgggtctcgaggtattggtggcgagtggtgagaccacatactacgcagactccgtgaagggccggttcaccatctcagagacattccaagaacaccctgtctctgcaaatgaacaacctgagagccgaggacacggccctatatactgtacgaaaatggcctacggattatgactactattggactggtacttcgatctcgtggggcctggccacctggtccacgtgtctccgtnacgccctcacccgaaggcccagtccggtcctccccgnggccgccctggcctccgagganccaccctcgagagcacncggccgccctggggcctgccgtggaccaaggcctactccattcactactcgtgacgtcgggctacgggcaagggcgcaggtngcgnnnntnnnnnnnnnnnn

SEQ ID NO: 255260 - DNA, 489 bp, Homo sapiens
  misc_feature: GYAE6OF02HHUWP.37.1.A01.1.454.CMB.1.raw
  modified_base (457)..(481): a, c, t, g, unknown or other
  misc_feature (457)..(481): n is a, c, g, or t
  modified_base (483)..(489): a, c, t, g, unknown or other
  misc_feature (483)..(489): n is a, c, g, or t
tcagtagtgtagatcacgaccggtgctcgatttagacgtctcatcaagggtaagggaagggactggagtgggtctcaggtattggtggcagtggtgagaccaaccatactacgcagactccgtgaagggccggttcaccatctccagagacaattccaagtaacaccctgtctctgcaaatgaaccaacctgagagccgaggacacgggccctatattactggtacgaaaatggcctacggatatgacgtactattgggactgggtacttcgatctctggggccgtggcaccctggtcactgtctcctcagcctccacctaaggggcccatccggtcttccccctggcgccctgccttccaggagcaccgtccgagagcacagcggcctgggctgcctggtcaaggactacttccattccgtacactactgagcgggctggcgaacggcgcactagnnnnnnnnnnnnnnnnnnnnnnnnngnnnnnnn

SEQ ID NO: 255261 - DNA, 382 bp, Homo sapiens
  misc_feature: GYAE6OF02IHOJA.37.1.A01.1.454.CMB.1.raw
  modified_base (377)..(382): a, c, t, g, unknown or other
  misc_feature (377)..(382): n is a, c, g, or t
tcagtagtgtagatcacgaccggtgctcgatttagacgtctcatcagggccaatcagagtgttaatagtaacttagcctggtaccagcagaaacctgcccaggctcccaggctcctcatgtatggtgcatccaccagggccactggtatcccagccaggttcagtggcagtgggactgggacagagttcagtctaaccatcagcagcctgcagtctgaagattttggagtttatttctgtcagcagtatagttcctggcctggacgttcggcccagggaccaaggtgaaatcaaacgactgtggctgcaccatctgtcttcatccttcccgcatctgaactctacactactgacgcgggctggcaagggcacatagnnnnnn

SEQ ID NO: 255262 - DNA, 171 bp, Homo sapiens
  misc_feature: GYAE6OF02FYRQS.37.1.A01.1.454.CMB.1.raw
  modified_base (170)..(171): a, c, t, g, unknown or other
  misc_feature (170)..(171): n is a, c, g, or t
tcagtagtgtagatcacgaccggtgctcgatttagacgtctcatcagggcccatcggtcttcccctggcgccctgctccaggagcacctccgagagcacagcggccctgggctgcctggtcaaggactacttccatctacactactgagcgggctggcaaggcgcatagnn

SEQ ID NO: 255263 - DNA, 604 bp, Homo sapiens
  misc_feature: GYAE6OF02I4SU2.37.1.A01.1.454.CMB.1.raw
  modified_base (372)..(372): a, c, t, g, unknown or other
  misc_feature (372)..(372): n is a, c, g, or t
  modified_base (578)..(578): a, c, t, g, unknown or other
  misc_feature (578)..(578): n is a, c, g, or t
  modified_base (581)..(604): a, c, t, g, unknown or other
  misc_feature (581)..(604): n is a, c, g, or t
tcagtagtgtagatcacgaccggtgctcgatttagacgtctcatcaagggaaggaagggacgtggaggtgggtcgtcaggtagttggtgggcagtggtgagaccacatactacgcagactccgtggaaggggccggttcaccatctccagagacaattaccaagaaacaccctcgtctctgcaaatgaacaacctgaggagccgaggacaccggccctatattactgtaacgaaaatggcctacggatatgactactattggggactggtacttcgatctcgtgggggccggtggcaccctggtcactgtctcctcacgcctcccaccgaacgggccccatccggtccttccccccgtgggccgcccccgtncccgtaccacggggacgtcccacccctacccgggaggaacgcccaaccgaggcccggggtccccttcggggggccttcgggcccgtttacggggttaccgaaaaggggaccccttaacccgttttccccaagttcccttaaaccccgactttacccgtgggacggggccgggggtccgtcgggaaccaacggggtcgcaacgttancgnnnnnnnnnnnnnnnnnnnnnnnn

SEQ ID NO: 255264 - DNA, 375 bp, Homo sapiens
  misc_feature: GYAE6OF02HDM6S.37.1.A01.1.454.CMB.1.raw
  modified_base (366)..(366): a, c, t, g, unknown or other
  misc_feature (366)..(366): n is a, c, g, or t
  modified_base (372)..(375): a, c, t, g, unknown or other
  misc_feature (372)..(375): n is a, c, g, or t
tcagtagtgtagatcacgaccggtgctcgatttagacgtctcatcagggccaatcagagtgttaatagtaacttagcctggtaccagcagaaacctgcccaggctcccaggctcctcatgtatggtgcatccaccagggccactggtatcccagccaggttcagtggcagtgggactgggacagagttcagtctaaccatcagcagcctgcagtctgaagtattttggattttatactgtcaacagtacaatgactggcctctcactttcggcggaggaccaaggtggagatcaaacgaactgtggctgcaccatctgtcttcatctcccgcatctgaatctacactactgagcggctggcaggcncatagnnnn

SEQ ID NO: 255265 - DNA, 473 bp, Homo sapiens
  misc_feature: GYAE6OF02HVR4T.37.1.A01.1.454.CMB.1.raw
  modified_base (441)..(441): a, c, t, g, unknown or other
  misc_feature (441)..(441): n is a, c, g, or t
  modified_base (444)..(473): a, c, t, g, unknown or other
  misc_feature (444)..(473): n is a, c, g, or t
tcagtagtgtagatcacgaccggtgctcgatttagacgtctcatcaagggaaggggaagggactggagtgggtctcaggtattggtggcagtggtgagaccacatactacgcagactccgtgaagggccggttcaccatctccagagacaattccaagaacaccctgtctctgcaaatgaacaactgagagccgaggacacggccctatattactgtacgaaaatggcctacggatatgactactattgggactggtacttcgatctctggggccgtggcaccctggtcactgtctcctcagcctcaccaagggccatcggtctcccctgcgccctgctccaggcgcacctccgagagcacgagcggccctggggctgcctggtcaaggtactacttccgatctacactactgagcgggctggcaaagggcgacaagtagnacnnnnnnnnnnnnnnnnnnnnnnnnnnnnnn

SEQ ID NO: 255266 - DNA, 447 bp, Homo sapiens
  misc_feature: GYAE6OF02JDM2D.37.1.A01.1.454.CMB.1.raw
  modified_base (345)..(345): a, c, t, g, unknown or other
  misc_feature (345)..(345): n is a, c, g, or t
  modified_base (368)..(368): a, c, t, g, unknown or other
  misc_feature (368)..(368): n is a, c, g, or t
  modified_base (430)..(447): a, c, t, g, unknown or other
  misc_feature (430)..(447): n is a, c, g, or t
tcagtagtgtagatcacgaccggtgctcgatttagacgtctcatcaaggaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggcctggcaccctggtcactgtctcctcagcctccaccaagggcccatccgtctcccctgcgccctgctcaggancacctcgagagcacagcggcccngggctgcctggtcaacggctacttccatctacactactgagcgggctggcaaggcacatagnnnnnnnnnnnnnnnnnn

SEQ ID NO: 255267 - DNA, 171 bp, Homo sapiens; identical to SEQ ID NO: 255262
  misc_feature: GYAE6OF02IS1QZ.37.1.A01.1.454.CMB.1.raw
  modified_base (170)..(171): a, c, t, g, unknown or other
  misc_feature (170)..(171): n is a, c, g, or t

SEQ ID NO: 255268 - DNA, 582 bp, Homo sapiens
  misc_feature: GYAE6OF02IAZ4C.37.1.A01.1.454.CMB.1.raw
  modified_base (220)..(220): a, c, t, g, unknown or other
  misc_feature (220)..(220): n is a, c, g, or t
  modified_base (368)..(368): a, c, t, g, unknown or other
  misc_feature (368)..(368): n is a, c, g, or t
  modified_base (515)..(515): a, c, t, g, unknown or other
  misc_feature (515)..(515): n is a, c, g, or t
  modified_base (520)..(521): a, c, t, g, unknown or other
  misc_feature (520)..(521): n is a, c, g, or t
  modified_base (525)..(525): a, c, t, g, unknown or other
  misc_feature (525)..(525): n is a, c, g, or t
  modified_base (530)..(530): a, c, t, g, unknown or other
  misc_feature (530)..(530): n is a, c, g, or t
  modified_base (534)..(534): a, c, t, g, unknown or other
  misc_feature (534)..(534): n is a, c, g, or t
  modified_base (544)..(544): a, c, t, g, unknown or other
  misc_feature (544)..(544): n is a, c, g, or t
  modified_base (546)..(546): a, c, t, g, unknown or other
  misc_feature (546)..(546): n is a, c, g, or t
  modified_base (554)..(554): a, c, t, g, unknown or other
  misc_feature (554)..(554): n is a, c, g, or t
  modified_base (579)..(579): a, c, t, g, unknown or other
  misc_feature (579)..(579): n is a, c, g, or t
tcagtagtgtagatcacgaccggtgctcgattttagacgtctcatcgaacggaagggaacgggacgtggacgtgggtctctaggtattggtggcagtggtgagaccacatactacgcagactccgtgaagggccggttcaccgatctccagagtacaattccaagaactaaccctgtctctgcaaatgaacaacctgagagccgagggacacggccctanattactggtacgaaaatggcctacggatatgactactattgggactggtacttcgatctcgtggggccgtggcaccgtggtcacgtgtctcctcaggcccgtccaccgtacgggtcccacgttcggtccttccccgtggccgtcccgngcctccgaggacgcacccgtccggagacgcgacgacggccggcccgtcgggcctaggccgtacggtacaacggacttaaccttccacttacctactacgtacgtaggaacgcgggcgtagggaccaaagggccgacgagtacggacngcgtnntacntacgngagngagacgctananactgtgtncgtcgcgcgcgagacgagacgtacnctc

SEQ ID NO: 255269 - DNA, 545 bp, Homo sapiens
  misc_feature: GYAE6OF02II7S2.37.1.A01.1.454.CMB.1.raw
  modified_base (138)..(138): a, c, t, g, unknown or other
  misc_feature (138)..(138): n is a, c, g, or t
  modified_base (202)..(202): a, c, t, g, unknown or other
  misc_feature (202)..(202): n is a, c, g, or t
  modified_base (366)..(366): a, c, t, g, unknown or other
  misc_feature (366)..(366): n is a, c, g, or t
  modified_base (435)..(435): a, c, t, g, unknown or other
  misc_feature (435)..(435): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (481)..(481): a, c, t, g, unknown or other
  misc_feature (481)..(481): n is a, c, g, or t
  modified_base (491)..(491): a, c, t, g, unknown or other
  misc_feature (491)..(491): n is a, c, g, or t
tcagtagtgtagatcacgaccggtgctcgattttagacgtctcatcgaacggaaggaacgggacgtggacgtgggtctctaggtattggtggcagtggtgagaccacatactacgcagactccgtgaagggccggttnacccgatctccagaggtaccaattccaagaaactaaccctgtctctgcaaatgacaacctgagngcgagggacacggccctatattactggtacaaaatggcctacggatatgactactattgggactggtacttcgatctcgtgggccgtggcacccgtgtcacgtgtctcctcaggccgtccacgacggccagtcggtctccccgtggccgccgtgctccaggacncaccgtccgagacgcacgcgccgcccgtcggctgaccgtcgtacaacggtactactccatctacactangaacgcgggactggacaaggcgacgagtacgnagncgtatctacgntcgatcggancgtacatatacgtgtgtagtcgtcgtcgtcgacgacgacgacgtcgtcgtcgtc

SEQ ID NO: 255270 - DNA, 382 bp, Homo sapiens
  misc_feature: GYAE6OF02FQY5W.37.1.A01.1.454.CMB.1.raw
  modified_base (369)..(369): a, c, t, g, unknown or other
  misc_feature (369)..(369): n is a, c, g, or t
  modified_base (374)..(382): a, c, t, g, unknown or other
  misc_feature (374)..(382): n is a, c, g, or t
tcagtagtgtagatcacgaccggtgctcgatttagacgtctcatcagggccaatcagagtgttaatagtaacttagcctggtaccagcagaaacctgcccaggctcccaggctcctcatgtatggtgcatccaccagggccactggtatcccagccaggttcagtggcagtgggactgggacagagttcagtctaaccatcagcagcctgcagtctgaagattttggagttttatttctgtcagcagtatagttcctggcctcggacgttcggcccagggaccaaggtggaaatcaaacgactgtggctgcacatctgtcttcatcttccgcatctgaatctacactactgagcgggctggcaagggcnatagnnnnnnnnn

SEQ ID NO: 255271 - DNA, 398 bp, Homo sapiens
  misc_feature: GYAE6OF02H43WC.37.1.A01.1.454.CMB.1.raw
  modified_base (314)..(314): a, c, t, g, unknown or other
  misc_feature (314)..(314): n is a, c, g, or t
  modified_base (390)..(398): a, c, t, g, unknown or other
  misc_feature (390)..(398): n is a, c, g, or t
tcagtagtgtagatcacgaccggtgctcgatttagacgtctcatcagggccaatcagagtgttaatagtaacttagcctggtaccagcagaaacctgcccaggctcccaggctcctcatgtatggtgcatccaccagggccactggtatcccagccaggttcagtggcagtgggactgggacagagttcagtctcaccatcagcagcctgcagtctgaagtattttgctagtttatttctgtcagctagtataattactggcctcctacgtggacgttcggaccaagggaccaaggtgaaatcaaacgaactgnggctgcacatctgtcttcatccttcccgctatctgaactctacactactgagtcgggctgggacaggcacagtgcnnnnnnnnn

SEQ ID NO: 255272 - DNA, 500 bp, Homo sapiens
  misc_feature: GYAE6OF02I7FTF.37.1.A01.1.454.CMB.1.raw
  modified_base (362)..(362): a, c, t, g, unknown or other
  misc_feature (362)..(362): n is a, c, g, or t
  modified_base (382)..(382): a, c, t, g, unknown or other
  misc_feature (382)..(382): n is a, c, g, or t
  modified_base (442)..(442): a, c, t, g, unknown or other
  misc_feature (442)..(442): n is a, c, g, or t
  modified_base (463)..(463): a, c, t, g, unknown or other
  misc_feature (463)..(463): n is a, c, g, or t
  modified_base (470)..(500): a, c, t, g, unknown or other
  misc_feature (470)..(500): n is a, c, g, or t
tcagtagtgtagatcacgaccggtgctcgatttagacgtctcatcaaggaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctcgtggggccgtggcaccctggtcactgtctcctcacgcctccaccgaacgggcccagtccggtccttcccccgtggccgtccctgcctccaggacnccaccctcgagacgcaacgngccggccctgggctcgcccgtggaccgaacggaccttactcccgactctaccacttacgngacgcggctggaccgaaggcncagtagnnnnnnnnnnnnnnnnnnnnnnnnnnnnnnn

SEQ ID NO: 255273 - DNA, 541 bp, Homo sapiens
  misc_feature: GYAE6OF02I1ZXN.37.1.A01.1.454.CMB.1.raw
  modified_base (190)..(190): a, c, t, g, unknown or other
  misc_feature (190)..(190): n is a, c, g, or t
  modified_base (352)..(352): a, c, t, g, unknown or other
  misc_feature (352)..(352): n is a, c, g, or t
  modified_base (520)..(520): a, c, t, g, unknown or other
  misc_feature (520)..(520): n is a, c, g, or t
  modified_base (522)..(541): a, c, t, g, unknown or other
  misc_feature (522)..(541): n is a, c, g, or t
tcagtagtgtagatcacgaccggtgctcgatttagacgtctcatcaaggaagggaagggacgtggagtgggtctcaggtattggtggcagtggtgagaccacatactacgcagactccgtgaagggccggttcaccatctccagagacaattccaagaacacactctatctgcaaatgaacagcctgaanaactgaggaacacggctgtgtatcatgtgacgaaccgtaagggggtttggagatgcagcgtggaggtgagttggttttgatttagcggggacaagggtacatgggtcaccggttctcgttcgacgccctccgaaccgaaggcccagtccggtccttccccgngcccacccctcaccaagcgtccacctcggtggggccacgcgccggccgtgggcctacggcctcgggtttacaacgggtaccttacccgttaccactcctaacctaccgtaacgtcggacggtccgggtcttaccgggaccaaggaccgtccgaagtacgtgcgctgcncnnnnnnnnnnnnnnnnnnnn

SEQ ID NO: 255274 - DNA, 564 bp, Homo sapiens
  misc_feature: GYAE6OF02GVK5K.37.1.A01.1.454.CMB.1.raw
  modified_base (108)..(108): a, c, t, g, unknown or other
  misc_feature (108)..(108): n is a, c, g, or t
  modified_base (320)..(320): a, c, t, g, unknown or other
  misc_feature (320)..(320): n is a, c, g, or t
  modified_base (373)..(373): a, c, t, g, unknown or other
  misc_feature (373)..(373): n is a, c, g, or t
  modified_base (495)..(495): a, c, t, g, unknown or other
  misc_feature (495)..(495): n is a, c, g, or t
  modified_base (515)..(515): a, c, t, g, unknown or other
  misc_feature (515)..(515): n is a, c, g, or t
  modified_base (518)..(518): a, c, t, g, unknown or other
  misc_feature (518)..(518): n is a, c, g, or t
  modified_base (520)..(521): a, c, t, g, unknown or other
  misc_feature (520)..(521): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (530)..(530): a, c, t, g, unknown or other
  misc_feature (530)..(530): n is a, c, g, or t
  modified_base (532)..(534): a, c, t, g, unknown or other
  misc_feature (532)..(534): n is a, c, g, or t
  modified_base (536)..(536): a, c, t, g, unknown or other
  misc_feature (536)..(536): n is a, c, g, or t
  modified_base (538)..(541): a, c, t, g, unknown or other
  misc_feature (538)..(541): n is a, c, g, or t
  modified_base (543)..(543): a, c, t, g, unknown or other
  misc_feature (543)..(543): n is a, c, g, or t
  modified_base (545)..(546): a, c, t, g, unknown or other
  misc_feature (545)..(546): n is a, c, g, or t
  modified_base (548)..(551): a, c, t, g, unknown or other
  misc_feature (548)..(551): n is a, c, g, or t
  modified_base (553)..(553): a, c, t, g, unknown or other
  misc_feature (553)..(553): n is a, c, g, or t
  modified_base (557)..(558): a, c, t, g, unknown or other
  misc_feature (557)..(558): n is a, c, g, or t
  modified_base (560)..(560): a, c, t, g, unknown or other
  misc_feature (560)..(560): n is a, c, g, or t
  modified_base (563)..(563): a, c, t, g, unknown or other
  misc_feature (563)..(563): n is a, c, g, or t
tcagtagtgtagatcacgaccggtgctcgatttagacgtctcatcaagggaacggaagggaactggagtcgggtctcaggtattcggtggcgagtggtgagaccacanactacgcagactccgtgaagggtccggttcgaccatcctccagagaacaattccaagaaccaccctcgtctctgcaaatgaacgaacctgagagccgagacgccggccctagtatactgtaacgaaaattcgacctacggatactgaactactagttaggctaggtacttcgagtctcgtgggcgtggcacctggtaccactcgtcgtcctnacggtctccacgaacggccatccggtcctcccgtgaccgtcctagcctaccgngtaacgcacctacggaacgtcgcaccggagccggtcccgtgcgtcgaacccgtggtacgaaacgtacggtaccttcggaactaaacccggtataaccttcgggaagggtccgtgaacgggtnaaccggaggctttaacgggnacncnncngntacgntnnngngnnnngngnngnnnngncgcnncncgnc

SEQ ID NO: 255275 - DNA, 739 bp, Homo sapiens
  misc_feature: GYAE6OF02HHSM2.37.1.A01.1.454.CMB.1.raw
  modified_base (658)..(658): a, c, t, g, unknown or other
  misc_feature (658)..(658): n is a, c, g, or t
  modified_base (666)..(666): a, c, t, g, unknown or other
  misc_feature (666)..(666): n is a, c, g, or t
  modified_base (671)..(671): a, c, t, g, unknown or other
  misc_feature (671)..(671): n is a, c, g, or t
  modified_base (692)..(692): a, c, t, g, unknown or other
  misc_feature (692)..(692): n is a, c, g, or t
  modified_base (707)..(707): a, c, t, g, unknown or other
  misc_feature (707)..(707): n is a, c, g, or t
  modified_base (712)..(712): a, c, t, g, unknown or other
  misc_feature (712)..(712): n is a, c, g, or t
tcagtagtgtagatcacgaccggtgctcgatttagacgtctcatctaagggtaagggaagggactggagtgggtcttcgacggtattgggtacggcagtaggtcgagaccacatactacgctacgacctccgtgaagggccggttcgaccactctccacgagacgaattccaagaacgaccctggtactctagccaatgaaccaaccctggagagccggtaggaccgacggaccctatacttactcgtacgaaaacgttggccgtaacgggactaatcgaacgtacttagttggggaccttacggtaactttcggacttcgtaccgtaggggcctagggccaccccgtgggtcctacgtcggtcctaccgtctacgcccttaccaccggtaagggcccctaacgtccgggttccccttacccccggtcgggtacccgtccccgtagtccccgtaccgtaacggggtacgtacccgtaacccggtccgggtaagggtaacggccccggtaaacgaaacggtcccggggttacccgtttcgggccctaccggtcccgttaggggtacccgaaacgggtaccttacccgttacccgtataccgtaccgtaacgtacgttagtacgggaccgggtcgttagacgacggaccgacaagtacgntatcgtancgtantctagcgtagacgtcgagtcncgtactacgcttagngtacngtaccgatcgctactactcgtacgtcg

SEQ ID NO: 255276 - DNA, 477 bp, Homo sapiens
  misc_feature: GYAE6OF02IQZJ7.37.1.A01.1.454.CMB.1.raw
  modified_base (350)..(350): a, c, t, g, unknown or other
  misc_feature (350)..(350): n is a, c, g, or t
  modified_base (382)..(382): a, c, t, g, unknown or other
  misc_feature (382)..(382): n is a, c, g, or t
  modified_base (461)..(477): a, c, t, g, unknown or other
  misc_feature (461)..(477): n is a, c, g, or t
tcagtagtgtagatcacgaccggtgctcgatttagacgtctcatcaaaggaaggaagggactggagtgggtctcaggtattggtggcagtggtgagaccacatactacgcagactccgtgaagggccggttcaccatctccagagacaattccaagaacaccctgtctctgcaaatgaaacaacctgagagccgaggacacgaccctaatattactgtaacgaaaatgcctaggatatgactactagttggactggtacttcgatctcgtggggccgtggccacccctggtcactgtcctcctcacgccctccaccgaagggccccagtccggtccttcccccgtggccncccgttgcctccgaggcgaccacctcgagacncacacgcgccgtggctgcctggtccaagtctactccaatctacacgtactgacggtcggcgtggacaaggcgacatagnnnnnnnnnnnnnnnnn

SEQ ID NO: 255277 - DNA, 484 bp, Homo sapiens
  misc_feature: GYAE6OF02GK0OI.37.1.A01.1.454.CMB.1.raw
  modified_base (172)..(172): a, c, t, g, unknown or other
  misc_feature (172)..(172): n is a, c, g, or t
  modified_base (461)..(461): a, c, t, g, unknown or other
  misc_feature (461)..(461): n is a, c, g, or t
  modified_base (472)..(472): a, c, t, g, unknown or other
  misc_feature (472)..(472): n is a, c, g, or t
  modified_base (474)..(484): a, c, t, g, unknown or other
  misc_feature (474)..(484): n is a, c, g, or t
tcagtagtgtagatcacgaccggtgctcgatttagacgtctcatcaaggaagggaagggactggagtgggtctcaggtattggtggcagtggtgagaccacatactacgcagactccgtgaagggccggttcaccatctccagagacaattccaagaacaccctgcttttcngcaaatgaacaacctgagagccgaggacaccggccctatattactgtaacgaaaatggcctacggatatgactactattgggactggtactcgatctctgggccgtggcaccctggtcactgtctcctcacgccctccaccgaacgggcccctatccgggtccttccccccgtgggccgccccgtgcctcccgaagggcgaccaccgtccggagacgccaacacggccggcccgtggggcctgcccgtggtaccaaggtactacttccatctacactactgagcgggcnggcaggcgcanannnnnnnnnnn

SEQ ID NO: 255278 - DNA, 604 bp, Homo sapiens
  misc_feature: GYAE6OF02HY6LC.37.1.A01.1.454.CMB.1.raw
  modified_base (256)..(256): a, c, t, g, unknown or other
  misc_feature (256)..(256): n is a, c, g, or t
  modified_base (388)..(388): a, c, t, g, unknown or other
  misc_feature (388)..(388): n is a, c, g, or t
  modified_base (504)..(504): a, c, t, g, unknown or other
  misc_feature (504)..(504): n is a, c, g, or t
  modified_base (557)..(557): a, c, t, g, unknown or other
  misc_feature (557)..(557): n is a, c, g, or t
  modified_base (568)..(568): a, c, t, g, unknown or other
  misc_feature (568)..(568): n is a, c, g, or t
  modified_base (576)..(577): a, c, t, g, unknown or other
  misc_feature (576)..(577): n is a, c, g, or t
  modified_base (580)..(581): a, c, t, g, unknown or other
  misc_feature (580)..(581): n is a, c, g, or t
  modified_base (584)..(586): a, c, t, g, unknown or other
  misc_feature (584)..(586): n is a, c, g, or t
  modified_base (590)..(593): a, c, t, g, unknown or other
  misc_feature (590)..(593): n is a, c, g, or t
  modified_base (595)..(600): a, c, t, g, unknown or other
  misc_feature (595)..(600): n is a, c, g, or t
  modified_base (602)..(604): a, c, t, g, unknown or other
  misc_feature (602)..(604): n is a, c, g, or t
tcagtagtgtagatcacgaccggtgctcgatttagacgtctcatcaaaggaaagggaagggactggagtgggtctcaggtattggtggcagtggtgagaccacatactacgcagactccgtgaagggccggttcaccatctccagggacaattccaagaacacactgtctctgacaaatgaacagcctgagagtcgaggacacggccttatattactgtgtagaacgggcctctacgtcccttaagagcaggcggntcggtcgtgtactttggacgcgtgggccagggaaccctggtcaccgtctctcgacgtccctaccaaccgaacggccctacgtccggttacccttcccccgtcggccgtcccctgcccgtaccgacggggacncccaaccggtcgaacgcggactaccgacggcccggacccggtgggtcctacggccgttacggaacgtaacgggtaccttactacccgtacttaccgtaactaaccttagaaccggngggtacccgggtcgtacgggaaaccggaaccgggcctaaccgtaaggtacgancgacgttcgancgatgacnncgnngcnnnctgnnnncnnnnnncnnn

SEQ ID NO: 255279 - DNA, 517 bp, Homo sapiens
  misc_feature: GYAE6OF02GDZ92.37.1.A01.1.454.CMB.1.raw
  modified_base (478)..(478): a, c, t, g, unknown or other
  misc_feature (478)..(478): n is a, c, g, or t
  modified_base (480)..(487): a, c, t, g, unknown or other
  misc_feature (480)..(487): n is a, c, g, or t
  modified_base (489)..(517): a, c, t, g, unknown or other
  misc_feature (489)..(517): n is a, c, g, or t
tcagtagtgtagatcacgaccggtgctcgatttagacgtctcatcagggccaatcagagtgtttaatagtaacttagcctggtaccagcagaaacctgcccaggctcccaggctcctcatgtatggtgcatccaccagggccactggtatcccagccagggttcaggtggcaggtgggactgggacagagttcagtactaacatcagcacgtcctgcgtagtctaggtaagttagttttgggtatttttattttctgtcagctaagttagttacgttcctcggccgttacgggtccgttcgggaccccgaggggaaccctaagggtacggaaataccgaaacggtacgtggtcggtctcggacctaacctattcttcgtcttactacttccgttacccgcctactcttacgaacttcctaacctacttacggtacggacgggtccgggcgttacggacggaacggtcgactaagtagngnnnnnnnngnnnnnnnnnnnnnnnnnnnnnnnnnnnnn

SEQ ID NO: 255280 - DNA, 484 bp, Homo sapiens
  misc_feature: GYAE6OF02HSRD2.37.1.A01.1.454.CMB.1.raw
  modified_base (143)..(143): a, c, t, g, unknown or other
  misc_feature (143)..(143): n is a, c, g, or t
  modified_base (170)..(170): a, c, t, g, unknown or other
  misc_feature (170)..(170): n is a, c, g, or t
  modified_base (190)..(190): a, c, t, g, unknown or other
  misc_feature (190)..(190): n is a, c, g, or t
  modified_base (304)..(304): a, c, t, g, unknown or other
  misc_feature (304)..(304): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
  modified_base (368)..(368): a, c, t, g, unknown or other
  misc_feature (368)..(368): n is a, c, g, or t
  modified_base (370)..(370): a, c, t, g, unknown or other
  misc_feature (370)..(370): n is a, c, g, or t
  modified_base (449)..(449): a, c, t, g, unknown or other
  misc_feature (449)..(449): n is a, c, g, or t
  modified_base (454)..(459): a, c, t, g, unknown or other
  misc_feature (454)..(459): n is a, c, g, or t
  modified_base (461)..(484): a, c, t, g, unknown or other
  misc_feature (461)..(484): n is a, c, g, or t
tcagtagtgtagatcacgaccggtgctcgatttagacgtctcatcaaggaagggaagggactggagtgggtctcaggtattggtggcagtggtgagaccacatactacgcagactccgtgaagggccggttcaccatctccanagacaattccaagaaccaccctgtctntgcaaatgaacaacctgagngccgaggacaccggtccctaatattactgtaacgaaaaagtcggacctacggatatgactactagttggactggtacttgatctcgtggccgtgcaccgtgtcatctcctctcncgcctaccaccgtacggcccagtccgtacctccccgngccncctgctccgagcnctcncgagcncnacgcgcctggctcgcgtgacaggacctctcactcgtaacctactcgtagcggtcggtcgaggtacgacggcgacgtaancggtnnnnnncnnnnnnnnnnnnnnnnnnnnnnnn

SEQ ID NO: 255281 - DNA, 771 bp, Homo sapiens
  misc_feature: GYAE6OF02FQ981.37.1.A01.1.454.CMB.1.raw
  modified_base (88)..(88): a, c, t, g, unknown or other
  misc_feature (88)..(88): n is a, c, g, or t
  modified_base (671)..(671): a, c, t, g, unknown or other
  misc_feature (671)..(671): n is a, c, g, or t
tcagtagtgtagatcacgaccggtgctcgatttagacgtctcatcaagggaagggaagggactggagtgggtctcaggtattggtggnagtggtgagaccacatactacgcagactccgtgaagggccggttcaccatctccagagacaattccaaagaacaccctgtctctgacaaatgaacaaccgtgagagaccggaggacaccggccctattattactagtaacgaaaatcgggacctacggatattagaactacgttaattagggacgtggttacttacgattcgtcggtcggggtccggtcggtccgtacccttggtcctactcgttcctcctacgacgtacccctaccaaccgaaccgggccttaagttccggtcccttttaccccccggcggcccgtaccccttggtacctaccgagggaccgcctaacccgtccgaaggaccgccgaaccgacgggccggtcccgtacggggtccgtacggtacccgttacgggtaacctaaacgacccgtttaacccgttacccgtaacgttacccctttaaaccgtaaaccgttaaccgggttaaccggaacggggtacccggggtaacggtaccgggtaacccgtaacggggacccgtaaccggtaaacgttacggtaagacccgttagacgtaccgancgacgacgacgtacatacggtactaccgtacgtcgacgtaccgtacgtacggttacggtacgacgacgtaccgttaccaccgtaccgtacgtaccgtacg

SEQ ID NO: 255282 - DNA, 480 bp, Homo sapiens
  misc_feature: GYAE6OF01C2R41.11.3.A03.1.454.CMB.1.raw
  modified_base (351)..(351): a, c, t, g, unknown or other
  misc_feature (351)..(351): n is a, c, g, or t
  modified_base (471)..(480): a, c, t, g, unknown or other
  misc_feature (471)..(480): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattccggccctcaggggtccctgaccgattctctggttccttgtctgaccacctcagcctccctggccatcactgggctccagcctgaggatgagctgattattactgtcagttcctttgactattaaacnggatgtggtattcgggcggaggacccacgtaaccgtctagtcacgcccaaggctcgccccctcggtcactctcgtcccaccctcctcgtactctctcgctgagcggctggcagcgcatgnnnnnnnnnn

SEQ ID NO: 255283 - DNA, 479 bp, Homo sapiens
  misc_feature: GYAE6OF01BCHAP.11.3.A03.1.454.CMB.1.raw
  modified_base (466)..(466): a, c, t, g, unknown or other
  misc_feature (466)..(466): n is a, c, g, or t
  modified_base (470)..(479): a, c, t, g, unknown or other
  misc_feature (470)..(479): n is a, c, g, or t
tcagcgagagataccacgaccggtgctcgatttagagagcgtcacagggtcctgggcccagtctgtgctgacgcagccgccctcagtgtctgggccccagggcagacggtcaccatctcctgcactggaaacagctccaacgtcggggcaggttatgatgttcactggtaccagcaccttccacaaacagcccccaaactcctcatatatggtaacagcattcggccctcgaggggtccctgaccgattctctggttccttgtctgacacctcagccctcctgccatcactggctccagcctgaggatgaggctgattattactgtcagttcctttgactaattaaactgatgtgtatcggcgagggacccacgtaccgtccgtagtcagccaaggctcgccccctcggtcactctcgtcccaccctcctcgtactctctccgctcgacggcggctggacaggccnatgnnnnnnnnnn

SEQ ID NO: 255284 - DNA, 476 bp, Homo sapiens
  misc_feature: GYAE6OF01AZG5P.11.3.A03.1.454.CMB.1.raw
  modified_base (347)..(347): a, c, t, g, unknown or other
  misc_feature (347)..(347): n is a, c, g, or t
  modified_base (467)..(476): a, c, t, g, unknown or other
  misc_feature (467)..(476): n is a, c, g, or t
tcagcgagagataccacgaccggtgctcgatttagagagcgtcacagggtcctgggcccagtctgtgctgacgcagccgccctcagtgtctgggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaacnggatgtggtattcgggcggagggaccccacgtaaccgtcctaggtcagcccaaggcctcgcccccctcggtcacttctcgttcctatcctctcgctgagcgggctggcaaggcgcatagnnnnnnnnnn

SEQ ID NO: 255285 - DNA, 476 bp, Homo sapiens
  misc_feature: GYAE6OF01DIAZT.11.3.A03.1.454.CMB.1.raw
  modified_base (349)..(349): a, c, t, g, unknown or other
  misc_feature (349)..(349): n is a, c, g, or t
  modified_base (469)..(476): a, c, t, g, unknown or other
  misc_feature (469)..(476): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctcctggccatcactgggctccagcctgaggatgaggctgattattactgtcagttcctttgactattaaacngatgtggtattcggcggaggacccacgtaaccgtctagtcacgcccaaggctcgcccctcggtcactctcgttcccgccctcctcgtactctctcgctgagcggctggcaggcgcagtgnnnnnnnn

SEQ ID NO: 255286 - DNA, 576 bp, Homo sapiens
  misc_feature: GYAE6OF01CLLVY.11.3.A03.1.454.CMB.1.raw
  modified_base (190)..(190): a, c, t, g, unknown or other
  misc_feature (190)..(190): n is a, c, g, or t
  modified_base (557)..(558): a, c, t, g, unknown or other
  misc_feature (557)..(558): n is a, c, g, or t
  modified_base (562)..(562): a, c, t, g, unknown or other
  misc_feature (562)..(562): n is a, c, g, or t
  modified_base (565)..(576): a, c, t, g, unknown or other
  misc_feature (565)..(576): n is a, c, g, or t
tcagcgagagataccacgaccggtgctcgatttagagagcgtcacagggtccgtgggcccagtctgtgctgacgccagccgccctcagtgtctgggccccagggcagacggtcaccatctcctgcactggaaacagctccaacgtcggggcaggttatgatgtcactggtaccagcaccttccacaaacngacccccaaactcctcatatatgggtaacagcattccggccctcgacggggtccctgaccgattcctcttggttccttgtctgacactcagtccctcctgccatcagtcgggcctccagcctgagagtgaggctgtagttacttacgtgtcctagttccctttagacgtaaatttaaacgtggtatggtaggtattcggggacgaacgggtacccctaacggtaaccgtccgtaaggtccgacggtacccaagggtcctccggaccccccgttcggtacccaacgttcgttacccgttccccgaccccttccgtcgtactccttactccgcttgacggtcggacgtgggaacaggtccgatagagcnngtcnagnnnnnnnnnnnn

SEQ ID NO: 255287 - DNA, 671 bp, Homo sapiens
  misc_feature: GYAE6OF01CAGPB.11.3.A03.1.454.CMB.1.raw
  modified_base (361)..(361): a, c, t, g, unknown or other
  misc_feature (361)..(361): n is a, c, g, or t
  modified_base (656)..(656): a, c, t, g, unknown or other
  misc_feature (656)..(656): n is a, c, g, or t
  modified_base (659)..(671): a, c, t, g, unknown or other
  misc_feature (659)..(671): n is a, c, g, or t
tcagcgagagataccacgaccggtgctcgatttagagagcgtcacagggtcctgggcccagtctgtgctgacgcagccgccctcagtgtctgggccccagggcagacggtcaccatctcctgcactggaaacagctccaacgtcggggcaggttatgatgttcactggtaccagcaccttccacaaacacgccccaaactcctcatatatggtaacagcattccggccctcacggggtccctgaccgattctctggttccttgtctgacactcacgcctcctgccatccacgtgggcctccagcctgagtatgaggctgtattattactgtctagttcctttagaactaagtttaaaacgnggtattggttagggttaacgtttccggggaccggtaaccggggtaaccccgtaaccggtttaaaccccggttccgttaacgggttacccgaaccggaccccgtaaacgggtcccgttccggcccccccgttacgggttaccctaacccgtttcccgttcccggtttcccccccgtcccctttccccgttacccggttaccttcccgttaccgttccggtccgtcgggtaaccgggtcccggggtacccgttcggggacccgtaaacggggcccgtacgtaacgttacggctcgcngcnnnnnnnnnnnnn

SEQ ID NO: 255288 - DNA, 485 bp, Homo sapiens
  misc_feature: GYAE6OF01DKP6E.11.3.A03.1.454.CMB.1.raw
  modified_base (349)..(349): a, c, t, g, unknown or other
  misc_feature (349)..(349): n is a, c, g, or t
  modified_base (468)..(468): a, c, t, g, unknown or other
  misc_feature (468)..(468): n is a, c, g, or t
  modified_base (470)..(485): a, c, t, g, unknown or other
  misc_feature (470)..(485): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaatcctcatatatggtaacagcattccggccctcaggggtccctgaccgattctctggttccttgtctgacacctcagccctcctgccatcactgggctccagcctgaggatgagctgattattactgtcagttcctttgaactattaaacnggatgtggtattcgggcggaggacccagtaccgtctaggtcacgccagctcgccccctcgtcactctcgttaccgccctctcgtactctctcgctgacgcggctggacacggcacatgngnnnnnnnnnnnnnnnn

SEQ ID NO: 255289 - DNA, 500 bp, Homo sapiens
  misc_feature: GYAE6OF01AND85.11.3.A03.1.454.CMB.1.raw
  modified_base (487)..(500): a, c, t, g, unknown or other
  misc_feature (487)..(500): n is a, c, g, or t
tcagcgagagataccacgaccggtgctcgatttagagagcgtcacagggtcctgggcccagtctgtgctgacgcagccgccctcagtgtctgggccccagggcagacggtcaccatctcctgcactggaaacagctccaacgtcggggcaggttatgatgttcactggtaccagcaccttccacaaacagcccccaaactcctcatatatggtaacagcattcggccttcaggggtccctgaccggttctctggctccaagtctggctcttccgcctccttggccatcactgggctcgaggctgacgatgaggctgattactactgtctgtcctatcgacgacgacctacagtaccttccggttttcggcggagggacctaaagctgaccgtcctaagtcacgcccaaggcctcgccccctggtccactcctcgttcccacccctcctcgtactcctctcgctgacgcgggctggacaggcgcatgnnnnnnnnnnnnnn

SEQ ID NO: 255290 - DNA, 812 bp, Homo sapiens
  misc_feature: GYAE6OF01CUARG.11.3.A03.1.454.CMB.1.raw
  modified_base (777)..(777): a, c, t, g, unknown or other
  misc_feature (777)..(777): n is a, c, g, or t
  modified_base (783)..(783): a, c, t, g, unknown or other
  misc_feature (783)..(783): n is a, c, g, or t
  modified_base (789)..(789): a, c, t, g, unknown or other
  misc_feature (789)..(789): n is a, c, g, or t
  modified_base (805)..(806): a, c, t, g, unknown or other
  misc_feature (805)..(806): n is a, c, g, or t
  modified_base (808)..(808): a, c, t, g, unknown or other
  misc_feature (808)..(808): n is a, c, g, or t
  modified_base (811)..(811): a, c, t, g, unknown or other
  misc_feature (811)..(811): n is a, c, g, or t
tcagcgagagataccacgaccggtgctcgatttagagagcgtcacagggtccgtggggcccagtctgtgctgacgcagcccgccctcagtgtcgtcggggccccagggcagacggtcaccatcctcctgcactggaaacagctccgaacggtcggggctaggttatgatgtcactggtaccagcctacccttccaacaaaccacgacccccaaactcctacaatatagtaggtaacagctacgttccggaccctcggacggggtccctggaaccgtattctcgtggttccttgtctcgactacctcacgccctccgtggacctactccgtacgtcgggtcctccgtacgccgtggaacggtagtcggtaacggtcttaggtaactttacgttaaccgttggttaccgttacggtttaccctttaacggaaacctttaaacgtttaaaaccggtggggttaaatttacggggtttaacggggttaccggtttcccgggggggaaacccgggtaacccggggttaaaccccgtaaccggggtttaaaaccccggtttcccggtaaggggttaccccgaacgggttaacccccgtaaacggggttccccgttaccccggtcccccccggttaccgggtacccttaaccggttccctttacccccggttacccccctaacccgttcccgtaaccgttaccttcccgttccgtaccgtccggttacggaaccgggtcccgggtcgtaccgggtaacggaacgggccgtacgtaacgttacgngtccgngcgcgnacgcgcgcgcgtcacnncngcnc

SEQ ID NO: 255291 - DNA, 647 bp, Homo sapiens
  misc_feature: GYAE6OF01C7DYK.11.3.A03.1.454.CMB.1.raw
  modified_base (322)..(322): a, c, t, g, unknown or other
  misc_feature (322)..(322): n is a, c, g, or t
  modified_base (338)..(338): a, c, t, g, unknown or other
  misc_feature (338)..(338): n is a, c, g, or t
  modified_base (367)..(367): a, c, t, g, unknown or other
  misc_feature (367)..(367): n is a, c, g, or t
  modified_base (624)..(624): a, c, t, g, unknown or other
  misc_feature (624)..(624): n is a, c, g, or t
  modified_base (629)..(629): a, c, t, g, unknown or other
  misc_feature (629)..(629): n is a, c, g, or t
  modified_base (632)..(633): a, c, t, g, unknown or other
  misc_feature (632)..(633): n is a, c, g, or t
  modified_base (635)..(635): a, c, t, g, unknown or other
  misc_feature (635)..(635): n is a, c, g, or t
  modified_base (637)..(639): a, c, t, g, unknown or other
  misc_feature (637)..(639): n is a, c, g, or t
  modified_base (641)..(647): a, c, t, g, unknown or other
  misc_feature (641)..(647): n is a, c, g, or t
tcagcgagagataccacgaccggtgctcgatttagagagcgtcacagggtcctgggcccagtctgtgctgacgcagccgccctcagtgtctgggccccagggcagacggtcaccatctcctgcactggaaacagcctccaacgtcggggcaggttatgatgtcactggtaccagccaccttccacaaacacgcccccaaactcctcatatatggtaacagcattccggccctcgacggggtccctgacccgatttcctcgttggttccttgtctgacacctcagccctcccgtggccatcacgtcggcctccagcctgacgntgagctgattattacngtcacgtttccttagacctaatttaaacnggtaactggttaggtacttcgggaacgggtacgggtaaccccacggttaaacccgtccgtaggtaccgaacgacccgtaacggccttacccgccccccgttacgggtacctaacccgttcctttacccggtttccccccggtcccctttaccccgttcccggtttaacttcccctttcccgttccggtaccttacggggaccgggtcccggggtaccgttacgggaaccggtaacggggcccgacgtaacgtacggncgcgngcnncncnnncnnnnnnn

SEQ ID NO: 255292 - DNA, 576 bp, Homo sapiens
  misc_feature: GYAE6OF01AZPZT.11.3.A03.1.454.CMB.1.raw
  modified_base (286)..(286): a, c, t, g, unknown or other
  misc_feature (286)..(286): n is a, c, g, or t
  modified_base (337)..(337): a, c, t, g, unknown or other
  misc_feature (337)..(337): n is a, c, g, or t
  modified_base (558)..(559): a, c, t, g, unknown or other
  misc_feature (558)..(559): n is a, c, g, or t
  modified_base (561)..(576): a, c, t, g, unknown or other
  misc_feature (561)..(576): n is a, c, g, or t
tcagcgagagataccacgaccggtgctcgatttagagagcgtcacagggtcctgggcccagtctgtgctgacgcagccgccctcagtgtcgtgggccccgagggcagacggtcaccatctcctgcactaggaaacagctaccaacggtcggggctaggttatgatgttcacgtggtaccagcaccttccaacaaacacgcccccaaactcctcatatataggtaacagcattccggccctcgacggggtccctgaccgtattctctggttccttgtctgacacctnacgtccctccgtggcctactcaccgtcgggcctccgacgccgtggaaggtntaggaggtctagtaatttattacgtgtctacgtttccttagactaattaacgtggtatgttggttacgtcgggacggtacggaccctaacgtaccgtcgtagtccacgccgagcctccgtccccgtcgtcctacttccgtccgtcccgtccctcctcgtactccttcgtccgtcgtcggacggccgggtacgtcggaccgaacgggtccgacgtagtacgnngnnnnnnnnnnnnnnnn

SEQ ID NO: 255293 - DNA, 540 bp, Homo sapiens
  misc_feature: GYAE6OF01DONAJ.11.3.A03.1.454.CMB.1.raw
  modified_base (369)..(369): a, c, t, g, unknown or other
  misc_feature (369)..(369): n is a, c, g, or t
  modified_base (524)..(540): a, c, t, g, unknown or other
  misc_feature (524)..(540): n is a, c, g, or t
tcagcgagagataccacgaccggtgctcgatttagagagcgtcacagggtcctgggcccagtctgtgctgacgcagccgccctcagtgtctgggccccagggcagacggtcacccatctcctgcactggaaacagctccaacgtcggggcaggttatgatgttcactggtaccagcaccttccaacaaacacgccccccaaactcctcatatatggtaacagcattccggccctcgacggggtcccctgaccgtattctcgttggttccttgtctgaccacctcacgcctccctgccatccactggcctccagtcctggaggatggaggctgtatttattactgtctagtcctttgactaattaaacgnggatggtggtagttcggcgggtacggaccctacgtaaccgtcgtaggtcacgcccgaaggtcctccggtccccctcggctaccgtcctccgtccccacccttcctcgtactctcctcgtctggacgccgggacgtcggacgaaggccacgatagnnnnnnnnnnnnnnnnn

SEQ ID NO: 255294 - DNA, 668 bp, Homo sapiens
  misc_feature: GYAE6OF01CR0RQ.11.3.A03.1.454.CMB.1.raw
  modified_base (198)..(198): a, c, t, g, unknown or other
  misc_feature (198)..(198): n is a, c, g, or t
  modified_base (292)..(292): a, c, t, g, unknown or other
  misc_feature (292)..(292): n is a, c, g, or t
  modified_base (652)..(668): a, c, t, g, unknown or other
  misc_feature (652)..(668): n is a, c, g, or t
tcagcgagagataccacgaccggtgctcgatttagagagcgtcacagggtcctgggcccagtctgtgctgacgcagccgccctcagtgtcgtcggggccccagggcagacggtcaccatctcctgcactggaaacagcctccaacggtcggggcaggttatgattgttcactggtaccagccaccttccaacaaaccncgacccccaaactcctcatactataggtaacagcagttccggccctcgacggggtccctaggacctattctcgttcggttccttgtctcgaccncctcacgtccctccgtcgccactccacgtcgggcctccgagtcctggacgagtggacggtctagtaacttactacgtggtactacggtttacctttagaacttaaacgtttaaacggtggttaaacgttggttagggttaaccggttcgggggtaaccgggaacccgggtaaccccgtaaccggttaaaccccggttccgttaacgggcccgtaaccggacccgtaacgggtccccgtacccggtaccccccgttcgggtaccctaccgttccgtcccgttcccccgcccttaccgtcgtacctccgtctaccgtcgtacggacgggccggtctacggccgtaacggccgtacagtagcnnnnnnnnnnnnnnnnn

SEQ ID NO: 255295 - DNA, 573 bp, Homo sapiens
  misc_feature: GYAE6OF01AVHJK.11.3.A03.1.454.CMB.1.raw
  modified_base (553)..(553): a, c, t, g, unknown or other
  misc_feature (553)..(553): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (559)..(561): a, c, t, g, unknown or other
  misc_feature (559)..(561): n is a, c, g, or t
  modified_base (563)..(573): a, c, t, g, unknown or other
  misc_feature (563)..(573): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgcccccaaactcctcatatataggtaacagctattccggccctcgacgggtccctgaccgtattcgtcttcggtttccttgtctcgaccaccctcacgccctcccgtcggcctactccacgtcgggcctccgagtcctggacggtatggacgtctagtaactttagttactgtactacgttcctttagaactaacttaaacgtggtattggtaggtcgttcgggacggtacggaccctacggtaccgtcgtaggtcacgacctaacggcctccgcccccgtgtaccacttccgtccgttcccctaccctcctcgtactccttctccgtcgtcgacggtcggcgtcgacgacggcgatagagntnangnnntnnnnnnnnnnn

SEQ ID NO: 255296 - DNA, 629 bp, Homo sapiens
  misc_feature: GYAE6OF01ESNOY.11.3.A03.1.454.CMB.1.raw
  modified_base (617)..(617): a, c, t, g, unknown or other
  misc_feature (617)..(617): n is a, c, g, or t
  modified_base (624)..(629): a, c, t, g, unknown or other
  misc_feature (624)..(629): n is a, c, g, or t
tcagcgagagataccacgaccggtgctcgatttagagagcgtcacagggtcctgggcccagtctgtgctgacgcagccgccctcagtgtctgggccccagggcagacggtcaccatctcctgcactggaaacagctccaacgtcggggcaggttatgatgttcactggtaccagcaccttccacaaacacgcccccaaactcctcatatataggtaaacagctacttccggccctcgacgggggtccctagacccgtattcctcttcggtttccttgtctcgacctacctcacgccctccctggccactcgacgttcgggcctccagtctgatgatggaggctagtaatttacttactgtcgcagcagtgggatcgactacctagtagttcggtctttggttggtttcgggtttcgggacgggtacgggtaaccgaaggtccgtacggtacccgttacgtacggtccgaacgacccggtaagtcccgtcccgccccgttcggtcctaccgttccctacccgttcccctaacccgttccctaccgttactcccttaccgttccgtaccgtacgggaccgtcggggtaccgtcggaccgtacggccggtacagtcgacncgatcgnnnnnn

SEQ ID NO: 255297 - DNA, 716 bp, Homo sapiens
  misc_feature: GYAE6OF01D10X1.11.3.A03.1.454.CMB.1.raw
  modified_base (262)..(262): a, c, t, g, unknown or other
  misc_feature (262)..(262): n is a, c, g, or t
  modified_base (691)..(691): a, c, t, g, unknown or other
  misc_feature (691)..(691): n is a, c, g, or t
  modified_base (697)..(697): a, c, t, g, unknown or other
  misc_feature (697)..(697): n is a, c, g, or t
  modified_base (701)..(716): a, c, t, g, unknown or other
  misc_feature (701)..(716): n is a, c, g, or t
tcagcgagagataccacgaccggtgctcgatttagagagcgtcacagggtcctgggcccagtctgtgctgacgcagccgccctcagtgtcgtcgggccccagggcagacggtcaccatctcctgcactggaaacagctccgaaggtcggggcaggttatgatgttcactggtaccagcctaccttaccaacaaacaccgacccccaaactcctacatatataggtaacagactacgttccggccctacggacggggttcccncgaccgtatttccgttcgttcggtttcctttgtcttacgacctaccttccacgtccctccgtcggaccattccgacgtcgggtcccaccgtacgccgttaggacggtataggacggtctttagtaacttttaacgttaccgtggttacccttacgtttaccgttaacgtaaaccttaaagtttaaaccgtggttaagttcggttaacgggttacggtccgggggaacggtaacccggggtaaacccctaacgggtttaacccgttaccggtaacgggttaccgaacccggacccggtaaccgtccccgttaccccgggtacccccgtttccgggtacctacccgttcccgtttcccgtaccccccgtaccttcccgttacgtacccttcgttcgtcgcgtggaccgcgggtctacggacgtaacgcganacgtgnacgnnnnnnnnnnnnnnnn

SEQ ID NO: 255298 - DNA, 616 bp, Homo sapiens
  misc_feature: GYAE6OF01A52UK.11.3.A03.1.454.CMB.1.raw
  modified_base (598)..(598): a, c, t, g, unknown or other
  misc_feature (598)..(598): n is a, c, g, or t
  modified_base (601)..(601): a, c, t, g, unknown or other
  misc_feature (601)..(601): n is a, c, g, or t
  modified_base (603)..(616): a, c, t, g, unknown or other
  misc_feature (603)..(616): n is a, c, g, or t
tcagcgagagataccacgaccggtgctcgatttagagagcgtcacagggtcctgggcccagtctgtgctgacgcagccgccctcagtgtctgggccccagggcagacggtcaccatctcctgcactggaaacagctccaacgtcggggcaggttatgatgttcactggtaccagcaccttccacaaacagcccccaaactcctcatatatggtaacagcattccggccctcgacggggtccctgaccgattctcttggttccttgtctgacacctcacgtcctcctggccatccacgtgggcctccgacgcctggacggatggaggtctagtatttattactgttcaacgtttccgttagaactaagtttaaaacgtggtactttggtcggttaacgttcggggtaccgggaacggggacccctaacggttaacccgttcgtacggtacgaccgacccgtaagggccttacccggtcccccgtcggtccctaccgtaccgttccggttcccccgtaccccttcccgtacgttactcccttccgtccgtcgtcgaccggtccggtccgtcgggaccaacgggccgacgtaagtacggtnctngnnnnnnnnnnnnnn

SEQ ID NO: 255299 - DNA, 795 bp, Homo sapiens
  misc_feature: GYAE6OF01EPB9R.11.3.A03.1.454.CMB.1.raw
  modified_base (133)..(133): a, c, t, g, unknown or other
  misc_feature (133)..(133): n is a, c, g, or t
  modified_base (778)..(778): a, c, t, g, unknown or other
  misc_feature (778)..(778): n is a, c, g, or t
  modified_base (787)..(788): a, c, t, g, unknown or other
  misc_feature (787)..(788): n is a, c, g, or t
  modified_base (790)..(790): a, c, t, g, unknown or other
  misc_feature (790)..(790): n is a, c, g, or t
  modified_base (795)..(795): a, c, t, g, unknown or other
  misc_feature (795)..(795): n is a, c, g, or t
tcagcgagagataccacgaccggtgctcgatttagagagcgtcacagggtcctgggcccagtctgtgctgacgcagccgccctcagtgtctgggccccagggcagacggtcaccatctcctgcactggaaacngctccaacgtcgggcaggttatgatgttcactggtaccagccaccttccaacaaacacgacccccaaaactcctcaatatactaggtaacagctaacttccggccctcgacggggttcccctggcccgtatttcctcgtcggcttaccggaagttccgtggcctaccttcgaccgcccttccctgggccccttggccgtaggtcggggccttacccgagttccgtaggacggaagttcgggacggtctacggtaacctttaattttaggttcggttacgaccgtaaggttccgggtagggtacgtcgggtaaccggttttcgtacgggtaggttcggtcggtttgggttccgggtttaccggtttaccgggggaaccgggtaacggggtaaccccgaaacgggttcccgttaccgggtaccccgggtttaccggttcggggtacccgaccggaccccgtaaacgggtccccgttacccggtccccccgttacgggttaccctacccgtttccgttaccccggtttccccccgaccctttccccggtttaccgttaccgttcccgtttcccgtacgttccgttacgggtacccggggtccgggtccgtaccgggtaccgaaaccgggtcggtacgtaggttaagcntcgcatacnncncgtgn

SEQ ID NO: 255300 - DNA, 674 bp, Homo sapiens
  misc_feature: GYAE6OF01AML5Q.11.3.A03.1.454.CMB.1.raw
  modified_base (132)..(132): a, c, t, g, unknown or other
  misc_feature (132)..(132): n is a, c, g, or t
  modified_base (213)..(213): a, c, t, g, unknown or other
  misc_feature (213)..(213): n is a, c, g, or t
  modified_base (645)..(645): a, c, t, g, unknown or other
  misc_feature (645)..(645): n is a, c, g, or t
  modified_base (649)..(649): a, c, t, g, unknown or other
  misc_feature (649)..(649): n is a, c, g, or t
  modified_base (653)..(653): a, c, t, g, unknown or other
  misc_feature (653)..(653): n is a, c, g, or t
  modified_base (656)..(656): a, c, t, g, unknown or other
  misc_feature (656)..(656): n is a, c, g, or t
  modified_base (658)..(658): a, c, t, g, unknown or other
  misc_feature (658)..(658): n is a, c, g, or t
  modified_base (662)..(662): a, c, t, g, unknown or other
  misc_feature (662)..(662): n is a, c, g, or t
  modified_base (668)..(669): a, c, t, g, unknown or other
  misc_feature (668)..(669): n is a, c, g, or t
  modified_base (671)..(672): a, c, t, g, unknown or other
  misc_feature (671)..(672): n is a, c, g, or t
tcagcgagagataccacgaccggtgctcgatttagagagcgtcacagggtcctgggcccagtctgtgctgacgcagccgccctcagtgtcgtgggccccagggcagacggtcaccatctctgcatggaaacngctccaacggtcggggctaggttatgattgttcactggtaccagccaccttaccaacaaaccaccgaccccaaactcctanactaatagtcggtaacacgctacgttccggccctcgacgggtccctgtaccgtattcgtcgttcggtttacttgtcgttcgacctcctcgacgtccctccgtcggactacgtcctacggtcggcctccgacgtccgtagacggagtggacggtctagtacttacgttacgtgtactactttccgttaataactaaacgttaacgtggtagttacggttaggtacgttaccgggggacgtacccgggtaaccccgtaacgttaccgtccgtaaggtcctacggacccgtacgtccgtcccgtcccgtcgtcctacctcccggttcccgtaccccgtcccgtaccgtttcgtaccttcccgtacgttccggcgttcgggtacccgggcggttaaccggcgggttaacccgggcggaccgtaccgtaggaccgtntcgntgcngancncagngtcacnncnngc

SEQ ID NO: 255301 - DNA, 637 bp, Homo sapiens
  misc_feature: GYAE6OF01D27WD.11.3.A03.1.454.CMB.1.raw
  modified_base (620)..(637): a, c, t, g, unknown or other
  misc_feature (620)..(637): n is a, c, g, or t
tcagcgagagataccacgaccggtgctcgatttagagagcgtcacagggtcctgggcccagtctgtgctgacgcagccgccctcagtgtctgggccccagggcagacggtcaccatctcctgcactggaaacagctccaacgtcggggcaggttatgatgttcactggtaccagcaccttccaacaaacacgcccccaaactcctcatatataggtaacagcattccggccctcgacggggtccctgaccgtattctcgttggttccttgtctgaccacctcacgccctccgtgccatcacgtgggcctccagcctggacggtatgaggtctagtaatttattactggtctaggtttcctttagaacctaaagtttaaacgtggtaattggttaggtacgttccggggacgggaacgggtaaccccctaacggttaaccccgttccgtaggtaccaacggtaccccgtaacgggtcctcccggtccccccgttcgggtaccctaccgttcccgttacccggttcccccgtccccttcccgttccgttaccgttcccttccgtaccggtccgtacggacgggtcccgggtcgtcgggacgtaacgggccgacgtagtacgnnnnnnnnnnnnnnnnnn

SEQ ID NO: 255302 - DNA, 680 bp, Homo sapiens
  misc_feature: GYAE6OF01BBAZB.11.3.A03.1.454.CMB.1.raw
  modified_base (134)..(134): a, c, t, g, unknown or other
  misc_feature (134)..(134): n is a, c, g, or t
  modified_base (659)..(659): a, c, t, g, unknown or other
  misc_feature (659)..(659): n is a, c, g, or t
  modified_base (662)..(662): a, c, t, g, unknown or other
  misc_feature (662)..(662): n is a, c, g, or t
  modified_base (664)..(664): a, c, t, g, unknown or other
  misc_feature (664)..(664): n is a, c, g, or t
  modified_base (667)..(668): a, c, t, g, unknown or other
  misc_feature (667)..(668): n is a, c, g, or t
  modified_base (670)..(680): a, c, t, g, unknown or other
  misc_feature (670)..(680): n is a, c, g, or t
tcagcgagagataccacgaccggtgctcgatttagagagcgtcacagggtcctgggcccagtctgtgctgacgcagccgccctcagtgtcgtgggccccagggcagacggtcaccatctcctgcactggaaacngctaccgacggtcggggcaggttatgattgttcacgtggtaccagcctaccttaccaacaaaccacgacccccaaactcctacatatacgtaggtaacagctacgttccggccctcggacgggtccctacgaccgtctttcttcgttcggttccttcgtactcggacctacctcgaccgtcccgtaccgtcggcctagtccgacgtccgggcctaccgacgtccgtaggacgggagtacggacgggtacttagttaaacttttacgtttaaccgttcgggtaccttaccggtttttacccgtttaacgaaacttaaacggttttaaacgtacgggtagtttcgggtttaagggtacgttacgggggacccgggtaaacggaaccccgttacggttaacccgtccgtagtaccgaccgaccgtacggtccctcccgtccccgtcgtctccgtccgttccgtcccgtcccgttcgtaccgtcttccgttctccgtcgtcggcggtcggtcgtacgcgagtcgatagngantngcnncnnnnnnnnnnn

SEQ ID NO: 255303 - DNA, 831 bp, Homo sapiens
  misc_feature: GYAE6OF01CEQXN.11.3.A03.1.454.CMB.1.raw
  modified_base (817)..(819): a, c, t, g, unknown or other
  misc_feature (817)..(819): n is a, c, g, or t
  modified_base (821)..(822): a, c, t, g, unknown or other
  misc_feature (821)..(822): n is a, c, g, or t
  modified_base (825)..(831): a, c, t, g, unknown or other
  misc_feature (825)..(831): n is a, c, g, or t
tcagcgagagataccacgaccggtgctcgatttagagagcgtcacgagggtcctgggcccagtctgtgctgacgcagccgccctcagtgtcgtcggggccccagggcagacggtcaccatctcctgcactaggaaacagcctccaacggtcggggcgaggttatgatgttcacgtggtaccagtcctacccttaccaaacaaaccaccgaccccctaaactcctactataatagtacggtaacagtcctacgttccggcccgtacgtaccggggtccctacggaccgtacttccgtcgttcggtttccttgtctacgaccacctcgaccgtccctcccgtcggcctactccgtacgtcggcctaccgacgtccgtaggacggtaagtcggtacggtacttacgttaactttacttacggttcgttccgtaacggtttaccgtttaactaaaccgtaacgtttaaagggtacggtagttttacggggttacgggtttaacggttacccgggggaccggggtaaacccggggtaaacccccggttaacccggttaaccccgggttaccgttaaccgggtacccggtaaccccggaaccccgggttaaccgggcccccgttaccccgggttacccccccggttacccgggttccccgtaacccgttttcccccggttaccccggtttcccccccgttcccgttaccccggtttaaccgttccgttcccggtttacccggttccgtaccgggtcggaaccggggtcccgggtaccggtaccgggacgtacgggaccgtacgtaacgtcgagtccatcgcgnnncnnctnnnnnnn

SEQ ID NO: 255304 - DNA, 565 bp, Homo sapiens
  misc_feature: GYAE6OF01DEFYW.11.3.A03.1.454.CMB.1.raw
  modified_base (193)..(193): a, c, t, g, unknown or other
  misc_feature (193)..(193): n is a, c, g, or t
  modified_base (373)..(373): a, c, t, g, unknown or other
  misc_feature (373)..(373): n is a, c, g, or t
  modified_base (384)..(384): a, c, t, g, unknown or other
  misc_feature (384)..(384): n is a, c, g, or t
  modified_base (549)..(565): a, c, t, g, unknown or other
  misc_feature (549)..(565): n is a, c, g, or t
tcagcgagagataccacgaccggtgctcgatttagagagcgtcacagggtcctgggcccagtctgtgctgacgcagcccgccctcagtgtcgtcgggccccagggcagacggtcaccatctcctgcactggaaacagctccaacggtcgggcaggttatgatgttcactggtaccagcaccttccaacaaacncgacccccaaactcctcatatagtaggtaaacagctacgttccggccctcgacggggtccctgaccgtattctcgttcggttccttgtctacgaccacctcacgtcctccgtgcctatcacgtggcctccgagccgtggaggtatggaggtctagtatttagttctgtctagttccttanaactattaagngtatgtgtctcgggcggacgaccctacgtaccgtgtacgtacacgaccgagcctccgtacccccgtcgtacctaccgttccgtcccgttcccctcccgttccgtcgttacttccgtcgtccgtcgtcgggacggtccggtacgtcggacgacgcggctagtacgnnnnnnnnnnnnnnnnn

SEQ ID NO: 255305 - DNA, 745 bp, Homo sapiens
  misc_feature: GYAE6OF01A6KW8.11.3.A03.1.454.CMB.1.raw
  modified_base (133)..(133): a, c, t, g, unknown or other
  misc_feature (133)..(133): n is a, c, g, or t
  modified_base (159)..(159): a, c, t, g, unknown or other
  misc_feature (159)..(159): n is a, c, g, or t
  modified_base (189)..(189): a, c, t, g, unknown or other
  misc_feature (189)..(189): n is a, c, g, or t
  modified_base (221)..(221): a, c, t, g, unknown or other
  misc_feature (221)..(221): n is a, c, g, or t
  modified_base (720)..(720): a, c, t, g, unknown or other
  misc_feature (720)..(720): n is a, c, g, or t
  modified_base (728)..(728): a, c, t, g, unknown or other
  misc_feature (728)..(728): n is a, c, g, or t
  modified_base (736)..(736): a, c, t, g, unknown or other
  misc_feature (736)..(736): n is a, c, g, or t
  modified_base (741)..(741): a, c, t, g, unknown or other
  misc_feature (741)..(741): n is a, c, g, or t
tcagcgagagataccacgaccggtgctcgatttagagagcgtcacagggtccgtgggcccagtctgtgctgacgcagccgcctcagtgtctgggccccaggcagacggtcaccatctcctgcactggaaaccngctccgaacggtcggggctaggttangatgtcacgtggaccagcaccttcacaacncgcccccaaatcctcatactacgtcggtaacngctacgttccggccctgaacggggtccctaggaccgtatttcctacgttcggtttcctggtctacgacctacccgtcgacgtccctcccgtggaccctaacgtccgacgttacgggtccctaccggacgtccgtaggacggtactacgggacgtacctaggttaacttttacgtaaccgttcggtaacccttaggtttacctttaggaaacttaacggtttaaacgtcggtaaattcgggttaacggtacgttccggggaacggtacggttaacccctacccggttaaccgttaccgtaggtaccgacggtacccgtacggtaccgtcccgtcccccggtacgtacccgtaccgttccttacccggttccccgttacccgttcccgttaccgttaccgttaccttcccgtcgtaccggttacgggaaccggtccgggtaacgtccgggtaaccgtaccgggtacgtccgtaacgtcgtacggacctagacgtactgacncagactcngacgtacncacgngtac

SEQ ID NO: 255306 - DNA, 765 bp, Homo sapiens
  misc_feature: GYAE6OF01CD9A9.11.3.A03.1.454.CMB.1.raw
  modified_base (746)..(746): a, c, t, g, unknown or other
  misc_feature (746)..(746): n is a, c, g, or t
  modified_base (752)..(752): a, c, t, g, unknown or other
  misc_feature (752)..(752): n is a, c, g, or t
  modified_base (754)..(754): a, c, t, g, unknown or other
  misc_feature (754)..(754): n is a, c, g, or t
  modified_base (758)..(760): a, c, t, g, unknown or other
  misc_feature (758)..(760): n is a, c, g, or t
  modified_base (762)..(764): a, c, t, g, unknown or other
  misc_feature (762)..(764): n is a, c, g, or t
tcagcgagagataccacgaccggtgctcgatttagagagcgtcacagggtccgtgggcccagtctgtgctgacgcagccgcctcagtgtcgtcgggccccagggcagacggtcaccatctcctgcacgtaggaaacagctccgaacggtcggggactaggttatcgattcgtcacgtggtaccacgctaccttaccaactaaaccaccgaaccccctaaactcctacaagttaagtagttaacggtaacacgtacgttacgttccggacccgttcggtaaccgggggttccctacggaaaccgttcgtttccgttcggtttccgggtttcctttacgggtcctaaccggtaccctaaccgttccaccggttcccttccggtacggacctacgtaccgtaacggtcggtcctaccgacggtcgtacgggagtacggtggaacgtcgttagtactttacgtacgttgtacgttacgttccgttagtaaacttaacgttaacggtcggttaagtttcggttacggtacgttacggggaccgggtaccgtaacccgttaaccggtaccggttacgttacggaccgtaccgaccgtaacgtccgtcccggtaccccgtcgtaccgttccttacccgtttccccgtacccttacccgttcccgttcttaccgttcccgtacgtccggtaacggtccgggtcgtcggtaacggtaccgacggtacctagtacggtcacgtctacgatgcgacntacgcngngtcnnncnnnc

SEQ ID NO: 255307 - DNA, 852 bp, Homo sapiens
  misc_feature: GYAE6OF01BXQMJ.11.3.A03.1.454.CMB.1.raw
  modified_base (815)..(815): a, c, t, g, unknown or other
  misc_feature (815)..(815): n is a, c, g, or t
  modified_base (835)..(835): a, c, t, g, unknown or other
  misc_feature (835)..(835): n is a, c, g, or t
  modified_base (838)..(838): a, c, t, g, unknown or other
  misc_feature (838)..(838): n is a, c, g, or t
  modified_base (845)..(845): a, c, t, g, unknown or other
  misc_feature (845)..(845): n is a, c, g, or t
  modified_base (849)..(849): a, c, t, g, unknown or other
  misc_feature (849)..(849): n is a, c, g, or t
  modified_base (851)..(851): a, c, t, g, unknown or other
  misc_feature (851)..(851): n is a, c, g, or t
tcagcgagagataccacgaccggtgctcgatttagagagcgtcacagggtcctgggcccagtctgtgctgacgcagcccgccctcagtgtcgtcgggcccccagggcagacggtcaccatctcctgcacgtaggaaacagcctaccgaacggtcgggcaggttatgagttcgttacacgtacggtaccacgtcctacccttaccaacaaaaccgacccgaaccccctaaaacctcctactaattacgtagtacggtaacacgtctacgttcccggacccggttccggggtccctacgtaccgtagttcctcgttcgtttccttgtcgtacgtacctaccgtcgaccgtccctcccgtacggacctacgtccgtaccggtccgggaccctaccgacgtcccgttagggacggtacggtacggtacggtcttacggttaaacgtttacgtttaccgtacgtttaaccgttacgttttaccgttaacgaaaccgtttaaagtttaaaccggtggtttaacggttaggggtttaccggttaacgggtttacccgggaacggggtaacccggtaaacccccggtttaaccggttaacccggttaccggtaaccgggtaccaacccggtacccgggtaccgtcccccgtaccccggtacccccgttacggttaccctacccggtttccccgttaccccgttcccccccgttacccgtttacccgttcgtttacccctcccggttcccgttccggtaccggtacccgggacgggttcccgggtaccgtaccgggtacccggaacgtcgtacgtagaaccgtntacggccagtcgctgcctanacntagctgnctgngng

SEQ ID NO: 255308 - DNA, 480 bp, Homo sapiens
  misc_feature: GYAE6OF02HG0TN.11.3.A03.1.454.CMB.1.raw
  modified_base (468)..(480): a, c, t, g, unknown or other
  misc_feature (468)..(480): n is a, c, g, or t
tcagcgagagataccacgaccggtgctcgatttagagagcgtcacagggtcatgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaatcctcatatatggtaacagcattcggccctcaggggtccctgaccgattctctggttccttgtctgacacctcagcctccctggccatcactggctccagcctgagatgaggctgattatactgtctgtcctatgacgacgacctacagacttccggtttcggcggagggactaagctgaccgtctaagtcagcccaagctcgcccctggtcactctcgttcccaccctctcgtatctctcgctgacgcggctggcaaggcgcagtagnnnnnnnnnnnnn

SEQ ID NO: 255309 - DNA, 479 bp, Homo sapiens
  misc_feature: GYAE6OF02F4GY9.11.3.A03.1.454.CMB.1.raw
  modified_base (456)..(456): a, c, t, g, unknown or other
  misc_feature (456)..(456): n is a, c, g, or t
  modified_base (462)..(463): a, c, t, g, unknown or other
  misc_feature (462)..(463): n is a, c, g, or t
  modified_base (465)..(479): a, c, t, g, unknown or other
  misc_feature (465)..(479): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgagatgaggctgattatactgtcagtcctttgactattaaactggatgtggtattcggcgaggacccagtaccgtctaggtcagccaaggctgcccctgtcactctcgttcccaccctctcgtactctctcgctgacgcggctggcaaggcncatagnncnnnnnnnnnnnnnnn

SEQ ID NO: 255310 - DNA, 542 bp, Homo sapiens
  misc_feature: GYAE6OF02JOWV2.11.3.A03.1.454.CMB.1.raw
  modified_base (231)..(231): a, c, t, g, unknown or other
  misc_feature (231)..(231): n is a, c, g, or t
  modified_base (356)..(356): a, c, t, g, unknown or other
  misc_feature (356)..(356): n is a, c, g, or t
  modified_base (482)..(482): a, c, t, g, unknown or other
  misc_feature (482)..(482): n is a, c, g, or t
  modified_base (496)..(496): a, c, t, g, unknown or other
  misc_feature (496)..(496): n is a, c, g, or t
  modified_base (508)..(508): a, c, t, g, unknown or other
  misc_feature (508)..(508): n is a, c, g, or t
  modified_base (515)..(515): a, c, t, g, unknown or other
  misc_feature (515)..(515): n is a, c, g, or t
  modified_base (528)..(528): a, c, t, g, unknown or other
  misc_feature (528)..(528): n is a, c, g, or t
  modified_base (535)..(535): a, c, t, g, unknown or other
  misc_feature (535)..(535): n is a, c, g, or t
  modified_base (539)..(540): a, c, t, g, unknown or other
  misc_feature (539)..(540): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctnaggggtcccctgacccgattcctctggttccttgtctgacacctcagccctcctggcccatccacgttgggcctccagcctgaggatgaggctgattatactgtctagtccttgactattaaacnggtaatgtaggtattcggcggaggacccacgtaaccgtcgtagtcgacgacccgtaagctcgccccgtcgtcctaccttccgtcgttcccacccttcctcgtacttctctcgctcgacgcgggtcnggtccgaaggtccncgtacgtagctncgtactnacgctcgtcgtcnctcgtcnctcnngc

SEQ ID NO: 255311 - DNA, 479 bp, Homo sapiens
  misc_feature: GYAE6OF02F8NUK.11.3.A03.1.454.CMB.1.raw
  modified_base (350)..(350): a, c, t, g, unknown or other
  misc_feature (350)..(350): n is a, c, g, or t
  modified_base (460)..(460): a, c, t, g, unknown or other
  misc_feature (460)..(460): n is a, c, g, or t
  modified_base (466)..(479): a, c, t, g, unknown or other
  misc_feature (466)..(479): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgactatttaaacnggatgtgtattcggcggaggacccagtaccgtctaggtcagcccaagctcgcccctcggcactctcgttcccacctcctcgtatctctcgctgacgcggctggcaaggcncatagnnnnnnnnnnnnnn

SEQ ID NO: 255312 - DNA, 485 bp, Homo sapiens
  misc_feature: GYAE6OF02FIKIG.11.3.A03.1.454.CMB.1.raw
  modified_base (465)..(465): a, c, t, g, unknown or other
  misc_feature (465)..(465): n is a, c, g, or t
  modified_base (471)..(485): a, c, t, g, unknown or other
  misc_feature (471)..(485): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggcccctcgaggggtccctgaccgattctctggttccttgtctgacacctcagcctccctggccatcactgggctccagcctgagatgaggctgattatctgtcagttccttgacattaactggatgtggtatcgggcggagggacccacgtaaccgtctaggtcagcccaaggctcgcccctcggtcacctctcgttcccaccctcctcgtactctctcgctgagcgggctggcaaggcncatagnnnnnnnnnnnnnnn

SEQ ID NO: 255313 - DNA, 698 bp, Homo sapiens
  misc_feature: GYAE6OF02IVBLS.11.3.A03.1.454.CMB.1.raw
  modified_base (664)..(664): a, c, t, g, unknown or other
  misc_feature (664)..(664): n is a, c, g, or t
  modified_base (671)..(671): a, c, t, g, unknown or other
  misc_feature (671)..(671): n is a, c, g, or t
  modified_base (690)..(690): a, c, t, g, unknown or other
  misc_feature (690)..(690): n is a, c, g, or t
  modified_base (692)..(692): a, c, t, g, unknown or other
  misc_feature (692)..(692): n is a, c, g, or t
  modified_base (694)..(694): a, c, t, g, unknown or other
  misc_feature (694)..(694): n is a, c, g, or t
  modified_base (697)..(697): a, c, t, g, unknown or other
  misc_feature (697)..(697): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccaacaaacacgacccccaaacttcctcaatatactggtaacagctagttccggccctacgacggggtccctagaccgtattccgtcttacggtttcccttgtccgtcgaaccacccgttcgacgtcccttccccgtggccctaacgtcctaacgtcggggtactccccaggtccgtaggaggacttcggaaggtcctttagtaattttacgtttacctgggttacctaaccggtttcccttttaagaacccgttaattttaaaaccggtgggtaacttttagggttacggttacgtttacgggggacgggtaaacccgggtaacccctaaacgggttaccgttcgtaacggtcctaacggacccaagggtccctaccggtcccccgttcggtctaccgtcttccgtccctaacccgttctcggttactcttccgtcgtctacggcggtaccggtcgtacggacgtagtcccgataagtacgnactgcgntagctcgtgcacgtacggngncnctnc

SEQ ID NO: 255314 - DNA, 619 bp, Homo sapiens
  misc_feature: GYAE6OF02HKN27.11.3.A03.1.454.CMB.1.raw
  modified_base (254)..(254): a, c, t, g, unknown or other
  misc_feature (254)..(254): n is a, c, g, or t
  modified_base (607)..(607): a, c, t, g, unknown or other
  misc_feature (607)..(607): n is a, c, g, or t
  modified_base (611)..(611): a, c, t, g, unknown or other
  misc_feature (611)..(611): n is a, c, g, or t
  modified_base (613)..(619): a, c, t, g, unknown or other
  misc_feature (613)..(619): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgcccccaaactcctcatatatggtaacagcattcggccctcgaggggtcccctgaccgattcncttggttccttgtctgaccacctcacgccctccctggccatcacgtggctccagcctggaggatgaggctgtaattattactgtgctagctagtgggatcgacacccgtagtaacgttcggtcctttggtcggtttgggttttccgggacgggacggggacctaaggccgtacggtaccccggtcgttacggtcacggacccgtaaggtcctaccggtcccccgttacgggtccctaccttccgttaccgtttacccccctacccgttcccgttaccgttacttcccttccgtacccggtcttacgggacggtccggggtaccttcgggaccgaacgggtccacgagttacgntcgncnnnnnnn

SEQ ID NO: 255315 - DNA, 481 bp, Homo sapiens
  misc_feature: GYAE6OF02JETW5.11.3.A03.1.454.CMB.1.raw
  modified_base (417)..(417): a, c, t, g, unknown or other
  misc_feature (417)..(417): n is a, c, g, or t
  modified_base (463)..(465): a, c, t, g, unknown or other
  misc_feature (463)..(465): n is a, c, g, or t
  modified_base (467)..(481): a, c, t, g, unknown or other
  misc_feature (467)..(481): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgagctgattattactgtcagttccttgacattaactgatgtgtattcggcgaggacccacgtaccgtctaggtcacgccaggctcgcccctcgtcactctcgtcccncctcctcgtactctctcgctgacgcggctggcgacggcgcagtagnnngnnnnnnnnnnnnnnn

SEQ ID NO: 255316 - DNA, 514 bp, Homo sapiens
  misc_feature: GYAE6OF02HR63O.11.3.A03.1.454.CMB.1.raw
  modified_base (134)..(134): a, c, t, g, unknown or other
  misc_feature (134)..(134): n is a, c, g, or t
  modified_base (338)..(338): a, c, t, g, unknown or other
  misc_feature (338)..(338): n is a, c, g, or t
  modified_base (449)..(449): a, c, t, g, unknown or other
  misc_feature (449)..(449): n is a, c, g, or t
  modified_base (491)..(491): a, c, t, g, unknown or other
  misc_feature (491)..(491): n is a, c, g, or t
  modified_base (497)..(514): a, c, t, g, unknown or other
  misc_feature (497)..(514): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacngctccaacgtcggggcaggttatgatgttcactggtaccagcaccttccaacaaacagcccccaaatcctcatatatggtaacagcattcggccctcgaggggtccctgaccgtattctcttggttcccttgtcctgacacctcagcctccctgcctatcacgtggcctccagtcctagaggatgaggtctgtaattagttacngtcagtcctttagactaagttaaactggacttggtagtattcggcggacggaccctaagtaaccgtctaggtcacgtaccaagctacgcccctcggtccactctcgtcccnccctctcgtactctctcgctgacgcggctcggcgacgccganagtagnnnnnnnnnnnnnnnnnn

SEQ ID NO: 255317 - DNA, 484 bp, Homo sapiens
  misc_feature: GYAE6OF02IXZI1.11.3.A03.1.454.CMB.1.raw
  modified_base (313)..(313): a, c, t, g, unknown or other
  misc_feature (313)..(313): n is a, c, g, or t
  modified_base (437)..(437): a, c, t, g, unknown or other
  misc_feature (437)..(437): n is a, c, g, or t
  modified_base (467)..(471): a, c, t, g, unknown or other
  misc_feature (467)..(471): n is a, c, g, or t
  modified_base (474)..(484): a, c, t, g, unknown or other
  misc_feature (474)..(484): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccaacaaacacgcccccaaaactcctcatatatggtaacagcattccggccctcgaggggtccctgaccgattctctggttccttgtctgacacctcagcctccctggccatcactgggctccagcctgagntgagctgattatactgtcagtccttgacattaaacgtgatgtagtattcggcgaggacccaagtaccgtctagtcagccaagctcgcccctcggtcactctcgttccatcctcctcgtactccntcgctcgacgcggctggcaaggcgcatagnnnnnacnnnnnnnnnnn

SEQ ID NO: 255318 - DNA, 549 bp, Homo sapiens
  misc_feature: GYAE6OF02FVD4H.11.3.A03.1.454.CMB.1.raw
  modified_base (529)..(529): a, c, t, g, unknown or other
  misc_feature (529)..(529): n is a, c, g, or t
  modified_base (532)..(549): a, c, t, g, unknown or other
  misc_feature (532)..(549): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgcccccaaactcctcatatatggtaacagcattcggcccctcgacggggtcccctgaccgtattcctcgtggttcctttgtctgacacctcacgccctccctggccatccacgtgggcctccgagcctgaggatggaggctgtatttacttactgtctagttcctttagactatttaaactggtaactggttaggtattcggggacgggacgggaccccacggttaaccgtccgtaggtccacgacccgaaggctccgcccccgtcggtccaccttccgtccgttccccgccccttcctcgtacttcctctcgctgacgcgggctgggcaggcgacanagnnnnnnnnnnnnnnnnnn

SEQ ID NO: 255319 - DNA, 523 bp, Homo sapiens
  misc_feature: GYAE6OF02I4SVN.11.3.A03.1.454.CMB.1.raw
  modified_base (507)..(523): a, c, t, g, unknown or other
  misc_feature (507)..(523): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgcccccaaactcctcatatatggtaacagcattccggccctcgacggggtccctgaccgattctctggttccttgtctgacacctcagcctcctggccatcactggctccagcctgaggatgaggctgattattactgtcagttccttagaactaattaaacgtggtaattggtggttagttcgggacggaacgggaccctaacggtaaccgtcgttaaggcacgcccgaagccgtcgcccccgtgcctactcctcgtccccgcccttcctcgtactctcctcgtctgacgcgggctcggcaaggccactatacgnnnnnnnnnnnnnnnnn

SEQ ID NO: 255320 - DNA, 520 bp, Homo sapiens
  misc_feature: GYAE6OF02F2HGN.11.3.A03.1.454.CMB.1.raw
  modified_base (192)..(192): a, c, t, g, unknown or other
  misc_feature (192)..(192): n is a, c, g, or t
  modified_base (221)..(221): a, c, t, g, unknown or other
  misc_feature (221)..(221): n is a, c, g, or t
  modified_base (315)..(315): a, c, t, g, unknown or other
  misc_feature (315)..(315): n is a, c, g, or t
  modified_base (494)..(494): a, c, t, g, unknown or other
  misc_feature (494)..(494): n is a, c, g, or t
  modified_base (501)..(508): a, c, t, g, unknown or other
  misc_feature (501)..(508): n is a, c, g, or t
  modified_base (510)..(511): a, c, t, g, unknown or other
  misc_feature (510)..(511): n is a, c, g, or t
  modified_base (513)..(520): a, c, t, g, unknown or other
  misc_feature (513)..(520): n is a, c, g, or t
tcagcgagagataccacgaccggtgctcgatttagagagcgtcacagggtccgtgggcccagtctgtgctgacgcagccgccctcagtgtcctggggccccagggcagacggtcaccatctcctgcactggaaacagctccaacgtcggggcaggttatgatgttcactggtaccagcaccttccacaaacncgcccccaaactcctcatatatggtaacngcattccggccctcacggggtccctgaccgattctctggttccttgtctgacacctcagcctcctggccatccactcgggctccagcctgaggntggaggctggattatacgtgtcagttcctttgaactagtttaaacgtggaattggtggtatcgggcggacggaccctaacggtaccgtccgtaggtcacgcccgaaggcctcggcccctggtccacgttcctcgttccccgcccttctcgtactctctcgctgcgcggctggcaaggcncagtagnnnnnnnngnngnnnnnnnn

SEQ ID NO: 255321 - DNA, 511 bp, Homo sapiens
  misc_feature: GYAE6OF02IGX2V.11.3.A03.1.454.CMB.1.raw
  modified_base (319)..(319): a, c, t, g, unknown or other
  misc_feature (319)..(319): n is a, c, g, or t
  modified_base (361)..(361): a, c, t, g, unknown or other
  misc_feature (361)..(361): n is a, c, g, or t
  modified_base (487)..(487): a, c, t, g, unknown or other
  misc_feature (487)..(487): n is a, c, g, or t
  modified_base (496)..(496): a, c, t, g, unknown or other
  misc_feature (496)..(496): n is a, c, g, or t
  modified_base (498)..(511): a, c, t, g, unknown or other
  misc_feature (498)..(511): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgcccccaaactcctcatatatggtaacagcacttccggccctcgacggggtcccctgaccgattctcgttggttccttgtctgactacctcacgccctcctggccatcacgtggctccagcctgaggntgaggctgattattactgtctagtcctttgactattaaacgngtatgtgtagtcggacgacggacccacgtaaccgtcctagtcacgaccaggctccgcccgtcgtacactctcgtcccaccttcctctactctctcgctggacgcgggcgtcggacgacggcgtacngtagcagcngnnnnnnnnnnnnnn

SEQ ID NO: 255322 - DNA, 486 bp, Homo sapiens
  misc_feature: GYAE6OF02JG02L.11.3.A03.1.454.CMB.1.raw
  modified_base (190)..(190): a, c, t, g, unknown or other
  misc_feature (190)..(190): n is a, c, g, or t
  modified_base (310)..(310): a, c, t, g, unknown or other
  misc_feature (310)..(310): n is a, c, g, or t
  modified_base (464)..(464): a, c, t, g, unknown or other
  misc_feature (464)..(464): n is a, c, g, or t
  modified_base (470)..(486): a, c, t, g, unknown or other
  misc_feature (470)..(486): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacngccccccaaactcctcatatatggtaacagcattcggccctcaggggtccctgaccgattctctggttccttgtctgacacctcagcctccctggccatcactgggctccagcctgaggntgaggctgattatactgtcagtcctttgactattaaactggatgtgtattcggcggaggacccacgtaaccgtctaggtcagcccaaggctcgcccctcgtcactctcgttcccgcccttcctcgtactctctcgctgacgcggctggcaggcncatagnnnnnnnnnnnnnnnnn

SEQ ID NO: 255323 - DNA, 599 bp, Homo sapiens
  misc_feature: GYAE6OF02G3C3P.11.3.A03.1.454.CMB.1.raw
  modified_base (581)..(581): a, c, t, g, unknown or other
  misc_feature (581)..(581): n is a, c, g, or t
  modified_base (585)..(585): a, c, t, g, unknown or other
  misc_feature (585)..(585): n is a, c, g, or t
  modified_base (587)..(588): a, c, t, g, unknown or other
  misc_feature (587)..(588): n is a, c, g, or t
  modified_base (590)..(590): a, c, t, g, unknown or other
  misc_feature (590)..(590): n is a, c, g, or t
  modified_base (592)..(599): a, c, t, g, unknown or other
  misc_feature (592)..(599): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccaacaaacacgcccccaaactcctcatatatggtaacagcattccggccctcgacggggtccctgaccgtattctctggttccttgtctgacacctcacgcctccctggccatccactgggcctccagccctggacggtatggacggtctaggtatttacttactgtcctagttcctttgaactattaaacgtggattgtggtagttcgggacgggacggaccctacggtaacccgtcgtaggtaccacgacccgaacggtcctccgtcccccgttcggtcctaccgtccttcccgttcccctaccccgttcccttaccgttacttcccttccgtccgtccgtcgggtacggtccgggtccgttacgggaccgtaacgggccgacctacgtacgctagncgtncnntngnnnnnnnn

SEQ ID NO: 255324 - DNA, 649 bp, Homo sapiens
  misc_feature: GYAE6OF02H0JJS.11.3.A03.1.454.CMB.1.raw
  modified_base (134)..(134): a, c, t, g, unknown or other
  misc_feature (134)..(134): n is a, c, g, or t
  modified_base (418)..(418): a, c, t, g, unknown or other
  misc_feature (418)..(418): n is a, c, g, or t
  modified_base (623)..(623): a, c, t, g, unknown or other
  misc_feature (623)..(623): n is a, c, g, or t
  modified_base (627)..(628): a, c, t, g, unknown or other
  misc_feature (627)..(628): n is a, c, g, or t
  modified_base (630)..(630): a, c, t, g, unknown or other
  misc_feature (630)..(630): n is a, c, g, or t
  modified_base (632)..(632): a, c, t, g, unknown or other
  misc_feature (632)..(632): n is a, c, g, or t
  modified_base (637)..(637): a, c, t, g, unknown or other
  misc_feature (637)..(637): n is a, c, g, or t
  modified_base (642)..(643): a, c, t, g, unknown or other
  misc_feature (642)..(643): n is a, c, g, or t
  modified_base (645)..(645): a, c, t, g, unknown or other
  misc_feature (645)..(645): n is a, c, g, or t
  modified_base (648)..(649): a, c, t, g, unknown or other
  misc_feature (648)..(649): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacngctccaacggtcggggcaggttatgattgttcactggtaccagcctaccttccaacaaaccacgacccccaaactcctcatatataggtaacagctacgttccggccctcggacggggttccctaggaccgtacttctcgttcggttccttgtctcgaccacctcgacgtcctccgtggcctatccgacgtcggccttccgagtccgtaggagagtggacgtcgttattaactttacttacgtcgtacgttacgtttcctttaagaaacttaacgtttaaacgnggtacgtttggtacggttacggtcgggacggaccggtaacccgtaacggtaccgtcgtacggtacgaccgaccgtacggtcccgtccgtcccgtacgttcctaccttccgttacccgttccccgtacccttcgtaccgttccttcccgtcgtccggtcgtacgggccgggtcgtcggtaacggaccggtacgtcgacgtaagcgntacnngncngctgnctcgnncncgnn

SEQ ID NO: 255325 - DNA, 479 bp, Homo sapiens
  misc_feature: GYAE6OF02FLWVH.11.3.A03.1.454.CMB.1.raw
  modified_base (432)..(432): a, c, t, g, unknown or other
  misc_feature (432)..(432): n is a, c, g, or t
  modified_base (468)..(468): a, c, t, g, unknown or other
  misc_feature (468)..(468): n is a, c, g, or t
  modified_base (472)..(479): a, c, t, g, unknown or other
  misc_feature (472)..(479): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaaacagcccccaaactcctcatatatggtaacagcattcggccctcacggggtccctgaccgattctctggttccttgtctgacacctcagcctccctggccatcactgggctccagcctgaggatgaggctgattaattctgtcagttcctttgactatttaaactggatgtgtattcgggcggagggacccacgtaaccgtcgtaggtcagcccaagctcgcccctcgtcacctctcgttcccnccctcctctactctctcgctgacgcggctggcagcnatgnnnnnnnn

SEQ ID NO: 255326 - DNA, 520 bp, Homo sapiens
  misc_feature: GYAE6OF02JCXU4.11.3.A03.1.454.CMB.1.raw
  modified_base (157)..(157): a, c, t, g, unknown or other
  misc_feature (157)..(157): n is a, c, g, or t
  modified_base (219)..(219): a, c, t, g, unknown or other
  misc_feature (219)..(219): n is a, c, g, or t
  modified_base (446)..(446): a, c, t, g, unknown or other
  misc_feature (446)..(446): n is a, c, g, or t
  modified_base (458)..(458): a, c, t, g, unknown or other
  misc_feature (458)..(458): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
  modified_base (506)..(520): a, c, t, g, unknown or other
  misc_feature (506)..(520): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttangatgttcactggtaccagcaccttccacaaacacgccccccaaatcctcatatatggtaacngctattccggcccctcgacgggggtcccctgaccgattctctggttccttgtctgacacctcacgtcctccctgccatcactgggcctccagccgtgaggatggaggctagtatttatactgtctagttcctttagaactaatttaaacgtggaattcggtaggttacgttcgggacgggtacggaccctacgtaccgtcgtagcacgccgagctccgccctcgtcnctctcgtacccncctcctctactctctcncngacgcggctggacgagtcgacatgntngnnnnnnnnnnnnnnn

SEQ ID NO: 255327 - DNA, 588 bp, Homo sapiens
  misc_feature: GYAE6OF02IKUNZ.11.3.A03.1.454.CMB.1.raw
  modified_base (135)..(135): a, c, t, g, unknown or other
  misc_feature (135)..(135): n is a, c, g, or t
  modified_base (158)..(158): a, c, t, g, unknown or other
  misc_feature (158)..(158): n is a, c, g, or t
  modified_base (194)..(194): a, c, t, g, unknown or other
  misc_feature (194)..(194): n is a, c, g, or t
  modified_base (225)..(225): a, c, t, g, unknown or other
  misc_feature (225)..(225): n is a, c, g, or t
  modified_base (433)..(433): a, c, t, g, unknown or other
  misc_feature (433)..(433): n is a, c, g, or t
  modified_base (550)..(550): a, c, t, g, unknown or other
  misc_feature (550)..(550): n is a, c, g, or t
  modified_base (570)..(570): a, c, t, g, unknown or other
  misc_feature (570)..(570): n is a, c, g, or t
  modified_base (572)..(588): a, c, t, g, unknown or other
  misc_feature (572)..(588): n is a, c, g, or t
tcagcgagagataccacgaccggtgctcgatttagagagcgtcacaaggggtcctgggcccagtctgtgctgacgcagccgccctcagtgtctgggccccagggcagacggtcaccatctcctgcacgtggaacngctccaacggtcgggcaggttangatgttcacgtggtaccagccaccttccaacaaacncgacccccaaactcctcatatatcggtaacngcagttccggccctcggacggggtcccctggacccgtattcctcgttcggttccttgtctacgacctaccgtccgacgtcccctcccgtcggcctacgtccgtacggtcgggccctaccgacggtccgtaggacggtacgtacggacggtcttagttaactttacgttacgttcgtacgtacgttctttaggaacttaacgttaacgngtagtgttggttacgtcgggacgacgaccgtaaccgtacgtcgtagtacgacgtaccgacgtccgtccgtcccgtcgcctctccgttccgtcccgtccttcgtctctctctcgtcgngcggtcgcgcgacgacgcantnnnnnnnnnnnnnnnnn

SEQ ID NO: 255328 - DNA, 502 bp, Homo sapiens
  misc_feature: GYAE6OF02HC7HZ.11.3.A03.1.454.CMB.1.raw
  modified_base (350)..(350): a, c, t, g, unknown or other
  misc_feature (350)..(350): n is a, c, g, or t
  modified_base (485)..(489): a, c, t, g, unknown or other
  misc_feature (485)..(489): n is a, c, g, or t
  modified_base (491)..(502): a, c, t, g, unknown or other
  misc_feature (491)..(502): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaatcctcatatatggtaacagcattcggccctcgaggggtccctgaccgattctctggttccttgtctgacacctcagcctcctggccatcactgggctccagcctgaggatgaggctgattattactgtcagtcctttagactatttaaacnggatgtggtattcgggacggaggacccacggtaaccgtcgtaaggtcacgacccgaaggctcgccccgtggtcactctcgttcccaccctcctcgtactctcctcgctggacgcggctggcgaagcgacagtagnnnnncnnnnnnnnnnnn

SEQ ID NO: 255329 - DNA, 695 bp, Homo sapiens
  misc_feature: GYAE6OF02H5BGC.11.3.A03.1.454.CMB.1.raw
  modified_base (134)..(134): a, c, t, g, unknown or other
  misc_feature (134)..(134): n is a, c, g, or t
  modified_base (674)..(674): a, c, t, g, unknown or other
  misc_feature (674)..(674): n is a, c, g, or t
  modified_base (678)..(678): a, c, t, g, unknown or other
  misc_feature (678)..(678): n is a, c, g, or t
  modified_base (681)..(686): a, c, t, g, unknown or other
  misc_feature (681)..(686): n is a, c, g, or t
  modified_base (688)..(694): a, c, t, g, unknown or other
  misc_feature (688)..(694): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacngctccaacggtcggggcaggttatgatgttcactggtaccagctaccttccaacaaacacgacccccaaactcctacatatagtggtaaacagctacgttccggccctcggacggggttccctaggaccgtattcctcgttcggtttccttgtctacgacctaccctcgacgtcccctccgtcggccattccacgttcgggcctccgacgtccgtaggaggtgacggacggtcttaggttaacttttaacgtttacttcggtaccttaacgtttccgtttacgaaacttaaacgtttaaaacgtggttagtttaggtacgggttacgttccggggacgggaaaccggtaccctaaaccggtttaaccctcggtaacggtacgaccggtacccgtaaccggtccgtacccggtcccccgttcggtacctacccgtttcccgttacccgttacccccgtaccccgtttccttaaccgttccttccttccgtccggtcgtacggcgggtccggtcgtcggaacggtacggacgacgtagcgancgancgnnnnnntnnnnnnnc

SEQ ID NO: 255330 - DNA, 760 bp, Homo sapiens
  misc_feature: GYAE6OF02F3ZK3.11.3.A03.1.454.CMB.1.raw
  modified_base (190)..(190): a, c, t, g, unknown or other
  misc_feature (190)..(190): n is a, c, g, or t
  modified_base (398)..(398): a, c, t, g, unknown or other
  misc_feature (398)..(398): n is a, c, g, or t
  modified_base (715)..(715): a, c, t, g, unknown or other
  misc_feature (715)..(715): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacncgcccccaaactcctcatatatggtaacagctattccggcccctcgacggggtccctagtacccgtattcctctggttccttgtctgacacctcacgcctccctggcccatccacgtcggcttccgagtcctagaggtactggacggtcctaggtactttaacttaccgtgttcaacgtttcctttaggaacttaaagtttaaaccgnggtacgttcgggtttaggttaacgttaccggggaccggggtaaaccggggtaccccgtaacgggttaaccccggttaccgtacgggttacccgtaaaccggtaccccggtaaacgggtccccttacccgggtaccccccgttccgggtacccttaacccggttttcccgtaccccggttttccccccgccccgtttccgttcccggtttaaccttcccttacccggttccgttccgttacgggtaacccgggttccggggaccttacgggggtaccgtaaccgggtcccggtactaaccggttacgagttcacgtcngtaccgctgtccgtatacccgtacgacgtactacgtcgtacgtcg

SEQ ID NO: 255331 - DNA, 822 bp, Homo sapiens
  misc_feature: GYAE6OF02F34AS.11.3.A03.1.454.CMB.1.raw
  modified_base (792)..(792): a, c, t, g, unknown or other
  misc_feature (792)..(792): n is a, c, g, or t
  modified_base (797)..(797): a, c, t, g, unknown or other
  misc_feature (797)..(797): n is a, c, g, or t
  modified_base (805)..(805): a, c, t, g, unknown or other
  misc_feature (805)..(805): n is a, c, g, or t
  modified_base (813)..(813): a, c, t, g, unknown or other
  misc_feature (813)..(813): n is a, c, g, or t
  modified_base (815)..(817): a, c, t, g, unknown or other
  misc_feature (815)..(817): n is a, c, g, or t
  modified_base (819)..(821): a, c, t, g, unknown or other
  misc_feature (819)..(821): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcacgtaggaaacagctaccgaacggtcgggggcaaggttatggattgttcacgttcgggtaccacgcctacccttaccaacaaaaccaccgaccccccaaaacttccctacaacttaattagtacgggttaaacacggtactaacgtttcccgggaccccttcgggaaccggggggttcccctacggaacccgttaccttttccgttccgtttcgggttttccctttcggttacctaccggtaccctaacccccttcgtaaccggtccccttcccccgtacgggacccctaacttcccgtaaccggtttcggggccccttcccgtaccggtcccggtagggtaacggacgttacgggacggtacctttggttaacttttaacgttacgttcgtacgtacgtttaccgtttaggaaccttaaagttaaacgtggttaacgtttggttacggttaacgtccggggtacgtaccggggtaaccctacggttaacccggttcgtaacggtaccgaccggtaccgaacggtcccgtaccgtccccgttcggttaccgccgttccttcccgttaccccttacccgtacccgttcgttaccgttccttccgttacgtccggttacgggtaccggtcgggtccgttacgggaccggaacggtcgtacgtacgtacgngactngtacgctnctagcctncnnncnnnc

SEQ ID NO: 255332 - DNA, 503 bp, Homo sapiens
  misc_feature: GYAE6OF02FODAA.11.3.A03.1.454.CMB.1.raw
  modified_base (189)..(189): a, c, t, g, unknown or other
  misc_feature (189)..(189): n is a, c, g, or t
  modified_base (281)..(281): a, c, t, g, unknown or other
  misc_feature (281)..(281): n is a, c, g, or t
  modified_base (306)..(306): a, c, t, g, unknown or other
  misc_feature (306)..(306): n is a, c, g, or t
  modified_base (485)..(488): a, c, t, g, unknown or other
  misc_feature (485)..(488): n is a, c, g, or t
  modified_base (490)..(503): a, c, t, g, unknown or other
  misc_feature (490)..(503): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttcacaaacngcccccaaatcctcatatatggtaacagcattccggccctcgaggggtccctgaccgattctctggttccttgtctgacacctcagcctccnggccatcactggcctcagcctgagntgagtctgtattatactgtcagttccttgactattaaactggtatgtggtattcgggacggacggaccctacggtaaccgtcctaggtcacgccgaagctccgccccgtcgtcctactcgtcgtcccgtcctcctctatcctctcgctggacgcgggtctcggcgacgcgacgagtcgnnnngnnnnnnnnnnnnnn

SEQ ID NO: 255333 - DNA, 694 bp, Homo sapiens
  misc_feature: GYAE6OF02IA2FB.11.3.A03.1.454.CMB.1.raw
  modified_base (137)..(137): a, c, t, g, unknown or other
  misc_feature (137)..(137): n is a, c, g, or t
  modified_base (464)..(464): a, c, t, g, unknown or other
  misc_feature (464)..(464): n is a, c, g, or t
  modified_base (674)..(674): a, c, t, g, unknown or other
  misc_feature (674)..(674): n is a, c, g, or t
  modified_base (677)..(677): a, c, t, g, unknown or other
  misc_feature (677)..(677): n is a, c, g, or t
  modified_base (680)..(680): a, c, t, g, unknown or other
  misc_feature (680)..(680): n is a, c, g, or t
  modified_base (682)..(690): a, c, t, g, unknown or other
  misc_feature (682)..(690): n is a, c, g, or t
  modified_base (692)..(694): a, c, t, g, unknown or other
  misc_feature (692)..(694): n is a, c, g, or t
tcagcgagagataccacgaccggtgctcgatttagagagcgtcacagggtcctgggcccagtctgtgctgacgcagcccgccctcagtgtcgtgggggccccagggcagacggtcaccatctcctgcactggaaacngctccaacggtcggggctaggttatgatgtcactggtaccagcaccttccaacaaacacgacccccaaaacttcctacaattatagtaggtaacagctagttcccggcccctggacggggttcccctaggaccgtatttcttcgttcggttttccctttgtccttcggaacctaccttccgacgtcccccttaccccgtaggacccctaattccaaccggtgggccccttacccgaacgtccgtaggaggtactcggaaggtcctttaggtactttacgtttaccgtgttactacgtttccgtttaagaaccttaagttttaaacgnggtagttaggtttacgggtaagttccggggaacggtaaccgggaacccgtaacgttaacccgttccgtacggtcgacgtacccgaacggtcgtcccgtcccgtcggtcctaccgttcttcccgttaccccctacccgtttaccgtcgttaccttccgtcctaccgtcgttcggacgggccgtacgcggacgaacggcctacgaacgtcgncgncgntnnnnnnnnncnnn

SEQ ID NO: 255334 - DNA, 792 bp, Homo sapiens
  misc_feature: GYAE6OF02JJ989.11.3.A03.1.454.CMB.1.raw
  modified_base (194)..(194): a, c, t, g, unknown or other
  misc_feature (194)..(194): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacggtcggggctaggttatgatgttcactggtaccagccaccttaccacaaacncgacccccaactcctacatatataggtaacagctagttccggccctcgacgggtccctgaccgtattctcgtcggttccttgtctacgacctacctcacgtccctcccgtggcctatacgcgtcggcccttaccgacgtcccgtaggacggtactcggtacggtacctttacgggtaaacttttacggttaaccgttcggtacctaaccgttttcccgtttaaggaaaccttaaacgttttaaacggtggtaacggtttgggttaccgggttacggttcccggggaccgggtaaaccgggtaccccttaaccggtacccgttaccgtagggtacccgtaaccggtacccgtaacggttcccgtacccggtaccccccgttcggtacccgttaccttcccgttacccggttcccccgttcccgtttaccctacccgtttaccgtacccgttccgtacccggtcgttaccgggtaccgggtccggttaccgggtaccggtaaccggtaaccgcggtaaccgacgttagacccgtagttccggacgtcggttaccgtaggtacctcgtcgtacgttaccggataccgtcgtacgtacgtcg

SEQ ID NO: 255335 - DNA, 599 bp, Homo sapiens
  misc_feature: GYAE6OF02GZ6C0.11.3.A03.1.454.CMB.1.raw
  modified_base (136)..(136): a, c, t, g, unknown or other
  misc_feature (136)..(136): n is a, c, g, or t
  modified_base (195)..(195): a, c, t, g, unknown or other
  misc_feature (195)..(195): n is a, c, g, or t
  modified_base (351)..(351): a, c, t, g, unknown or other
  misc_feature (351)..(351): n is a, c, g, or t
  modified_base (372)..(372): a, c, t, g, unknown or other
  misc_feature (372)..(372): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
  modified_base (483)..(483): a, c, t, g, unknown or other
  misc_feature (483)..(483): n is a, c, g, or t
  modified_base (569)..(569): a, c, t, g, unknown or other
  misc_feature (569)..(569): n is a, c, g, or t
  modified_base (572)..(573): a, c, t, g, unknown or other
  misc_feature (572)..(573): n is a, c, g, or t
  modified_base (591)..(594): a, c, t, g, unknown or other
  misc_feature (591)..(594): n is a, c, g, or t
  modified_base (596)..(598): a, c, t, g, unknown or other
  misc_feature (596)..(598): n is a, c, g, or t
tcagcgagagataccacgaccggtgctcgatttagagagcgtcacagggtcctgggcccagtctgtgctgacgcagccgccctcagtgtctggggccccagggcaggacggtcaccatctcctgcacgtggaaacngctccaacgttcggggcaggttatgatgttcactggtaccagccaccttccaacaaacncgacccccaaatcctcaatatagtacggtaacagtctacgttccggccctcgacggggtccctacggaccgtacttctcgttcggtttccttggtccgttcgactacctcacgtccctcccgtcggccaatcgacgtcgggctccacgcctggagntcggaggctgtattacgttancgtactacgttcttagactatttaaacnggtnttgtggttacgtgggaccgtaacggccctaacggtaccgtacgtaggtcacgtacccgagtccaccgtcccgtcgtacncgtaccgtccgtccccgtccttcctagttcctgtccctacgcgtacgggtcgtcgggtacctcggacggtacgtccgagttaacgngtnntgcgtatccatgcagtcnnnncnnnc

SEQ ID NO: 255336 - DNA, 481 bp, Homo sapiens
  misc_feature: GYAE6OF02HFD0P.11.3.A03.1.454.CMB.1.raw
  modified_base (423)..(423): a, c, t, g, unknown or other
  misc_feature (423)..(423): n is a, c, g, or t
  modified_base (461)..(461): a, c, t, g, unknown or other
  misc_feature (461)..(461): n is a, c, g, or t
  modified_base (467)..(481): a, c, t, g, unknown or other
  misc_feature (467)..(481): n is a, c, g, or t
tcagcgagagataccacgaccggtgctcgatttagagagcgtcacagggtcctgggcccagtctgtgctgacgcagccgcccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactggctccagcctgaggatgaggctgattattactgtcagttcctttgacatttaactggatgtggtattcggcggaggacccacgtaccgtctaggtcagccaaggctcgcccctcgcactctcgttcccnccctcctcgtctctctcgctgacgcgggctggcaggcncatagnnnnnnnnnnnnnnn

SEQ ID NO: 255337 - DNA, 783 bp, Homo sapiens
  misc_feature: GYAE6OF02IXNDP.11.3.A03.1.454.CMB.1.raw
  modified_base (205)..(205): a, c, t, g, unknown or other
  misc_feature (205)..(205): n is a, c, g, or t
  modified_base (756)..(756): a, c, t, g, unknown or other
  misc_feature (756)..(756): n is a, c, g, or t
  modified_base (771)..(771): a, c, t, g, unknown or other
  misc_feature (771)..(771): n is a, c, g, or t
  modified_base (780)..(781): a, c, t, g, unknown or other
  misc_feature (780)..(781): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgcccccaaactccncatatatggtaacagcattccggcccctcgacgggggttcccctaggacccgtatttcctcgttcggtttccctttgtcctacggaacctaccctcacgccccgttccccgtcggcctaactccgacgtcggggtaccctcccgacggtccgtgggaacgggtacgtacgggacggtccttagggttaactttttaactttaaccgttggttacccttaacggtttcccgtttttagaacgttaaaacgtttttaaaacggtcgggtattttaggggttacggtttaacggtttccggggggaaccgggtaaccggggtaacccccgtaaacggtttaaaccccggttacccgttaggttaaccggaaccgtacccgtaacgggtacccgtcccggtacccccggttaccggtaccctaccgttacccgttcccgtttacccctaccccgtttcccgttaccgttaccttcccttccgtccgtcgtcggtacgggtccgggtacgttcgggtaccgtacgggccggtacgacgttacgacgtgactcggancgtgcttagctgtcncgagcgtanncg

SEQ ID NO: 255338 - DNA, 718 bp, Homo sapiens
  misc_feature: GYAE6OF02FTI5U.11.3.A03.1.454.CMB.1.raw
  modified_base (301)..(301): a, c, t, g, unknown or other
  misc_feature (301)..(301): n is a, c, g, or t
  modified_base (682)..(682): a, c, t, g, unknown or other
  misc_feature (682)..(682): n is a, c, g, or t
  modified_base (689)..(689): a, c, t, g, unknown or other
  misc_feature (689)..(689): n is a, c, g, or t
  modified_base (694)..(694): a, c, t, g, unknown or other
  misc_feature (694)..(694): n is a, c, g, or t
  modified_base (697)..(697): a, c, t, g, unknown or other
  misc_feature (697)..(697): n is a, c, g, or t
  modified_base (711)..(711): a, c, t, g, unknown or other
  misc_feature (711)..(711): n is a, c, g, or t
  modified_base (715)..(715): a, c, t, g, unknown or other
  misc_feature (715)..(715): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacagcctccaacggtcggggcaggttatgatgttcacgtggtaccagccaccttccaacaaacacgacccccaaactcctcatatagtcggtaacacgtcacttccggcccctacgtacggggtccctaggaccgtattcctcgttcggttccttagtcctgaccacctnacgtccctcccgtggacccattccacgtcgggacctcccgacggccctaggaggtactcggaggtctgtaacgttttattaccgttggttccacgtttccttacgaaaccttaagtttaaacgtcgggtatttcgggttaacgggtttacggttccggggaacgggggtaacccgggaaccccgttaaaccgggttaaccccgtttacggaccgggttaccgaaccggtacccgaaacgggtcccgtcccgtacccccggttcgggtccctacccgttccgttacccgttacccctacccgttcccgttacgttaccttcctaccgttccgtcgtacggtacggccgggtaccgtcggacgacggtccgagtacgtacgcncgtacgntacgncgngtcgatcgcgtgcngtcngcg

SEQ ID NO: 255339 - DNA, 747 bp, Homo sapiens
  misc_feature: GYAE6OF02H7QXT.11.3.A03.1.454.CMB.1.raw
  modified_base (727)..(727): a, c, t, g, unknown or other
  misc_feature (727)..(727): n is a, c, g, or t
  modified_base (731)..(733): a, c, t, g, unknown or other
  misc_feature (731)..(733): n is a, c, g, or t
  modified_base (735)..(735): a, c, t, g, unknown or other
  misc_feature (735)..(735): n is a, c, g, or t
  modified_base (737)..(739): a, c, t, g, unknown or other
  misc_feature (737)..(739): n is a, c, g, or t
  modified_base (741)..(743): a, c, t, g, unknown or other
  misc_feature (741)..(743): n is a, c, g, or t
  modified_base (745)..(746): a, c, t, g, unknown or other
  misc_feature (745)..(746): n is a, c, g, or t
tcagcgagagataccacgaccggtgctcgatttagagagcgtcacagggtcctgggcccagtctgtgctgacgcagccgccctcgagtgtcgtggggccccagggcaggacggtcaccatctcctgcactggaaacagcctaccaacggtcggggctaggttatgattgttccacgtggtaccagcctaccttaccaacaacaccgtacccccaaacgtcctacattatagtacggtaacagactacgttccgggccctggaccggggtccctagtaccgtacttccttcggttgtttacccttggtctagtacctacctcgacgtccctccgtacggacctattccgtacggtcggaccctccgtacgtccgtaggacggtagttacggacggtacttacggttaacttaacgtttacttcgtacgttacgttccgtttcaaacgttaagtttaacgggttaacggttggttaacggttacggttcccggggaacggaacccggggtaccaacccggtttaccggttacccgttaggtacccgaccggtacccgtaaacgggtcccgtacccggtccccggttaccggttacctacccgttaccgtttccccgttaaccccctacccgttttaccgtacttaaccgtttctcccgtcggttccgtcggggtaaccgggcccgggttacgtacggaccggaaccgtcgtaccgaagttcggactggnacgnnntncnnngnnncnng

SEQ ID NO: 255340 - DNA, 727 bp, Homo sapiens
  misc_feature: GYAE6OF02JC978.11.3.A03.1.454.CMB.1.raw
  modified_base (134)..(134): a, c, t, g, unknown or other
  misc_feature (134)..(134): n is a, c, g, or t
  modified_base (157)..(157): a, c, t, g, unknown or other
  misc_feature (157)..(157): n is a, c, g, or t
  modified_base (336)..(336): a, c, t, g, unknown or other
  misc_feature (336)..(336): n is a, c, g, or t
  modified_base (705)..(705): a, c, t, g, unknown or other
  misc_feature (705)..(705): n is a, c, g, or t
  modified_base (714)..(715): a, c, t, g, unknown or other
  misc_feature (714)..(715): n is a, c, g, or t
  modified_base (717)..(718): a, c, t, g, unknown or other
  misc_feature (717)..(718): n is a, c, g, or t
  modified_base (720)..(720): a, c, t, g, unknown or other
  misc_feature (720)..(720): n is a, c, g, or t
  modified_base (722)..(727): a, c, t, g, unknown or other
  misc_feature (722)..(727): n is a, c, g, or t
tcagcgagagataccacgaccggtgctcgatttagagagcgtcacagggtcctgggcccagtctgtgctgacgcagccgccctcagtgtctggggccccagggcagacggtcaccatctcctgcactggaaacngctccaacgtcggggcaggttangatgttcactggtaccagcaccttccaacaaacacgaccccccaaactcctacataatataggtaacagcctagttccggcccctcgacgggggttcccctaggacccgtattccgtcgttcggtttcctttgtctcgaccacctcaccgccctcccgtcggccatccacgtgggtccnccgagtccgtggaggtatgggacggtctagtaatttagttactggtctagtttccctttagaacttaacgtttaaacgtgggtaagtttcggttagggtttacgtaccgggggacgggtaaacgaacccggtaaccccgttaaaccgggtttaaccccgttcccggttaagggtacccgaacccggtaaccccggaaaccgggtcccgtaccccgggtcccccgttaccgggtaccctacccgtttcccgttcccggtttccccccgtaccccttacccgttaccggttaccttcccgttacccggtccgtccgtacgggtaccgggtccggggtccgtacgggacgtacggggccacgtagtacggcngatcgtacnngnncncnnnnnn

SEQ ID NO: 255341 - DNA, 752 bp, Homo sapiens
  misc_feature: GYAE6OF02JUQOI.11.3.A03.1.454.CMB.1.raw
  modified_base (159)..(159): a, c, t, g, unknown or other
  misc_feature (159)..(159): n is a, c, g, or t
  modified_base (178)..(178): a, c, t, g, unknown or other
  misc_feature (178)..(178): n is a, c, g, or t
  modified_base (277)..(277): a, c, t, g, unknown or other
  misc_feature (277)..(277): n is a, c, g, or t
  modified_base (378)..(378): a, c, t, g, unknown or other
  misc_feature (378)..(378): n is a, c, g, or t
  modified_base (447)..(447): a, c, t, g, unknown or other
  misc_feature (447)..(447): n is a, c, g, or t
  modified_base (698)..(698): a, c, t, g, unknown or other
  misc_feature (698)..(698): n is a, c, g, or t
  modified_base (703)..(703): a, c, t, g, unknown or other
  misc_feature (703)..(703): n is a, c, g, or t
  modified_base (712)..(712): a, c, t, g, unknown or other
  misc_feature (712)..(712): n is a, c, g, or t
tcagcgagagataccacgaccggtgctcgatttagagagcgtcacagggtcctgggcccagtctgtgctgacgcagccgccctcagtgtctgggccccagggcagacggtcaccatctcctgcacgtggaaacagcctccaacggtcgggctaggttangatgttcacgtggtaaccngcctaccttccaacaaaccacgccccccaaaacttcctacaatatacgtacgggtaacacgtactacgtttcccggcccctacggaacggggttccccngaacccgtattcctcgtagtttccctgtacgtccgaaccacccgtacgcgttcccccgtccggtagccctaagttccctaacggtcgggttcccctaaccncggtcccctagggtaaacgtcgttggaaccggtctaggtaactttacgtcgtgtctaccggttacgttntaaaccgtaatttaaacgtgtaatttgggtacggttactcgggaccggggaacctacccgttaaacccgttaccgccggtttaagcccgaaaccggtccgtaaccgggtcgtcccccgtcccggtacgttccctaccgttcggttaccccgttcccccgcccttccggttaccctagtttcccgtccgtaaccgcggttacggtacccgggcggttaacgtcgggccgtaacctccgagttaagtcgtccnccgtnacgtctcgngtcaccgtccgacgtacgtacgtcgtacgtacgtacgtcg

SEQ ID NO: 255342 - DNA, 959 bp, Homo sapiens
  misc_feature: GYAE6OF02GPLAM.11.3.A03.1.454.CMB.1.raw
tcagcgagagataccacgaccggtgctcgatttagagagcgtcacagggtccgtggcccagtctgtgctgacgcagccgccctcagtgtctggggccccagggcagacggtcaccatctcctgcactaggaaacagctccaacggtcggggcaggttatgattgttcacgttcggtaccagctaccttaccaactaaaccaccgacccccaaactcccgtactaactacttagtacggtaacgacgtcgtacgttcccggtcccctacggtaccgggggttaccccgtaggaacccggttactttcccgttaccgtttcggttttaccgtttcggttacttaccggtaacctaacccgtccgaccgtacccttccccgtacggccctaagttccacgttcgggaccctccgaggtccctgggaacggtgtccggtacgtcgttagtactttaacgttacgtgtccgtacgttccgttagtaaccttaaaccggttaacgtacggtagtttacgggttacgttacgggttacccggggcgggtaaacccggggttaacccccgtaacccggtttaacccgggtttaccgttaaccgggtttacccggaaccccggtaaccccgggtaaccggttcccccgtttaaccccccggggtcccccccgggtttaggggttaaccccttacccggtttacccgggttttacccccccgggtttaccccccggtttacccccgttttaccccgggtttaccccgggttttaaccgttccccgtttacccgggttcgttaacccggggttaacgggccccggggtttcccggggtaaccggggttacgggtaaccccgggttacgggggtaaccccgttacggttaacgggttacccgttaggccgtttaagcccggggtaactcgcgtacgtcgacggtaccgtctacgtagtacgtctacgtacg

SEQ ID NO: 255343 - DNA, 532 bp, Homo sapiens
  misc_feature: GYAE6OF01BGHQZ.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtcttagttgaagaagcctggggcctcagtgaaggtttcctgcaaggcttctggatacaccttcactacctatgctatgaattgggtgcgacaggcccctggacaagggcttgagtggatgggatggatcaacaccaacactgggaacccaacgtatgcccagggcttcacaggacggtttgtcttctccttggacacctctgtcagcatggcatatctgcagatcagcagcctaaaggctgaggacactgccgtgtatttctgtgcgagaggttcagggagcgaggtcggctgggtccgaggggcgggggattcgggacttacggtcggggccgaggggtaaccccg

SEQ ID NO: 255344 - DNA, 558 bp, Homo sapiens
  misc_feature: GYAE6OF01E4HPN.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacaccttcactacctatgctatgaattgggtgcgacaggcccctggacaagggcttgagtggatgggatggatcaacaccaacacgtagggaacccaacgtatcgcccagggcttcacgaggtacggtttgtcttctccttggacctacctctgtcagcatggcatatctgcagatcagcagacctaaaggctaggacggacactgccgtgttactttcgtgtgcgaggtaggttcgagggagcgtaggtggcgttcgggtcccggagggggtcgggggtagttcggaacgttacggtcgggggcccgtaaccggggg

SEQ ID NO: 255345 - DNA, 722 bp, Homo sapiens
  misc_feature: GYAE6OF01CCMJI.23.76.G10.1.454.CMB.1.raw
tcagacgcgagtatcacgaccggtgctcgatttagtcactcatacaggggacccaacaaccgacacccctcctaagaagaagccccgtagaccacagctccacaccatggacctggacctggagatcctcttcttggtggcagcagcaacaggtgcccactcccaggtgcaactggtgcaatctgggtctgagttgagagcctggggcctcagtgaaggtttcctgcaaggcttctggatacaccttcacttacctatcgctatgaattgggtgcgacacggcccctggacgaaggcttgacgtggatggtatggatcaacaccaacgacgtcgggaacccaacgtatcgcccgagggccttcgacgtacggtacggtttcgtacctttcgttcccgttggaccctacccgttcctcggttccaacggtccaacgttcgggacctaagttacgttacgtgtaccgtaggtacttaccgtaagtacccgaacggtacccgttaaaagggtcctttaagggtaacgggtaaccctacgttaccggtaccccggtttaggtttacgttttccgttcgggttacggtaccggtaagggttacggtttaccgaagggtaacggtaccggtaagggttcgggtacggttcggggtacccggaacggggggtaccgggggtactttcgggtaacccgttcgggttccgggggtacccgtaacccggggg

SEQ ID NO: 255346 - DNA, 569 bp, Homo sapiens
  misc_feature: GYAE6OF01BITX6.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacaccttcactacctatgctatgaattgggtgcgacaggcccctggacaagggcttggagtggatgggatggatcaacaccaacactacgggaacccaacgtatcgccaggcttcacgaggtacggtttgtcttctccgttggactacctctcgtcagccagtcggcatactctgcagatcagcagacctaaggctagacgacacgtgccgtgttatttcgtgtgcgtaggtaggttacgagggtagcgtagggtggtcggtcgggtaccggaggggggtccgggggtattacgggaccgttacgggtcgggggcccgtaaaccggggg

SEQ ID NO: 255347 - DNA, 558 bp, Homo sapiens
  misc_feature: GYAE6OF01DPLME.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacaccttcactacctatgctatgaattgggtgcgacaggcccctggacaagggcttgagtggatgggatggatcaacaccaacactgggaacccaacgtatgcccagggcttcacaggacggtttgtcttctccttggaccacctctgtcagcatggcatatctgcagatcagcagacctaagctgagacactgccgtgttactttcgtgttggcgaaggtacggttcgagggtagcgtaggttcgggcgttggggtacccgaggggggtcgggggtaatttcgggacgttaccggtgggggcccgtaaacccggggg

SEQ ID NO: 255348 - DNA, 570 bp, Homo sapiens
  misc_feature: GYAE6OF01BEGZR.23.76.G10.1.454.CMB.1.raw
  modified_base (447)..(447): a, c, t, g, unknown or other
  misc_feature (447)..(447): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacaccttcactacctatgctatgaattgggtgcgacaggcccctggacaagggcttgagtggatgggatggatcaacaccaaacacgtagggaacccaacgtatcgccccgagggccttcacgaggtacgtttgtcttctccttggactacctctgtcagcatggcatatctgcagatcagcaagtacctaaaggcgtagacggacncgtgcgttgtatttctggtgcgtaggtagggttcgagggacgtcgagggttggcggttcggggtccggagggggacgggggtattacgggaccgttacgggtcgggggcccggtaaccggggg

SEQ ID NO: 255349 - DNA, 688 bp, Homo sapiens
  misc_feature: GYAE6OF01CR1DU.23.76.G10.1.454.CMB.1.raw
  modified_base (236)..(236): a, c, t, g, unknown or other
  misc_feature (236)..(236): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttcnggatacctaccttcactacctatgactatgaattgggtgcgacacggcccctggacagggcttgaggtggatgggatggactcaacaccaaacacgtacgggaaaccaacggtaatgaccccgaggtccttacgacgaggtacggttttcgtcttcgttcccgttacgggtacctaacccgttcttcggtactacgacgtaacttcgggacctaagttacttccgtaggaccaaggtacttacgaggacctaaggtaccttaaaacgggccgttaaggaacgggtaacctaacgttccggtacccggtttaagtttacttttccggtaggttacggaccggtaaggttagggttcccgaagggacggtacgtagggtacgggtcgttcggggtacccgaggggggtacggggtattacgggacgttacgggcgggggacccgtaaacggggg

SEQ ID NO: 255350 - DNA, 745 bp, Homo sapiens
  misc_feature: GYAE6OF01C9EEL.23.76.G10.1.454.CMB.1.raw
  modified_base (210)..(210): a, c, t, g, unknown or other
  misc_feature (210)..(210): n is a, c, g, or t
  modified_base (382)..(382): a, c, t, g, unknown or other
  misc_feature (382)..(382): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagctggggcctnagtgaaggtttcctgcaaggtcttctggatacaccttcactacctatgctatgaattgggtgcgacaggcccctaggacaagggtcttggagtggatgggatggatacaacaaccaacacgtacgggaacccaacggtatcgccgtaagggcttcaacgtaggtacggtttnttaccttcttccgtttcggacctacccgtcgtcgtacacggtcctagtacgggtactaagttacgttccgttagacgtaacggtaactccgtaacggaccgtaaccggtaacccgtaaaaggggtcccttaagggaaccggtaacccgttacgtaccgggttaccgtttagggtttaaccttttcggtacggttagggaccggttaagggttacgggtttaccgggacggggtaagtacccggttaaggggtccgggtacgggttcccggggttaacccgggtaggggggggtacccgggggttaagtttaccgggaccgggtttaaccggggtccggggggaaccccggtaaacccgggggg

SEQ ID NO: 255351 - DNA, 697 bp, Homo sapiens
  misc_feature: GYAE6OF01CSIXK.23.76.G10.1.454.CMB.1.raw
  modified_base (273)..(273): a, c, t, g, unknown or other
  misc_feature (273)..(273): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacaccttcactacctatgctatgaagttgggtncgacaggcccctggacagggcttgagtggatgggatggatcaacaccaacgacgtacgggaaaccccaagtactcgaccccgagggtcctttacgaacgtagggtaccggttttcgttcctttccgttcccgtttcgggaacctaccccgttcgttcggtcgtacggcctaagttcgggactaattaacttcgttggacctaaggtattaccgaacggtaccgaacggtacccgttaaaagggcccgttaggaacggtaacctacgtcggtaccgtttagtttactttcgtggttacggacggtaaggtacgggtttccgaagggtacggtaccggtagggttggttccggttcggggtccgggaacggggggtcgggggtaattcggggaccgttaccgggtcgggggacccgtaaccggggg

SEQ ID NO: 255352 - DNA, 584 bp, Homo sapiens
  misc_feature: GYAE6OF01D5E89.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtcttagttgaagaagcctggggcctcagtgaaggtttcctgcaaggcttctggatacaccttcactacctatgctatgaattgggtgcgacaggccctggacaagggcttgagtggatgggatggatcaacaccaacacgtggaacccagtatcgcccagggcttcacgaggtacgtttgtcttctccgttggactacctctgtcagcagtggctatatctgcagatcagcagcctaaaggcctaggaggacacgtcgtaccgttagttacttttcgagttggccggtaggtacgggttcgaagggtagccggtagggtcggacggttcggggtcccggaggggggtcccggggtattcggtaacgttacgggtcgggggcccgacggggtaaccccgg

SEQ ID NO: 255353 - DNA, 580 bp, Homo sapiens
  misc_feature: GYAE6OF01EDXKQ.23.76.G10.1.454.CMB.1.raw
  modified_base (477)..(477): a, c, t, g, unknown or other
  misc_feature (477)..(477): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctgatacaccttcactacctatgtctatgaagttgggtgcgacacggcccctggacaagggcttggagtggagtgggatggatacgaacaccaacgacgtacgggaacccaacgtatcgaccgtagggcttacgacgtaggtacggtttgtctttctccgttggacctacgtctgtacagctagtcgctatatcgtgacgagactcgagcacgtaccgtaagcgtagagacacgtcgtcgttnttattcgtagtgtacgagtacggttcgaggtagcgtaggtcggtacgtgggaccggagggggcggggtatacggtacgttacgggcgggacccgtaaccgggg

SEQ ID NO: 255354 - DNA, 596 bp, Homo sapiens
  misc_feature: GYAE6OF01A3JIC.23.76.G10.1.454.CMB.1.raw
  modified_base (272)..(272): a, c, t, g, unknown or other
  misc_feature (272)..(272): n is a, c, g, or t
  modified_base (469)..(469): a, c, t, g, unknown or other
  misc_feature (469)..(469): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacaccttcactacctatgctatgaattgggtncgacaggcccctggacaagggcttgagtggatgggatggatcaacaccaacacgtagggaacccaagtatcgacccagggcttacgacgaggtacggtttgtacttctccttggactaccttctcgtcagcagtcggacatatctgcaagatcagcagacctaaggctagacggacacgtagccgtagttatttcgngttgacggaggtacggttcgagggtagaccggtagggttggccggttgggtacccgggagggggtccgggggttaagttacggtaaaccggtttaccgggtcggggggtacccgtaaacccgggggg

SEQ ID NO: 255355 - DNA, 732 bp, Homo sapiens
  misc_feature: GYAE6OF01DOE0Y.23.76.G10.1.454.CMB.1.raw
tcagacgcgagtatcacgaccggtgctcgatttagtcactcatacagggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagccgtggggcctcagtgtaaggtttcctgcaaggtcttcgtggatacaccttcacttacctatgctatgtagttggtgacgacgacggtcccctaggacgaagggtcttggagtggagtgggatggatacaaacaccaacgacgtacgggaaacccagtactcggacccgaggtaccttacgaacgtacgggttacggttttacgtcctttccgtaccgtttacggaaccctccgttcgtcgtacacgtctagtggacctagttactctagacgtaagtactacaggtacctaacgtaccgtaaacggcgtaagggaacgaacctaccgtcggtacccggtttagtttaaccgttttccggtaggtacgggtaccggtaagggttacgggttaccgagggtacggtaccggttaacgggttcggggtacccggttcgggggttacccggggtaagggggggttaccgggggttagtttaccgggtaaccgggttacccgggggttccgggggaacccgggttaaacccgggggg

SEQ ID NO: 255356 - DNA, 698 bp, Homo sapiens
  misc_feature: GYAE6OF01EIRN3.23.76.G10.1.454.CMB.1.raw
  modified_base (412)..(412): a, c, t, g, unknown or other
  misc_feature (412)..(412): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagccgtggggcctcagtgaaggtttcctgcaaggtcttctggatacaccttcactacctatgctatgtaattgggtgcgacacggcccctggaacgaagggtcttggaggtggagtggggatggtatacgaacaccaacgacgtacgggaaacccacgtacgtcgccgaggcttacgacgtaggtacggtttgtcttctcgttagacctacctntcgtcagtcagtcggactatacttcgtcgactaggactacgacgacgtacgtaaccgtaaggtcgtaggaacggacgtacgtcggtaccgtttggttaactttcggtaggtcggtacgggtagggttaacgggttacgaacggggtacggtacggtagggttccgggacggtttccggggggtaaccggggtacgggggggtaccgggggggtttacgtttaacccgggaaacccgggttttacccggggggttaccggggggaccccgggttaaaaccccggggg

SEQ ID NO: 255357 - DNA, 755 bp, Homo sapiens
  misc_feature: GYAE6OF01C6638.23.76.G10.1.454.CMB.1.raw
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (261)..(261): a, c, t, g, unknown or other
  misc_feature (261)..(261): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtcgcccactcccaggtgacaactggtgacaatcgtgggtctgagttgaagaagccgtgggctcgagtgaacgtttcngcgaaggtctntgatacacttcactacctagtnctatgtaagttggggtacgcgaaccgacggccccgtaggaaccgaaaggggtctttaggaagttaggagtggggagtaggactacaaaccaaccaaacgtaacgacgggaaacccctaagtacgtacgacccgtagggtaccttacgaacggaacgggttaacggttttgtccgtttcctcgtttacgggaacctaaccgttccgttcggtactacgggacctaagttcggacctaattaacgtccttagacgaagttacacgacgacaacgtaaccgtaacggtacgtagaacgaacgaacgtacggtaccggttacgttaacgtttcgttcggtacggtacggtaacgggtaacggttacgggttaacgggacggtacggtagggtagggtacggttacgggttaccggggtaacgggggtacggggggttaacgggttacgggttaaccggttaacgggttaccgggggaacccggggtaaaccccggggg

SEQ ID NO: 255358 - DNA, 648 bp, Homo sapiens
  misc_feature: GYAE6OF01DO1E3.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagccgtgggcctcagtgaaggtttcctgcaaggcttcgtggatacaccttcactacctatgctatgaagttgggtgcgacacggcccctaggacgaagggcttggagtggagtgggatggatacaacaccaacgacgtacgggaaaccccaaggtactcggaccccgtagggtcttaccgacgtacgggttacgggttttcgtacctttccgtcccgtttacgggacctacccgttctcggtccacggtcacgttggactatactcgtgcagtactcaagccaacgtaccgtaaaggcgtaggacggacctacgtggtcccgttagttacgtttcgtggtacggcgtaagggtcggttcgaaggtgtccggtaggtcggtcggttcggggacggagggggtcggggttagttcggacggttaccgggtcgggggacccgtaacccggggg

SEQ ID NO: 255359 - DNA, 598 bp, Homo sapiens
  misc_feature: GYAE6OF01A7I0L.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacaccttcactacctatgctatgaattgggtgcgacacggcccctggacaagggcttgagtggatgggatggatcaacaccaacacgtacgggaaccccaacgtatcgcccgaagggccttacgacgtacggtacggttttcgtcctttctccgttggacctaccttcgtgtcagtctagtcggctatatctgcagactcagcacgaccctaaggctaggaacgacacgtcgtccgttagttactttcgtgtaggcgtaggtaggttacgagggtacgcgtaggtggcggttcggggtccggagggggtacggggtattacgggtaaccgttacgggtcggggacccgtaaccggggg

SEQ ID NO: 255360 - DNA, 815 bp, Homo sapiens
  misc_feature: GYAE6OF01BPW6U.23.76.G10.1.454.CMB.1.raw
  modified_base (226)..(226): a, c, t, g, unknown or other
  misc_feature (226)..(226): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagccgtggggcctcagtgaaggtttccngcaaggcttctggactacacttcactacctatgctatgtaattgggtgcgacgacgggcccctagggaaccgaaggggtccttaggaggttaggagttaggggattggaactaccgaacaaccaacgaacgtacgggaaacccctaacgtacgtaccggaccccgtaaggggtcctttacgaacggtaacggggttaaccggttttcgttccgtttacccgtttccccggtttacgggaacccttaaccccgtttcccggttacggttaccgaacggtaccgtaaccggttagggtacctaacggttaattcccgttaggacgtaacggtagttaaccgacggtaccgtaacggtaaaccgtaaacggggtccgttaacgggaaccgggtaaccctaacggttccgggttacccggtttacggttttaacttttccgggaggttacggtacggtaaggttaccggggttagtacgggtagccggtaaacgggttcgggttaccggtacggggtaccgggagggggggtaccggggttaggttacggtacccgggtttaacggggccggggtacccgggtaaaccggggg

SEQ ID NO: 255361 - DNA, 662 bp, Homo sapiens
  misc_feature: GYAE6OF01CAPP1.23.76.G10.1.454.CMB.1.raw
  modified_base (236)..(236): a, c, t, g, unknown or other
  misc_feature (236)..(236): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttcnggatacaccttcactacctatgctatgtaattgggtgcgacacggcccctggacaagggtcttgagtggatgggatggatcaaacaccaaacgacgtacgggaaaccccaacgtactcgacccgagggtccttacgacgaggtacgggttttgtcctttccgtcccttaggacctaccttcgtcgttcacggctagtggacctaattactccgtgaccaaggtactcgaagtcgaacgaccgttaaaaggcgttaggaaggaacctacgtcggtcccggttagtttactttccgtggtcgacggtaggtacgggttacgagggagccgtaaggtggggtaccgttcgggtacccgggagggggtaccggggggtaacgttacgggaacccggtttacgggtccgggggacccggtaaaccgggggg

SEQ ID NO: 255362 - DNA, 686 bp, Homo sapiens
  misc_feature: GYAE6OF01A8AF7.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggcgcaactggtgcaatctgggtctgagttgaagaagcctggggcctcagtgaagtttcctgcaaggcttctggatacaccttcactacctatgctatgtaagttgggtgcgacgacggcccctaggacaaggtctgaggtggagtgggatggatcaacaccaacgacgtacgggaacccaacgtatacgacccgtagggtccttacgaacgtaagggttaccggtttacgttcctttcgtaccgtttacggacctaccttcgtcgtacgacgctacgtacggctaagttctcgtacgacgtagactacgacgtacgacgtaaccgtaaacggcgtaacggaacgtaccgtaaccggttacgtaccggtttacgtttacgttttacgtggttacgggtacggtaaggtacgggttcgaagggacgtcggtaaggttcgggtacggtcggggtaccgggtagggggtaccggggttacggttacgggaaccggttacgggtcgggggtacccggtaaaccgggg

SEQ ID NO: 255363 - DNA, 665 bp, Homo sapiens
  misc_feature: GYAE6OF01CECIU.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggagatcctcttcgttggtggcagcagcaacaggtcgcccactcccaggtgcaactggtgcaatcgtgggtctgagttgaagacgcgtgggcctcagtgtaaggttccgtgacgaaggtcttctggactactaccttcgactacctatgtctatagtaagttgggtgcgacgacggcccgtacggacgaaggtcgtggaggtaggtagtgggagtggatacgaacaaccgggggaacacgtacggaaccgaacgtacgtacgaccgacggtacgtaccgacgtacggtacggtttacgttccgttccgttccgtacggtaccgtacctactcgtcgacgctacgtcgtactactatcgtcgacgacgacgtacacgtacgtaacgtaaccgtaacggtacgtagacgtactacgtacgtacgttagttacgtttacgttgtacggtacgtagtacggtcggaggacgtaggtacggtaggtacggtcgggaccgggtaggggtacgggtacggttacggacggtacgggtcgggtaccggtaaccggg

SEQ ID NO: 255364 - DNA, 583 bp, Homo sapiens
  misc_feature: GYAE6OF01D9PHE.23.76.G10.1.454.CMB.1.raw
  modified_base (371)..(371): a, c, t, g, unknown or other
  misc_feature (371)..(371): n is a, c, g, or t
  modified_base (406)..(406): a, c, t, g, unknown or other
  misc_feature (406)..(406): n is a, c, g, or t
  modified_base (411)..(411): a, c, t, g, unknown or other
  misc_feature (411)..(411): n is a, c, g, or t
  modified_base (458)..(458): a, c, t, g, unknown or other
  misc_feature (458)..(458): n is a, c, g, or t
  modified_base (484)..(484): a, c, t, g, unknown or other
  misc_feature (484)..(484): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagccgtggggcctcagtgtaaggtttcctgcaaggtcttctggatacaccttcactacctatgctatgaattgggtgcgacacggcccctggacgaagggcttggaggtggagtgggatggatcaacaccaacacgtgggaacccagtatcgccgaggctcagaggtcgtttntcttctccgtgactacctctgtcagtcatgctatntctgnagactcagcagaccgtaagctagacgacactcgtcgtgttatttcgngtcggacgtaggtacggttcgaaggngtacggtacgggttgggccggttcggggacccggagggggggtcggggtagtttacgggaaccggttacgggtcggggggaacccggtaaacccggggg

SEQ ID NO: 255365 - DNA, 697 bp, Homo sapiens
  misc_feature: GYAE6OF01DRCOX.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggagatcctcttcttggtggcagcagcaacaggtgcccactcccaggtgcaactggtgcaatctgggtctgagttgaagaagccgtggggcctcagtgtaaggtttcctgcaaggtcttcgtggataccaccttcactacctatgctatgtaattgggtgcgacacggcccctggaacgaagggtcttggaggtggagtgggatggatcaaacaccaacacgtacgggaacccaacgtactacgacccgaggtccttacgaacgtacgggtacggttttcgtctttccgttccgttcggacctacccgttgttcgttaccgacggtctacgtcggacctaagttacttcgtacgtactaagtacgtccaagtaccgtaaccgtaccgtaaaacgggcttaagggacggtacaccgttcggtacccgttaggttacttttcgtaggtcggtacgtacgggtacggttacggagggtagaccggtagggttcgggtcttacggggtcccgggtaaggggggtacccggggttagttacgggtaccgtaacggggtccggggggtacccggtaaacccggggg

SEQ ID NO: 255366 - DNA, 661 bp, Homo sapiens
  misc_feature: GYAE6OF01DQ1PJ.23.76.G10.1.454.CMB.1.raw
  modified_base (472)..(472): a, c, t, g, unknown or other
  misc_feature (472)..(472): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttgggtggcagcagcaacaggtgcccactccccaggtgcaactggtgacaatcgtgggtctggagttgaagagccgtggggcctcgagtggtaacggtttcctgacaaggtcttcgtggactactaccttcacctacctatgtacctatggtaagttggggagccgaccgtacggccccgtagggaccgtaagggtcttaggaggttggaggttgggagttggactaccgaaacaaccaacgtacgtacgggaaaccccgtaagtacgtcggaccggtaggtacttacgacgtacgggttaccgtttgtaccttctccgtagcctacctgtcgtacacgtnagtcggtacagttactctgacagtcacgacgacacgtacgtacgtacgacggtacacgtccgtcggtaccgttagtttcgttcgtgacggtacggaaggttacggttacggaggtacggacggttagggtggtacggtcgggttcggaggggtcgggtagttcggacggtcgggtcgggacggtaccgg

SEQ ID NO: 255367 - DNA, 647 bp, Homo sapiens
  misc_feature: GYAE6OF01CG6DD.23.76.G10.1.454.CMB.1.raw
  modified_base (433)..(434): a, c, t, g, unknown or other
  misc_feature (433)..(434): n is a, c, g, or t
  modified_base (596)..(596): a, c, t, g, unknown or other
  misc_feature (596)..(596): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagagccgtgggcctgagtgtaaggtttcctgcgaaggtcttcgtggatacctaccttacactaccgtatgctatgtaagttgggtgacgacgacggccccgtaggacgaagggtcttaggaggtggagtgggatggatacaaacaccaacgacgtacgggaaaccctaagtacgcgacccgtaggcttacgacggtaacggtacgtttcgtcttcctcgttacgctaccgtctgtacnnctagtcgcaattctcgtgacagctagacgacggtaaccaacggtaacggccgtaagggaaccgacgtacgttaccgtcggtttactttgtttcccgttaggcggttaggagggttacgacggtacggacgtcggtaggtacgggacggttcggggtaccggnggggggtacgggtaagtcgaacggggtcggtccggggaaccggtacccggg

SEQ ID NO: 255368 - DNA, 727 bp, Homo sapiens
  misc_feature: GYAE6OF01CP4AI.23.76.G10.1.454.CMB.1.raw
  modified_base (257)..(257): a, c, t, g, unknown or other
  misc_feature (257)..(257): n is a, c, g, or t
  modified_base (436)..(436): a, c, t, g, unknown or other
  misc_feature (436)..(436): n is a, c, g, or t
  modified_base (449)..(449): a, c, t, g, unknown or other
  misc_feature (449)..(449): n is a, c, g, or t
tcagacgcgagtatcacgaccggtgctcgatttagtcactcatacaggggacccaacaaccacacccctcctaagaagaagcccctagaccacagctccacaccatggactggacctggagatcctcttcttggtggcagcagcaacaggtgcccactcccaggtgcaactggtgcaatctgggtctgagttgaagaagccgtggggcctcagtgaaggtttcctgcaaggcttctggataccaccttcactacctntgcttatgaagttggtgcgacaggccctggacaagggcttggagtggagtgggatggatacaacaccaacacgtacgggaacccaagtactacgacccgaggtccttacaacgtagggtacgttttgtccttcgttccgttcgaacctacctcttagcgtacgctagtcggactaagtnttacgtgactagntaccgagtccgtaacgaaccgttaacggcgtacggaacgggactaccgttaggtcccggtttacgtttaacgtttcggttacgggttacgggtaccgtaacgggttaacggggttcgtaaacggggtaggtacccgggtaggggttaccgggttaacccgggttacgggggtacccccgggggtaaaggggggttcccggggggttaacggtttaacccggggtaccggttaacccgggggtttacggggggtaaccccgggttaaaccccggggggg

SEQ ID NO: 255369 - DNA, 627 bp, Homo sapiens
  misc_feature: GYAE6OF01C7E3N.23.76.G10.1.454.CMB.1.raw
  modified_base (392)..(392): a, c, t, g, unknown or other
  misc_feature (392)..(392): n is a, c, g, or t
  modified_base (407)..(407): a, c, t, g, unknown or other
  misc_feature (407)..(407): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagagccgtggggcctcagtgtaaggtttcctgcaaggtcttctggatacctaccttcactacctatgtactatagtaagttgggtgacgacgacggccccgtaggaacgagggtcttggaggtggagtgggatggatcaacaccaacacgtacgggaacccaagtactcgccgaggtcctacacgaggtacggtttntctcgtccgtgaccnctcgtgtcagtcagtcggactatactctgacagtactcagtaccaggtacccgtaaggctaggacgtacctacgtacgtccgttagttactttcgtagttcggacgtaggttacggttacgagggtagtaccggtagggtcgggtaccggttcgggggtaccggtaggggggcgggttagttacggaccgttacggggtcggggtcccggtaaaccgggg

SEQ ID NO: 255370 - DNA, 1037 bp, Homo sapiens
  misc_feature: GYAE6OF01D3LEE.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttctggtggcagcagcaacaggtcgccccactccccgaggtcgacctaacgtgggtacgacctaagttccgtgggggtaccttggtaacggtttaggaaaacggaacggtccccgggttcgggggcccttaccgaacgggttagggtaaaccggggtttttcccgtagggaccgtaaacggggttccctttacggttacgggaacttaacccgtacccttaccgtaaccttacccttagtcgtaccttaagtaggttaacggttgggggtacgaccggtaaccgtaccgggtcccccggttaagggaacccggtaacggggttgtttacgggaagggtttacgggtaacggttagggggtaacgttacggggtaaacccttaacccgaaaacccgggtaaaccccaaaaaccgggtaacccgggttaaaccccggggaaaaacccccgtaaacgggtttaacccgacccgggtaccccggtaacgggttaccctttaacccggaaccggggtttaacgggggttaccggtttttacgtttaccccgtttacggtttaccccgttaaccgggtaaccctttaccccgttcgttaccggttacccgacgtaccgtacgttacggtacttaacgttaccgttacgtacgacgtacgtacgttaccgacgtaccgaacggtaacccgtaagtacggtaacgacgtaccgacgttacggtacccgtttaggttacgtttacggtcggttaaccggtacgggttaacggtacgggttacggtaacgggtaacggtacggttcgggttaccgggtacggttaccgggggtcggggtaaaccggggggttcgggtaaccgttacgggtaaacccgggtccggggggttaaccgggtaccccggttaaacccgggggg

SEQ ID NO: 255371 - DNA, 808 bp, Homo sapiens
  misc_feature: GYAE6OF01DNQEK.23.76.G10.1.454.CMB.1.raw
  modified_base (770)..(770): a, c, t, g, unknown or other
  misc_feature (770)..(770): n is a, c, g, or t
tcagacgcgagtatcacgaccggtgctcgatttagtcactcatacaggggacccaacaaccaccacccctcctaagaagaagcccctagaccacagcctccacaccatggactggacctggagatcctcttcttggtggcagcagcaacgaggtcgcccactcccgaggtgacaacgtggtgactaatcgtgggtctggtagttaggaagaacgtccgtggggcctcgaggtaggtaacggtttccgtagacgtaaggtcttcgtaggactacctaccttacactactagtcgtactagtagtagttggtacgaccgacgccggacccgtaggaacgtacggtcgttaggacggtaggaacggtgggtaagtacggtacctaaccgaaacccgtaaaccgaaacccgttaccgggtaacccgggaaaccccgtaaacggttaccgtaccggtaccccggtaacgggttcccttaaacggtaccgggttaacggggtttacggtttttaccgtacccgttttccgtaccgtttaccggaccctacccgtttcggtaccgtaccgtagtacccgttagtccggaacttaacttccggttcaggacctaacgtataccgacggtaccctaacggtaacccggtagtacggaacggtaccgtaattccggttcgttaccggttatttccgttacggtgaacggtggtaacgttacggtggacggacgttcgtacgggtgggtaccggtcggggtccgggaggggtttacccggnttaccgggtacgggtcgggcggttacccggaacccggg

SEQ ID NO: 255372 - DNA, 767 bp, Homo sapiens
  misc_feature: GYAE6OF01E3R1P.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatcgtgggtctgagttgaagaacgccgtggggcctcagtgtaaggtttcctgcaaggtcttcgtggactacaccttcactacctatgtctatgaagtttgggtagcgaccacggtcccctaggaaccgaagggtctttaggaggtggtaagtggggtactagggactaccgaaaccgaacccgaaacgtaccgtaacggggaaacccctaacgttaacgtccggaccccgtaagggtccttaacgaaccggtacgggttacggttttcggtcctttcgttacccgtttacggacctaccgttgtacggtactacgtctaggtcgtacgtaacttacgttcgtacgtaccgtaagtacgtacgacggtacctaacggtaaccgtaaaggccgttaaggacggaaccgttacggtacggttaccggttacgtttacgtttcggtcggttaacggtacgggtaacggttacggggttaccgaggggaacgtggtaccgggttagaccgggttccgggtacggggacggggggtaaccgggttcgttacggggtaaccggttaccggggtcgggtaacccgggtaacccgggg

SEQ ID NO: 255373 - DNA, 721 bp, Homo sapiens
  misc_feature: GYAE6OF01ATEO2.23.76.G10.1.454.CMB.1.raw
  modified_base (239)..(239): a, c, t, g, unknown or other
  misc_feature (239)..(239): n is a, c, g, or t
  modified_base (261)..(261): a, c, t, g, unknown or other
  misc_feature (261)..(261): n is a, c, g, or t
tcagacgcgagtatcacgaccggtgctcgatttagtcactcatacagggggacccaacaaccacacccctcctaagaagaagcccctagaccacagctccacaccatggactggacctggacggatcctcttcttggtggcagcagcaacaggtgcccactcccaggtgcaactggtgcatctgggtctgagttgaagaagccgtgggcctcgagtgaacggtttcctgcaaggcttcnggatacaccttcacttaccttntcgctaatgtaacttggggtgcgacacggcccctggacgaagggtcttggagtggtagtgggatggtataccgaaaccaccaaacgtaccgtacgggtaaaacccctaacggttacgtccgcccgtacgggtccttacgaacggtacgggtaccggttttcgtaccttttcgttcccggttacggaacctaccgttccgttacgtcggtaacgtcgtagtacggctaacgtctacgttgactaagtacgtacacggcgaacgtaacctaaagggctaggaaccggttctaaccgttcggtccggttagttaccggtttacgtacggtacggtaccggtaagttaaccggggttactagggtacgacgttacgggtcggtcggttaccggggtaccccggtaggggggtcccgggttaaagttccggtaacggtccggtcggggtaaccgtaacccggggg

SEQ ID NO: 255374 - DNA, 732 bp, Homo sapiens
  misc_feature: GYAE6OF01APEV4.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagccgtggggcctcgagttggtaaggtttcctgacgaaggtctttcgtaggactaccgtacccttcaccttaacctagtcgtacttatacggtagttgggtcgccgacgaccggccccgtaggacgtagggtctaggaggtggtaggtagggtagtaggactacgaaaccgaccgaaacgtacggtaccgggaaaccctaacggtaacgtccggacccggtacggtccttacgtacggtacgggttacgggtttcgttaccgtttccgttaccggttaccggtaccttccgttacgtcgtaccgacgtactaacggtcgtatacttaccgttcgtaggctaagtacgactacgtacgaaccgtaacggacgtcggtagacgtaccgtcgtacgtcgttagttagttgtacggtggacggtacggtaggtacgagggtacgacggtcgggttcgtacgggtacggggcccgggtaagggggtcgggttacggttaccgggaaggttcccgggtacggggtcccggtaacccgggg

SEQ ID NO: 255375 - DNA, 728 bp, Homo sapiens
  misc_feature: GYAE6OF01CUWP8.23.76.G10.1.454.CMB.1.raw
  modified_base (224)..(224): a, c, t, g, unknown or other
  misc_feature (224)..(224): n is a, c, g, or t
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (533)..(533): a, c, t, g, unknown or other
  misc_feature (533)..(533): n is a, c, g, or t
  modified_base (709)..(709): a, c, t, g, unknown or other
  misc_feature (709)..(709): n is a, c, g, or t
tcagacgcgagtatcacgaccggtgctcgatttagtcactcatacaggggacccaacaaccacacccctcctaagaagaacgcccctagaccacagctccacaccatggactggacctggaggatcctcttcgttggtggcagcagcaacgaggtcgcccactcccgaggtgacaacgtggtcgactaatcgtgggtctgtagttagaagacgccgtgggcctnagtagtacggttccngacaggtntcgtgactactaccttcactactatctactagtagtaggttgggtacgacgaacgaccggtacccgtagggaacgtaagggtctggtaggtaggtaggtggtagtcggtaactaccgaaaccaacctaacgtaacggtaaccggaaaccccgtaaggtacgaccggtaccggtacggtacctaacggacggtaacgggtttacgtttcgttcttaccgtcggttacggaccctacgttcgtacgtacgtacgacgtacgtacggactagtactcgtacgacgtaanacgtacgacggacgtaccggtaaccgtaaggacgttaggaaacgtcctaacggtaccggtcgttagttacgttgcggttaggacggtaggtacggtaggtacgggacgtacggtagggtcggtacgggtcgggaaccggggtagggggacgggttagtaccggagggttaccgggnggggtacccgtaaccgggg

SEQ ID NO: 255376 - DNA, 749 bp, Homo sapiens
  misc_feature: GYAE6OF01DLKMA.23.76.G10.1.454.CMB.1.raw
  modified_base (267)..(267): a, c, t, g, unknown or other
  misc_feature (267)..(267): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttagaagagccgtggggcctcgagtgtaaggtttcctgacgaaggtcttcgtggactaccaccttcacttacctangtactataggtaagttgggtcgaccgacgaccggtccccgtaggaacgaagggtcttggaggtaggagtgggatggactacgaaccaccaactacgtaacggaaacccctaacgtacgtcggacccgtacgggtaccttacgaacgtacggggttaccggtttttacgttacccgtttccgttacccgttcgggtaacccctacccgttcgttcgtaaccgtaggacgttagtcgggtaacttaataccgttcgtagactaaaggtctacggacgaaccctaacggaccgttaaaggccgtaaggtaaccgtacgtacgttaccggtacccggtttacgtttacgtttcgtacggtcgaccggttaaggttaccggttacgagggtacgtacggtaagggtccggttacggtccgggaccggggtacgggggtacgggtacgttaccgggtacgtacggggtcgggaccccggtaaaccggg

SEQ ID NO: 255377 - DNA, 808 bp, Homo sapiens
  misc_feature: GYAE6OF01EL0P4.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcatctgggtctgagttcgaagaagccttgggggcctcgaagtgaaggtttcctgccaaggcttctggactacgtaccttcaccttactagtcgtactagtagtaagttcgggtacgacggacgaaccgggtccccgtacggaccgtaaacggggtccttaggtacgggacggtagtgggagttacggtcgtaaccaaccaaaccgaaactacggtaccgggaaaaaccgtccccgttaagttaccgaccggtaacgggtccgttaccgtaacggaacggggttaacgggtttacgtttccgttaccgtttaccgtttaacgggtacccgttaacccgtttcgtacggtttaccgacgttacgtacgtacggtccgtaacgttaacttcgttacgacgtaacgacgttacgacgtacgaacgaccgttaaacggcgttacggaaggaacctcgtacggtaccgtttacgttacgttttacgttacggttaccggtaacggtacgggtacggtttacggacgggaaggtccggttacggtacgggttacggtcgggttaccgggtaaacgggggtccgggtaacggtttacgaacccgggtttacgggtcggggaaccgggttaaaccccgggg

SEQ ID NO: 255378 - DNA, 762 bp, Homo sapiens
  misc_feature: GYAE6OF01DJ965.23.76.G10.1.454.CMB.1.raw
  modified_base (461)..(461): a, c, t, g, unknown or other
  misc_feature (461)..(461): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttctggtggcagcagcaacgaggtgcccactcccgaggtcgacaacgtggtgactaatcgtggggtctaggtagttaggaagaacgtccgtggggcctcgtagtagtaaggtttcctgagaaggtcttcgaggtatacctacccttccacttacctattcgactagtagtagtgggtagcggaccgacggtccccgtgggaacgtacgggtcgtaggagtggagtgggatggactacaacgaccgaataccggacggaaacctagacgcgccgacggtcctcaagacggttacgttcgtacgttctaccgtacggacctacttcgtacgtacncgacgagtcgacgtaactcgtctcgtacaacgtacgtacgaccggacggtaacccgtaacggtaaacggtcgtaacgggtaaccgtacgtaccgttaccgggtaaccgtttagtttaaccgggttcctagggttaccgggaacgggtttaggtaccgggttaaggacgggtaccggtagtaccggggttaggttccgggggtcccgggttaccggggggtaacggggtccgggggggttaaatttcccgggtaaaccgggttcccgggggtaccgggggtaaccggggttaacccccgggg

SEQ ID NO: 255379 - DNA, 749 bp, Homo sapiens
  misc_feature: GYAE6OF01CLAHM.23.76.G10.1.454.CMB.1.raw
  modified_base (299)..(299): a, c, t, g, unknown or other
  misc_feature (299)..(299): n is a, c, g, or t
  modified_base (537)..(537): a, c, t, g, unknown or other
  misc_feature (537)..(537): n is a, c, g, or t
tcagacgcgagtatcacgaccggtgctcgatttagtcactcataccaggggacccaacaaccacacccctcctaagaagaagcccctagaccacagctccacaccatggactggacctggacggatcctcttctaggtggcagcacgcaacaggtgcccacctcccgaggtcgctaacgtggtgacctatcgtcgggctgtagttagaagaacgccgtgggacctcgagtacggtaacgtttccgagcaaggtcttcgtagaactacaccttcactcctagtgactgagtagttggacngacgacggtcccgtaggaacgtacggtgtacgtaggtaggaggtggattacggactaccggaacaccgaacggtacgaacgggtaaccctaaggttactaccggaccgtaggtaccttacgaacggtcgggttaacttttcggttcccgtcgtttacccggtacggtcaaccccgttggttaccgaccggtaagtccgtaacggtccggaacttacgtacgtacgttacgccgttaanaccgtcccgaagtacccgtaagaaccccggttaagcctaagggacccttagtaaccggtctaccggttaatttacgttcggtagttacccggaagtcgggtcggtaaccgacgggtagtacggtcggttcggaacgggttccggaccgggtacggggttaacgccggttaaacgtacccggttaacgggcccgggtaacggttaaacccggg

SEQ ID NO: 255380 - DNA, 858 bp, Homo sapiens
  misc_feature: GYAE6OF01CJCRO.23.76.G10.1.454.CMB.1.raw
tcagacgcgagtatcacgaccggtgctcgatttagtcactcatacaggggtaccgaacaaaccacacccctcctaagaagaagcccctagaccacagctccacaccatggactggacctggagatcctcttcttggtgcagcagcaacaggtgcccactcccaggtgcaactggtgcaatctgggtctgagttgaagaagccgtggggcctcgaggtaggtaacggtttccctgaccgaagggtcctttcgtaggtactacgtaccttcaacttactatgtacttagtgtaacttgggtagccggtaacgacggtacccgtaggtaacgtaagggtcgttaggagggtggtagttggggaactgggtaactacgaacgtaaccgaacgtacgtaacgggaaccctaagtacgtacgacccgagggtaccttacgaacgtacgggtacgtttcgtactccgttaccgttacggaacctcccgttacggtctaccgtacgtaccgtaacggttcggtaacgtaacgttaacgtacgttaccggtaacgaaacgtacgttaccgaaacggtaccgtaaaccgggtaaccggttaaaacggtcggtttaacgggaacgggtaaaccgttaaccgggtacgggttacccgggtttaagggttttaacgttttccggtttacgggtaacggggttaccggtaaacgggtttaaccggtttaccggtaaacgggttacgggttaccgggttaaacgggtcggggttaaccggttacgggggtacccggtaaaggggggttaccggggtacggtttaaccgggacccggttaacggggtcccggggtaacccgttaaacccggggg

SEQ ID NO: 255381 - DNA, 917 bp, Homo sapiens
  misc_feature: GYAE6OF01E2PRH.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacgaggtgccccactcccgaggtcgactaacgtggtcgacaactcgtgggttctagtagttagaagaacgtccgtacggggcctacgtagtaggtaacggtttccaggacgtaaggtcctttcgtaggactaccgtaccttacgacctacctagtacgtacttaagtaggtaaggtttcgggtacgaccgacgtaccggtccccgtaggaaccggtacgggtcgttacgggtagggtggtacggtaggggtaaccgtggtaccctaacgaacccgtaaccgtaacgtaaccggtaaccggtaaaccccgtaaggttaccgaccgtacccgggtacggttaccctaacgaacgggtaccgggtttacggttttaccgttacccgtttcccgttaccgtaccggtaacccttccggttacttacggtacgtaaccgtagtacgtacggttaacctagttaccgttacgtacggtagaacgttactacggtacgacccgtaaccgtaacggtaaccggtcggttaacggacggtacccgttacggttccggttacccgttttaggttaaccgtttcggtaacgggtaccggtttacgggaacgggtttaccgggtaaaccggtaggggacccggtttacggggttaacccggttcgggggttacccggttggggggtaaccccggggggtagggggtttaaaacccggggttacgtttaccggggttaacccgggtaccggggggttccccggggaaaccgggttaacccgggg

SEQ ID NO: 255382 - DNA, 685 bp, Homo sapiens
  misc_feature: GYAE6OF01DQIF9.23.76.G10.1.454.CMB.1.raw
  modified_base (431)..(431): a, c, t, g, unknown or other
  misc_feature (431)..(431): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
tcagacgcgagtatcacgaccggtgctcgatttagtcactcatacgaggggacccaacaaccaccacccctcctaagaagaacgcccctagaccacagctccacaccatggactggacctggagatcctcttctggtgcagcagctaacaggtcgcccactcccgaggtcgacaacgtggtgaccaagtcgtgggtctgagttagaagacgccgtgggcctcgaggtacgtaggttcctgacgaaggtcttgagtactacctaccttcaacttaccgtatcgtactaagttagtagttggggacgcgaaccgaccggcccgtaggaaccgagggtcgttaggacggtggagtagggatagtaacaacaaccgaaccaacgacgggtaccggaaaccagtacgcgaccgaggtcctagacgaggttcgtttntctctcgtacgctactgcncganctagtcgatagtctcgtagactagtaccgtacggacgaccgtacgtaaaccgtaacgtcgttacggaactacggtcttacgggtactttagttacttcgtacggtacgtaaggtacggtttcgggaatcgggaacttacgggcggtttacgggacgtccggggtacgggacgggggttaaggtcccgtttaggaaccccgggtttggggaaccgggtccccgggtaacggg

SEQ ID NO: 255383 - DNA, 720 bp, Homo sapiens
  misc_feature: GYAE6OF01DFD1H.23.76.G10.1.454.CMB.1.raw
  modified_base (354)..(354): a, c, t, g, unknown or other
  misc_feature (354)..(354): n is a, c, g, or t
  modified_base (506)..(506): a, c, t, g, unknown or other
  misc_feature (506)..(506): n is a, c, g, or t
tcagacgcgagtatcacgaccggtgctcgatttagtcactcatacagggacccaacaaccacacccctcctaagaagaagcccctagaccacagcctccacaccatggactggacctggagatcctcttctggtgcagcagcaacaggtcgcccactcccgaggtgctaactggtcgactaatcgtgggtctagtagttaggaagacgccgtgggcctcgagtgtaacgttcctggactaaggtcttcgtagactacctaccttacaccttactagtcgacttagtaggtaggttcgggtacaccggtaccgaccggtaccccgtaggaacggtaggtccgttaggaggtaggngtagggatggactaccgaactaccgacacgtacggaaccctagtacgtacgccgtagtcctacgagtacggttacgtttactcctacgtcgtacgaccctacgtctgtaccgaagtctaggtacgtacttagtactctaccgagtaacggtnaacgaccgtagaccgtaacgtaacggtacggacgtaactcgtaacgtaccggttacgttactttagtacgttggtacgtacgtaggtttaacggccgaaggtccgtagggtaccggttaggtaccggttggggtaacccggggaggggtttaaccggtaacgggttaccggaccgggtttccgggggtaacggtccccggggttaaaccccggg

SEQ ID NO: 255384 - DNA, 878 bp, Homo sapiens
  misc_feature: GYAE6OF01DW7A1.23.76.G10.1.454.CMB.1.raw
  modified_base (129)..(129): a, c, t, g, unknown or other
  misc_feature (129)..(129): n is a, c, g, or t
  modified_base (612)..(612): a, c, t, g, unknown or other
  misc_feature (612)..(612): n is a, c, g, or t
tcagacgcgagtatcacgaccggtgctcgatttagtcactcatacaggggacccaacaaccacacccctcctaagaagaacgcccctagaccacagctccacaccatggactggacctggagactcctnttctggtggcagcagcaacaggtcgcccaacctcccgaaggtcgacaacgtggtgactaatcgtgggtctagaggttagaaaggtaacggccgggtacgggtaccgtacgtaaggttacggtaaacgggttttcctacggaccggtaaacgggtctttacgtacggtaaccgttaaccgtaccttacgtaaccttaaccgtagtcggtacctaagttagttaagggttcgggtagaaccggtaacgtaccggtacccgtacggtaaacggaacgggttcgttaggaggtagggtaggttacggagtaggtacaaccaaccgtaacccgaatacggaacggtaaccctaaagtacgtcggaaccggtacggtcctaacggacggtaacggttccggtttacgttactcgttacgtacggacgttaacctgtacccgtgactacgtacgtaccggaataacgttacgacgtacggtaccggtaanacgtaccgacggaaccggttacgaacggtaaacggcgtaacggtaacgtaaccgttaccgtacggttaccccgtttaaggttaccggttactggggttaccggaacggttaccgggttaaacgggttacgtaacggaaccgggttcggtacgggtaaccgggtacggtttaacggggtaccgggggaaaccggggtttacggggtaacggttaccggggtaagggttaccccgggggacgggggtaacccccgggttaaacccggg

SEQ ID NO: 255385 - DNA, 641 bp, Homo sapiens
  misc_feature: GYAE6OF01BKO52.23.76.G10.1.454.CMB.1.raw
  modified_base (463)..(463): a, c, t, g, unknown or other
  misc_feature (463)..(463): n is a, c, g, or t
  modified_base (589)..(589): a, c, t, g, unknown or other
  misc_feature (589)..(589): n is a, c, g, or t
tcagacgcgagtatcacgaccggtgctcgatttagtcactcatacaggggacccgaacaaccacacccctcctaagaagaagcccctagaccacagctccacaccatggactggacctggaggatcctcttcttggtggcagccagcaacaggtgcccactcccaggtgcaactggtgcatctgggtctgagttgaagagccgtggggcctcagtgtaaggtttcctgcaggtcttctaggactaccaccttcactacctagtgctatgtaagttgggtgacgacacggccctaggacgaaggtcttaggagtggagtgggtagtacggataccgaacaccgtaacgacggtacgggaaccctaacgtgtcggaccgtaggtcctacgacgtaggtacgtttgtccttccgtccgtacggacctaccgttcgtcgtacacgtcgtagtcggacagttactcgngaccgtagactcgaagcgtacgtaccgtaaggcacggtagactcgtacgtcgttacgttgttacgcggtaggaccgtaggtcggtaacggaggacgtggtcgggtgtacgggtacgggtaccgggngggggtacggttctaccgggtaacggtcgggtcccggggacgtaacccgggg

SEQ ID NO: 255386 - DNA, 768 bp, Homo sapiens
  misc_feature: GYAE6OF01CXVQ3.23.76.G10.1.454.CMB.1.raw
  modified_base (658)..(658): a, c, t, g, unknown or other
  misc_feature (658)..(658): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgacaatcgtgggtctgtagttagaagaacgccgtggggcctcgagtagtaacggtttcctgacaaggtcttcgtaggactaccaccttcaccttacctatgacgtatagtaagttgggtcgaccgacgaccggtcccgtaggaacgtagggtccgttagacggttggaacgtgggtaagtcggaactacgaaaccaccaacgaacgtaccgggaaaccctaacgttacacggacccgtacggtccttacgaaccgtacgggtaccgttttcgtccgttcgttaccgtcggtacctacccgttcgttacgtcgagtacgtaacgttcggaacttacgtacttacgacgtacgaaacgtccgtaccgaaacggtccaaaaccgtcggttaaacgcgtaacggtaaccggaccttacggtaccggttcgtttaacggttcgtttcgtacggttacgggacggttaggtacggtttacgggaacggngtacggtacgggttacggggtcctaaccgggggtcccgggaaacggggtacggggttaacttaaccgggtacccggtacggggtcccgggtaacccgggtaaccccgggg

SEQ ID NO: 255387 - DNA, 734 bp, Homo sapiens
  misc_feature: GYAE6OF01EAHQH.23.76.G10.1.454.CMB.1.raw
tcagacgcgagtatcacgaccggtgctcgatttagtcactcatacaggggacccaacaaccacaccctcctaagaagaagcccctagaccacagctccacaccatggactggacctggaggatcctcttcttggtggcagcagcaacaggtgcccactcccaggtgcaactggtgcaatcgtgggtctggtagttagaagacgccgtggggcctcgagtgtaagtttccagacaggtctcgtagactacgtaccttctactacctaagtgtacttaagtacgtaaggttggtcgtacggacgtaccggcccgtaggaacgaggtccgttgaggttcggagtcggggagtcggtaactacgaacaccgtaacgaaccgtacgggaaccctacgtacgtaccgaccggacggtcgttacgacgtacggttaacgtttcgtacttccgtacgtcgacctacgtctgtacacgtacgagtacgctacgttagtacgtgaccgtagtaacgtacaacggtaccgtacgaaccggttaacggacggttaacggacggtaacctcggtacggttccgtttaaccggttgtttaccggttcggtacggtacggtagtaggttaccggaccggaggtacccggtaaggggtccgtagggtcccgggtacggggtaacgggggacgggttaccggttacggtaacgggtttaccggggcccgggttaaccgggtaaccccgggg

SEQ ID NO: 255388 - DNA, 665 bp, Homo sapiens
  misc_feature: GYAE6OF01EVNEB.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatcgtgggtctgagttgaagaagccgtggggcctcgagtgtaaggttttcctgacgaaggtcttcgtggataccaccttcaaccttacctatgtactatagtaagttgggtgacgacgacggccccgtaggaacgaagggtcttggaggtggagtgggatggactacaacaccaacgacgtacggaacccaacgtacgtcgaccgacggtctacgacgtacggtcgtttcgtcttcctcgttcgacctaccgtcgtcgtctagctagtcggctattactctagctacgtatacgagcgacgaccgtaaggctaggacgtacacggttcgtccggtttagttcgtttcgtggtcggtacggtaggtacggttacggagggacgtggtagggttcgggtccgggtcggggtaccggggtacgggggacggggttacgtttaccggggtaacgggttccggggtcgggggtaccccggtaaacccggggg

SEQ ID NO: 255389 - DNA, 739 bp, Homo sapiens
  misc_feature: GYAE6OF01DLZTS.23.76.G10.1.454.CMB.1.raw
  modified_base (236)..(236): a, c, t, g, unknown or other
  misc_feature (236)..(236): n is a, c, g, or t
tcagacgcgagtatcacgaccggtgctcgatttagtcactcatacagggacccaacaaccacacccctcctaagaagaagcccctagaccacagctccacaccatggactggacctggagatcctcttcttggtggcagcagcaaacaggtgcccactcccaggtcgcaactggtgacaaatcgtgggtctgacgttagaagaacgccgtggggcctcgagttgtaacggtttccngcaaggcttcgtgactaccacctttcaacctactagtgacttataggtaagttgggtacgacgtacgaccgggcccctagggaaccgaaggggtctttggaaggtggaggttgggattaggataccgaacaacccaaaccgacggtaacgggaacccctaaaaggtcgtaccgccggagggtacctacgaacgtaggttaccggttttgtccctttctaccgttacggacctacccgttctcgggttaccagaccgtagttcgggaacttacgttaacgtcgtttagaccgtaagtacgtacgacgtaaccgaaccgaaccgttaaacgggcgtaacggaacgggtaccgtaacggttcgtacccggtttgtaacgttttcgagttcggacggtaggtacggttacggaggtacgacggttcggtacgggtcgtccggggccgggaaggggtcgggtaagttaccgtacgggtaaccgggtccgggtaccggtaaacccgggg

SEQ ID NO: 255390 - DNA, 701 bp, Homo sapiens
  misc_feature: GYAE6OF01EIN3D.23.76.G10.1.454.CMB.1.raw
  modified_base (481)..(481): a, c, t, g, unknown or other
  misc_feature (481)..(481): n is a, c, g, or t
tcagacgcgagtatcacgaccggtgctcgatttagtcactcatacagggacccaacaaccacacccctcctaagaagaagcccctagaccacagctccacaccatggactggacctggaggatcctcttcttggtggcagcagcaacaggtgcccactcccaggtcgcaacgtggtgcaatcgtgggtctggtagttgaagagccgtcggggcctcaggttgtaacggttttcctgacgaaggtcttcgtggactaccaccttccactacctatcgtctatggtaagtttggggtcacgaaccgaccgtcccgtaggaacgtaagtcggtcgttggaggttggaggtgggagtggtaactacgaaaccaaccgaacgtaccggtacggaaaccccgaaggtagtaccgccggtacggtcttacgacggttacggtacggtttacttccgttacctccgttcggtaacctactcgttcgacngtctagtcggatattacgtgtacgagacgtacacgtagaccgtaacgtaccgtaagccgtagacggacgtacgtccggttacgttacgtttagtttacggtgtacgacgggttacggtacggttacgagggtacgcgttacggtcgggtcgtcggggttaccgggtagggggtaccggttacggttaacgggtacgtcgggggtaccgggtaacccgggg

SEQ ID NO: 255391 - DNA, 664 bp, Homo sapiens
  misc_feature: GYAE6OF01AGBYM.23.76.G10.1.454.CMB.1.raw
  modified_base (306)..(306): a, c, t, g, unknown or other
  misc_feature (306)..(306): n is a, c, g, or t
  modified_base (468)..(468): a, c, t, g, unknown or other
  misc_feature (468)..(468): n is a, c, g, or t
  modified_base (487)..(487): a, c, t, g, unknown or other
  misc_feature (487)..(487): n is a, c, g, or t
  modified_base (493)..(493): a, c, t, g, unknown or other
  misc_feature (493)..(493): n is a, c, g, or t
  modified_base (560)..(560): a, c, t, g, unknown or other
  misc_feature (560)..(560): n is a, c, g, or t
  modified_base (614)..(614): a, c, t, g, unknown or other
  misc_feature (614)..(614): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgacaatctggggtctgagttagaagaacgccgtggggcctacgaggtggtaaggtttcccgtgacgtaagggtctttcgtaggactacctacccttactaacctacctatgtactatagtaagttcgggtntacgaccgacggcccctagggacgtaagggtcgtggtaggtgggagtagggatcgggactacaaccaacctaacgacgtacgggaaacccgtaacgtactcggacccgaggtcctacacggaggtacgtttgtcgttcttcgtacgctaccttcgtcgtacncgactacgtggactagttnttacgngacgaacgtctacgacgaccgtacgtaacgtagcgttaggacgtactgtccgcgttgttatcgtggnggtacgagggtcggttacgaggtaggcggtcgggtcggtacggcgggtaccggngggggtaccggtgtacgggtacggacggttcggggccgggtaaacccggg

SEQ ID NO: 255392 - DNA, 926 bp, Homo sapiens
  misc_feature: GYAE6OF01BVA2L.23.76.G10.1.454.CMB.1.raw
  modified_base (233)..(233): a, c, t, g, unknown or other
  misc_feature (233)..(233): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacgaggtgcccactcccaggtgcaactggtgcaatcgtgggtctgaggttagaagacgccgtggggcctcgaggtgtaaggtttccngcgaaggtcttcgtaggactacgtaccttcgaccttacctagtcgtcttaagtaggtaaacggtttggggtacgtaccggaaccggtaccgggcccccgttaggggaaccggtaaacggggttccgtttagggaacgggttagggggtaacggtgggggaacgttgggtaaactacccgaaaacccgtaacccgaaaccgtaacccgggtaaccggggaaaaacccctaacggttaccgtaccggaccccggtaacgggtcctttaaaccggacgggtaaaccggggtttaccggttttacggtttccccgtttacccggttccggtttacccggggaaccccttacccgtttccggtacggtaccggtaacgtaccgtaacggtacgggtaaccttaagtttaaccgttcggtaacggtacgtaaacggtcgtaaccgtacggaccgtaacccggtaaccggtaaaccggtcgttaacgggtaaccggtaacgtacccgggttaccggttaccggtttacgtttaaggtttccgttagggtcgggtaccggtaggtacgggttacggaaacgggtggaccgggttacggtccgggtaggttcccgggggaccggggtcgggggttacgggttacgggtttaaccggtaccgggttacccggggtcgggggtaaccccgggttaaacccgggg

SEQ ID NO: 255393 - DNA, 737 bp, Homo sapiens
  misc_feature: GYAE6OF01DX8SF.23.76.G10.1.454.CMB.1.raw
  modified_base (152)..(152): a, c, t, g, unknown or other
  misc_feature (152)..(152): n is a, c, g, or t
  modified_base (157)..(157): a, c, t, g, unknown or other
  misc_feature (157)..(157): n is a, c, g, or t
  modified_base (183)..(183): a, c, t, g, unknown or other
  misc_feature (183)..(183): n is a, c, g, or t
  modified_base (339)..(339): a, c, t, g, unknown or other
  misc_feature (339)..(339): n is a, c, g, or t
  modified_base (352)..(352): a, c, t, g, unknown or other
  misc_feature (352)..(352): n is a, c, g, or t
  modified_base (427)..(427): a, c, t, g, unknown or other
  misc_feature (427)..(427): n is a, c, g, or t
  modified_base (501)..(501): a, c, t, g, unknown or other
  misc_feature (501)..(501): n is a, c, g, or t
  modified_base (552)..(552): a, c, t, g, unknown or other
  misc_feature (552)..(552): n is a, c, g, or t
  modified_base (645)..(645): a, c, t, g, unknown or other
  misc_feature (645)..(645): n is a, c, g, or t
tcagacgcgagtatcacgaccggtgctcgatttagtcactcatacagggacccaacaaccacacccctcctaagaagaacgcccctagaccacagcctccacaccatggactggacctggaggtactcctcttcttggtgcagcagcaacgnggtcnccccactcccgaggtcacaacgtggnactatcgtgggtctgagtagagacgtcggtggcctgagtagtagttccgactagtcttcgagaacttacctacctacaacgttctagtcgtattaagtaggtaaggttcgggagacccgaaccggcccggttacccgagggtacggaacgggtttntgggaaggttggnggtagggatcggaacctaccgaaaccaaccggtaacaacggtacccgaaaccaggttcgaaccgcccgggttaanacccgttacgaccgggtttaacggtttccggtttaaactttccctccggtttaaccgtacgaccttacccgttnttggaccgtactacgtcgtacgtaactcgtctagacgacgtagacaccgtnaccgtaacgtacgtaacgtcgacgggaacccgtacggtccgttacgtacgttttcgttccgttacggtgacggtacggtccgtaagggtacgnggtaacggttgtacgggtacggtcgggtccggagggggacggttaggtacggtacgggacggttccggggtaaccggtccgggtaaaccggg

SEQ ID NO: 255394 - DNA, 806 bp, Homo sapiens
  misc_feature: GYAE6OF01C42GS.23.76.G10.1.454.CMB.1.raw
  modified_base (238)..(238): a, c, t, g, unknown or other
  misc_feature (238)..(238): n is a, c, g, or t
  modified_base (280)..(280): a, c, t, g, unknown or other
  misc_feature (280)..(280): n is a, c, g, or t
  modified_base (563)..(563): a, c, t, g, unknown or other
  misc_feature (563)..(563): n is a, c, g, or t
  modified_base (653)..(653): a, c, t, g, unknown or other
  misc_feature (653)..(653): n is a, c, g, or t
tcagacgcgagtatcacgaccggtgctcgatttagtcactcatacaggggacccaacaaccacacccctcctaagaagaagcccctagaccacagctccacaccatggactggacctggagatcctctcttggtgcagcagcaacaggtgcccactcccaggtcgctaacgtggtgacaactcgtgggtctggtagttgaagaagccgtggggcctcgagtaggtaacggttttcccnggacaaggtcttcgtaggaattaccaccttacactacttacngtacttaagtaggtaacttggggtcgacggaaccgaaccgggtccccgtagggaaccaaggggtcttggaacggtggaacggtaggggtacgtcgggaactacgtaaacccgaaccgtaaaaccgaccggttaaccgggaaacccctaaacgttacgaccgggaccgtaacgggtccttaaccgaacggtacgggttacgttttcgttacccgtttcgtcccgtttacggaccctaccgttcgttaccgtactacggccgtaacggtgtaactagtacgttcnggataacgactgacgtaacgtaccgtaaacggtaaccgcgtacggaacgtacgtaccgttaccggttcccggttaatttcggttttacgngggtaacctacgggtaaggtccggttaaggtaaccggacgtaacgggtttcccgggagttccgggtttaccggggaggacccgggggggttacggggtaactttaccggggtaacgtttaacccgggggtcgggtaaacccccggttaagggg

SEQ ID NO: 255395 - DNA, 775 bp, Homo sapiens
  misc_feature: GYAE6OF01CQM6D.23.76.G10.1.454.CMB.1.raw
  modified_base (155)..(155): a, c, t, g, unknown or other
  misc_feature (155)..(155): n is a, c, g, or t
  modified_base (161)..(161): a, c, t, g, unknown or other
  misc_feature (161)..(161): n is a, c, g, or t
  modified_base (544)..(544): a, c, t, g, unknown or other
  misc_feature (544)..(544): n is a, c, g, or t
  modified_base (653)..(653): a, c, t, g, unknown or other
  misc_feature (653)..(653): n is a, c, g, or t
  modified_base (665)..(665): a, c, t, g, unknown or other
  misc_feature (665)..(665): n is a, c, g, or t
tcagacgcgagtatcacgaccggtgctcgatttagtcactcatacaggggacccaacaaccacacccctcctaagaagaacgcccctagaccacagctccacaccatggactggacctggaggactccctcttcttgggtggcagcagcaaacgngggtcncccactcccgaggtcgactaacgtggtcgacaagttcggtggggttctaggtaggttaggaaacggtacggccggttcggggccctacggtaaggttcggtaaacggttttccaggaccgaacggtcttcgaggtaacctacctaccttacaccttacctagtcgtacttaagtagtaagggttgggactaccggaccggtaccggtccccgtaaggaaccggagggttcgttaggacgggtaggtaggtgggtacgtaggactaacccgaaccgaaccaacgtaccggtacggaaaccctaaggtacgccgtaccggaggtctacgaacggttggttacgtttcgttctacccggtgttaacgccttaccgtcgtacgtacngaccgtagtacgacttactactacccggtgacgtaagtcaccgtaacgacggtaaaccccgtaagtaacgggtccgaaggtacccaacggtcgttccggtaacggtttnttaggttaccgnggtacggtacgtaggtacggagggacctggaacggtggtcgacgggttagggcccggggtaaggggtcgttagtacggtaccggtcggggtaacccggccggtaacgggg

SEQ ID NO: 255396 - DNA, 781 bp, Homo sapiens
  misc_feature: GYAE6OF01ERCC4.23.76.G10.1.454.CMB.1.raw
  modified_base (683)..(683): a, c, t, g, unknown or other
  misc_feature (683)..(683): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttctggtggcagcagcaacaggtgcccactcccaggtgcaactggtgacaatcgtgggtctgagttagaagaacgccgtggggacctcgagtggtaacggtttccgtagacgtaacgggtcctttacgtaggaactaacctaccttacaaccttaacctagtcgtactataggtaagttcgggtacgacgaacggacggtccccgtaaggaaccggtaacgggtcctttagggacggttagggtagttaggggtagtggaactacgaaaccgaccttaaacgacggttaacgggaaaccctaagtcgtaccggtaccgacggtacttacgaacgtaggttacgtttgtaccttcgtacgttacggacctactctgtacgacgtgtacgtaggactaagtcgtcagacgtaagactacgaacgtacgaacgtaaccgtaagtccgaggtaccgaacgtacgttacggtaaccgttgtttaacccgtttaggaggtaccggtaacgggtacggtagggtaaccgtaggggtaaccgtacgggtaacgggttccgggngggttacccgggaccggggttaacgggggtaaccggggttacgttaaccgggacccgggttaacgggggtccggggttaaccccggtaaacccggggg

SEQ ID NO: 255397 - DNA, 1094 bp, Homo sapiens
  misc_feature: GYAE6OF01DFJTE.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggactcctcttcttggtggcagcagcaacaggtcgccccaacctcccgaggtcgcaacgttgggcgactaatcgtggggttcctaggtaaggttaggaaaggaacgtcccggtacgggggtccctacgtagggttacggtaacggtttttccgaggtaaccggtaacggtcctttcgtaggtaactaaccctacccttaccgtaaccttaacgttacgtacggtacttaagttaggtaaggtttcgggtacgacgtaaccggtaccggtcccggtacggaacggtaagggttccgttagggaggtaggtaggttacgggattacggaactaccgaaaccaacccgtaaccgtaaccgggtaaccgggaaacccgtaaacgtacgtacccggacccggtacgggtaccttaaccggacggtaacggggtttaaccggttttcgttacccgtttacccggttacccgttaaccggtaacccgtaccccgtttacgtaccggtttaacccggacgttacccgtaaggggtttaccccctaaaggttaaccccgtttaacgggttacccggtaaccgtaaaacgggggtaaaccttttacccggtaaacccggtaaccggtacgggtaaaacccccggtttaaaaaccggtttaaacgggggcccccggtaaaggggtaaaccccgtaaaccccggggtttcctaacggggtttttaacccgggttttacggttttaaacgttaccccggtttaggggggtaaccctaaaacggggggggtaacgttttaaacggggggtaccgggttaaaacggggacccggtagggtttaaacggggggtcccgggtttaacccgggttaggggggaacccccggggggttaagggggggtaaccccgggtttaacggttaaacggtacccccggggttaccgggggggttaaaccccggggccccgggggtttaaaacccccggg

SEQ ID NO: 255398 - DNA, 926 bp, Homo sapiens
  misc_feature: GYAE6OF01DFWK7.23.76.G10.1.454.CMB.1.raw
  modified_base (158)..(158): a, c, t, g, unknown or other
  misc_feature (158)..(158): n is a, c, g, or t
  modified_base (188)..(188): a, c, t, g, unknown or other
  misc_feature (188)..(188): n is a, c, g, or t
  modified_base (433)..(433): a, c, t, g, unknown or other
  misc_feature (433)..(433): n is a, c, g, or t
  modified_base (645)..(645): a, c, t, g, unknown or other
  misc_feature (645)..(645): n is a, c, g, or t
tcagacgcgagtatcacgaccggtgctcgatttagtcactcatacaggggacccaacaaccaccacccctcctaagaagaacgcccctagaccacagctccacaccatggactggacctggagactcctcttctggtgcagcagacaacgagggtccnccctactcccgaggtacgactaacgtggtnactagttcgtcgggtctaggtagttaggaacggtaacgtccgggtacgggtcctacggtagggtagttaacggtttccgtaggacggtaacggttcctttacggaggtaaccttaacccgttacccgtttactaacccgtttaaccttacgtcggttaacgttaagttaggttaacgggttcgggttaccgaaccgggtaaccggcccggtaccccgggttaaggggaaccggtacgggggtttntttaaggggaacggggttaggtaggggttagggacggtaaggttaaacccaacccgtaaaaccgtaacccggtaacggtaaccccgggaaaccggtaaacccccgtaaggttaaccccggaccgtacccgggtggtaaccccctaggtacccgttacggtttccgtttacgttccttaccggtacgtccgtaccgtacgtgtaccaccgggntacgtcgacggtacttagtaccgttacgtacgtagtaccggtacgtaccgacgtacgaacgtacgtacggtacgtaagggaccgttaacggtccgttaccgtggtttaacgtttcgttacggtcgttacggtagggtaccggtagtaccgggtacgggttacgggtacgggtcggttaccggtaggggtaccgggtacccgggggtaggggttaccgggtttacgggaaccggttcccgggggtaagggggacccccggttacccgggggttaaacccggg

SEQ ID NO: 255399 - DNA, 817 bp, Homo sapiens
  misc_feature: GYAE6OF01D1CRY.23.76.G10.1.454.CMB.1.raw
  modified_base (229)..(229): a, c, t, g, unknown or other
  misc_feature (229)..(229): n is a, c, g, or t
tcagacgcgagtatcacgaccggtgctcgatttagtcactcatacaggggacccaacaaccacacccctcctaagaagaagcccctagaccacagctccacaccatggactggacctggagatcctcttcttggtggcagcagcaacgaggtgcccacctcccaggtgcaacctggtgcaatcgtgggtctgagttgaagaagccgtgggcctcgagtgaaggtttccngacaaggtcttcgtggataccaccgttacacctacctaagtgtctagtacgtaagttgggtgcgacgacggccccgtaggacgaagggtcgttggaggtcggtagtggggtagtggtaactaccgaaaccaaaccgaacgtaaccgtaccgggaaacccgaaacggtacgtccggacccgtaggccttaaccgaacgtagggttaccggttttcgttcctttaccgttcccgttacggtacctaaccgttcgttacgtaccgtagaccgtaggtacggtacgtacttaacgttcgttacgaacgtaggtaacctcggaacgtaccgacgtaacccggtaaagggtcctaagggtaacccggaacgtccggttaacggttccgttaggtttaactttcggtttcgtaacgggttcggtaacggggttaacggttacgggtaacggggtaacgttacggggtaaacgggttcgggttacccggttacgggggtacccggggaacggggggttacccggggtaccggtttaaccggaacccggggtttaccgggggtcccgggggtaaccccgggttaaaaccccgggggg

SEQ ID NO: 255400 - DNA, 692 bp, Homo sapiens
  misc_feature: GYAE6OF01A0NJ4.23.76.G10.1.454.CMB.1.raw
  modified_base (230)..(230): a, c, t, g, unknown or other
  misc_feature (230)..(230): n is a, c, g, or t
  modified_base (265)..(265): a, c, t, g, unknown or other
  misc_feature (265)..(265): n is a, c, g, or t
  modified_base (607)..(607): a, c, t, g, unknown or other
  misc_feature (607)..(607): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgacaacgtggtgcaatcgtgggtctgagttgaagaacgcgtggggcctcgagtgaaggtttccngcgtaaggtcttgtggatacaccttacactactangtctatacgtagttagggtgacgacgacggccccgtaggacgaagggtcgttaggtaggtggagtgggagtaggactacgaaaccgaactaaaccacggtacgggaaaccctaacgttacgtccgacccggaggtccttacgacggtaaccggttaggttttccgttccgtttccgtcccgtttacgggaccctccgttactcggttacacgacgtagtcggactagtacttcgtacgactacgacttcgaacggcctaacggaccgtaagtcgtacgaacggtacacgtacgtaccgttagtttacttcggtgttaccgaggtacggtcggtacgtaaggngtacggtggtcggtacggttcggaccggggaggggtacgggttagttacggaaccggtcgggtaccgggcccgggtaaaccgggg

SEQ ID NO: 255401 - DNA, 1156 bp, Homo sapiens
  misc_feature: GYAE6OF01BVVIE.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggactcctcttcttggtggcagcagcaacaggtgcccactcccgaggtcgacaacgtggtcgactaattccgtgggtcctaggtacgttaggaaacgtaacgtcccggtcggggacccttacgtaggtacggttaaacggtttcccgtacgaccgtaaacggttccgtttccgtaagggtaaccttaacccgtacccctttttacccgaacccgtttaacccgtacgttaccggtaaccgttaacgtaacgggtttaaaggttttccgggggaaccgacccgggttaaaccggtacccggggtacccccccgttaagggggaaacccggttaaacgggggttccccgtttaagggtaaccgggtttacggtaaaggggttacgggggtaaaccgttacggggtaacctttaaacccccgaaaacccggtaaacccgttaaaaccggtacccgggtttaaaccccgggggaaaaaccccgttaaaaccggttggtttaaccccccgggcccgggttaaaccggggttccccctttaaacgggtaaacccgggttacggggttttaaccccggttttccgggtttaacccttttcccggtttaaaccgggttccggttaaaccccgtttaaccccggttccggtttaaaccgtacgtaccggtaacggttacggttaacccggtcgttaaaccttcggttaacccgtaccggaccggttaaagtacccgtaccgtaaccgggtaacctaaccgggtaaacccggtttaaacgggccgttaacgggaacccgtaaacggttccggttaccggttaacccggttttagtttaccgggtttaacccgtagggttaaccgggaccggttaagggttacccggtacgggtacgggttacccgggaaggtttcccgggtaacgggtttcccgggttaaggggggtaccggggttacccggggggtaacggggtttacccggtttaaccggggaacccggtttcggggggtaaccccccgggttaaacggggttaacccccgggg

SEQ ID NO: 255402 - DNA, 802 bp, Homo sapiens
  misc_feature: GYAE6OF01BISVR.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtcgcccactcccaggtcgcaacgtggtgcaatcgtgggtctggagttagaagaacgccgtcggggcctcgaggtggtaaggtttcctggacaaggtcttcgtaggacttacctaccttcaacctactagtcgtacttagttagtaaggtttcggggacgtaccggaccgacggtccccgtagggaacggtaacggggtcttaggacggtaggacgtaggggtattacgggactaaccgaaacctaacccgaacgtaccggtaaccgggtaaaccctaaggttacgtccggaccggaacggttcctaaccggaacggtaaccgggttcgtttaccgttcttcccgttacggttacgtacccttaccgttcgtcggtaccgacgtacgtcggtacggtactaacgttcgtacgtcggaacgtacgtacgtccggtaccgtacggtaacgtaaaccggtaagggtctaagggacccggtaccgttcggtaccggttaccgtttagtttacttccgggtaggtcggtaccggtaaggtccggttaagacgggtacggtacccgggtaggttcggggtaccgtacggggttccggggtaacggggttgggtacctagggtacccgggtcggggtccgggggtaaccggtacccggg

SEQ ID NO: 255403 - DNA, 782 bp, Homo sapiens
  misc_feature: GYAE6OF01ELO08.23.76.G10.1.454.CMB.1.raw
  modified_base (130)..(130): a, c, t, g, unknown or other
  misc_feature (130)..(130): n is a, c, g, or t
  modified_base (517)..(517): a, c, t, g, unknown or other
  misc_feature (517)..(517): n is a, c, g, or t
  modified_base (711)..(711): a, c, t, g, unknown or other
  misc_feature (711)..(711): n is a, c, g, or t
tcagacgcgagtatcacgaccggtgctcgatttagtcactcatacaggggacccaacaaccacacccctcctaagaagaacgcccctagaccacagctccacaccatggactggacctggagtactcctnttctggtcgcagcagcaacgagtcgcccactccaggtcgactaagtggtcactaacgtcgttgggtctaggtagttaggaacgacgtccgggtcgggacctacgaggttcggttaacggtttccgaggaccgtaacggttcctttacggtacggtaacttaccctaccgttacaccctttaacgtagtcgtacttagtacggttaagggttcggtcgaccgaacgtccgacccgtaggaaccggtaggtcgttaggacggtaggacgtagggtagtacgtaacaccaaacctactaacgaccggaacgtacccgtaatacgccgtaccggacggtacttaccggacgtacggttcgttctctcggtcgttacaccttcgtcgttacncgtacgtacgtcggtactacttacgtcgttaccgacgacggtacgtgaaccgtaccgtacgtaaccgaacgtaccggtcggaacggtaaccgtctacgttccggtacggttcgtttacgtaggtcggtcgaacgggttcggtacggtacggtacgggtaagttccggcggttacccgggtaggggtacccgggnggggttacggggtaaccggtagggttaccccgggtagttacccgggggtaaccggtcccgggtaacccggg

SEQ ID NO: 255404 - DNA, 713 bp, Homo sapiens
  misc_feature: GYAE6OF01CQ29A.23.76.G10.1.454.CMB.1.raw
  modified_base (152)..(152): a, c, t, g, unknown or other
  misc_feature (152)..(152): n is a, c, g, or t
  modified_base (413)..(413): a, c, t, g, unknown or other
  misc_feature (413)..(413): n is a, c, g, or t
tcagacgcgagtatcacgaccggtgctcgatttagtcactcatacaggggacccaacaaccacacccctcctaagaagaagcccctagaccacagctccacaccatggactggacctggagatcctcttcttggtggcagcagcaacaggtncccactcccaggtcgccaacgtggtcgcaagtctgggtctgagttgaagagccgtgggcctcagtggtaacggttttcccgtgccgaaggtcttcgtacggacttacctaccttaccaccgttaccttatagtaccttagtagtaacggttgggttacgaccgacgtaccggccccttagggaaccgtaagggtcctgggtaggtggtagtggggtatcggactaccgaactaccaacgtaccgacggaacccaacgtacncgacccaggtcctacgacgtacggtacgtttgttacttcgtccgtacgactaccgtcgtcgtacactacgacgtcgacttaacgtatccgttagaacaggtacttacgacggtacaacggtaaccgtaaggacggttacgaacgggttacctacgtcggtacgttacgttacgtttcggtacgtgggataccggggttagtacgtacgggtagccggttacggtcgggtacgtccggggtcggtacgggggaccggtacggttaatccccgggtagggtcccggtcccggtaacccgggg

SEQ ID NO: 255405 - DNA, 733 bp, Homo sapiens
  misc_feature: GYAE6OF01BBMMQ.23.76.G10.1.454.CMB.1.raw
  modified_base (525)..(525): a, c, t, g, unknown or other
  misc_feature (525)..(525): n is a, c, g, or t
  modified_base (542)..(542): a, c, t, g, unknown or other
  misc_feature (542)..(542): n is a, c, g, or t
tcagacgcgagtatcacgaccggtgctcgatttagtcactcatacaggggacccaacaaccacacccctcctaagaagaagcccctagaccacagctccacaccatggactggacctggagatcctcttcgttggtggcagcagcaacgaggtcgccccaccgtcccgaggtcgaccaacgttgggtgactaactcggttgggtacgtaggtagttagaacggacgtcggtcgggcctcggtaggtaggtaacggttctaggactaggtcttcggtagtacttacctacccttacaccgtactagtcgtataagtacggtaggtcggacgaccgtaccgtaccggtaccggtaggtacggtacggtcgttagggtaggtgggtacggtagggagtacggtaaccaccgaaaccgacgaacgaccggtaaccggtaaccgtacgtcgacccggaccgtacggtccgtacgtacgggtacggttcgttcttcgtacctacgtacgtaccgtcgtagtcgacgtacgngtacgtctacgtactcnctacgcgtactcgacgacgacgaacgtacgtacgacgtacgtacgtcgtcgtacgtcgtacgttagtcgtaggtcggtagtacggtacggacggtacggtcggtacggtcggtacggcggtaccggggtacgggtaccggggtcggttacggtacggtacccgggtacgggtaccgggtacggtacccggg

SEQ ID NO: 255406 - DNA, 886 bp, Homo sapiens
  misc_feature: GYAE6OF01A1ZBK.23.76.G10.1.454.CMB.1.raw
  modified_base (417)..(417): a, c, t, g, unknown or other
  misc_feature (417)..(417): n is a, c, g, or t
tcagacgcgagtatcacgaccggtgctcgatttagtcactcatacaggggacccaaacaaccaccacccctcctaagaagaacgcccctagaccacagctccacaccatggactggacctggaggactcctcttcttgggtggcagcagcaacgaggtacgcccaccctcccgagggtcgacaactgggtgactaagttcgtgggtctggtaggttagaaacggtacggtccggtcggggtcctacgtaagggttaggttaacgggttttccgtacggtacggtacgggttcctttcggtaggtacttacctacctttacaacccgttaccttatcgatagttaggttaagtcggggtgaccgaccggaccggtacccgtagggaccgtagggtcgttaggtacgggtagggtaggngggtacggacgtaaccgtaaccaaaccctaaccgaaaccggtaccggaaacccggtaaacccgtaaacggtaccggtacccggacccgggtacggttaccgttaacccgaacggggtttacggtttaccggtttccgttacccgttttccgttaacccggtaccggttaccctacctttccgtacggtaaccgtgtaccgtaagtcggtacttacgtacttaccggacgtacggtacctaaggtccacggaaccgaccgtaacggtacgtaccggtaagaaccggtaacgtccgtaccggtttagtaggtttacgttccggttaggttcgggaccggtaggtacgggtacgaggaccggttcggtcggttaggggtccggttaccgggggtcggggtaaacgggggttccggttaccggtaacgggttaccgggggtaacccggtcccggggtaacgggtaaccccggg

SEQ ID NO: 255407 - DNA, 728 bp, Homo sapiens
  misc_feature: GYAE6OF01B4LWK.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagccgtggggcctcgagtgtaaggtttcctgcaaggtcttcgtggactacctaccttcactacctatgactatgtaagttgggtgcgacgacggccccgtaggaacgaaggggtcttaggacggtgggaagtggggtagtaggataccgaaacgaacccaaacgacgtaccgggaaacccaacggtaactccgacccgagggtccttaacgacggaacgggttacggttttcgttccgtttccgtaccgtttacgggtaaccctacccgttcgttcgtaccgagtacctaggttacgggactaagttacgttcgacgtctaaggaacttcgaacgtaccgaacgtaaccgtaaggcgtaggaacggtacctcgtacgtccggttacgtttagtttcgtacggttggacgtagggtacggttacggacggagtcggtacgggtgggtacgggtaccgggttaccgggaggggggtcgggttaacggttacggtaacggttcggggtaccgggggtccgtaaaccccggggg

SEQ ID NO: 255408 - DNA, 610 bp, Homo sapiens
  misc_feature: GYAE6OF02IMMNY.23.76.G10.1.454.CMB.1.raw
  modified_base (272)..(272): a, c, t, g, unknown or other
  misc_feature (272)..(272): n is a, c, g, or t
  modified_base (312)..(312): a, c, t, g, unknown or other
  misc_feature (312)..(312): n is a, c, g, or t
tcagacgcgagtatcacgaccggtgctcgatttagtcactcatacaggggacccaacaaccacacccctcctaagaagaagccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacacttcatacctatgctatgaattgggtgcgnaggccctggacaagggcttgagtggatgggatggatcaanaccaacactgggaacccaacggtatcgcccaggcttcacaggtacggtttgtcttctccgttaggactacctctaggtcagctatggcagtatctgtcagatacagcagacctaaagctcgaggacaacgtggtccgtagttacgtttacgtgttggccggtaaggtacggggtttccaaggggtacggaccgtaagggtgggtaccgttcgggggttacccggagggggtccgggggggtaacgtttaccgggtaccggtttaaccggtcggggggtacccgttaaacccggggggg

SEQ ID NO: 255409 - DNA, 517 bp, Homo sapiens
  misc_feature: GYAE6OF02FTGKS.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggttcctgcaaggcttctggatacaccttcactacctatgctatgaattgggtgcgacaggcccctggacaagggcttgagtggatgggatggatcgaacaccaacactgggaacccaacgtatgcccaggcttcacaggacggtttgtcttctccttggacacctctgtcagcatggcatatctgcagatcagcagcctaaaggctgaggacactgccgtgtatttcgtgtgcgagaggttcaggagcgagtggctggtccgaggggcgggggattggacgtacgtggggctaaccggg

SEQ ID NO: 255410 - DNA, 521 bp, Homo sapiens
  misc_feature: GYAE6OF02FMSH5.23.76.G10.1.454.CMB.1.raw
  modified_base (465)..(465): a, c, t, g, unknown or other
  misc_feature (465)..(465): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacaccttcactacctatgctatgaattgggtgcgacaggcccctggacaagggcttgagtggatgggatggatcaacaccaacactgggaacccaacgtatgcccagggcttcacaggacggtttgtcttctcttggacacctctgtcagcatggcatatctgcagatcagcagcctaaaggctgaggacacgtgccgtgttattcgtgtgcgagtggttcaggngcgaggtggctgggtccgaggggcggggattggacgtacggtggggccgaacgggg

SEQ ID NO: 255411 - DNA, 568 bp, Homo sapiens
  misc_feature: GYAE6OF02HHBVW.23.76.G10.1.454.CMB.1.raw
  modified_base (465)..(465): a, c, t, g, unknown or other
  misc_feature (465)..(465): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacaccttcactacctatgctatgaattgggtgcgacaggcccctggacaagggcttgagtggatgggatggatcaacaccaacactagggaacccaacgtatcgcccagggcttcgacgaggtacggtttgtctttctccttggacctacctctgtcagcatggcatatctgcagatcagcagacctaaaggctaggacggacacgtcgccgtgttacttttcgngtcgcggtaagtaggtttcgagggtacgcgtaaggtcggcgtcgggtaccggagggggtccggggtattcggaccgttacgggtcgggggaccgtaaccgggg

SEQ ID NO: 255412 - DNA, 569 bp, Homo sapiens
  misc_feature: GYAE6OF02HMUAM.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacaccttcactacctatgctatgaattgggtgcgacaggcccctggacaagggcttggagtggatgggatggatcaacaccaacactacgggaacccaacgtatcgcccgagggcttacacgaggtacggtttgtcttctccttggacctaccgtctgtcagcatggctatatctgacagatcgagcacgaccgtaaaggctaggaggacacgttcgcgttcgttatttcgtgtcggcgaggtaggttcgagggtagacgtaggtggcgtcgggtaccgagggggtacggggtacttggaccggtacggtacggggaccgtaaccgggg

SEQ ID NO: 255413 - DNA, 580 bp, Homo sapiens
  misc_feature: GYAE6OF02F58J2.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacaccttcactacctatgctatgaattgggtgcgacaggcccctggacaagggcttgaggtggagtgggatggatcaacaccaacacgtacgggaaacccaacgtatcgcccagggccttacgacgacggtacggtttgtctttctccgttgacctacctcgtcgtcagcagtcggacattatctgcagatcagcacgacgtaaaggctaggacggactacgtcgtccgttagttactttcgtgttcgacggtagtacggttcgaggtacgacgtaggtcggtcgtcgggtaccggaggggcggggtattcggacgtacgggtcggggaccgtaaccggg

SEQ ID NO: 255414 - DNA, 570 bp, Homo sapiens
  misc_feature: GYAE6OF02IOCVP.23.76.G10.1.454.CMB.1.raw
  modified_base (272)..(272): a, c, t, g, unknown or other
  misc_feature (272)..(272): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacaccttcactacctatgctatgaattgggtncgacaggcccctggacaaggcttgagtggatgggatggatcaacaccaacactgggaacccaacgtatgacccaggcttcacaggtacgtttgtcttctccttggaccacctcgtcgtcacgtcagtggctatatctgcagtactcagcagtaccgtaaaggctagacggacacgtggccgttgttactttcgtagtgacgtaaggtacggttacgagggacgtcgtaggtacggcgtcgggtccggaggggtcgggggtattcgggtaaccgtacggtcgggggacctaaccggggg

SEQ ID NO: 255415 - DNA, 601 bp, Homo sapiens
  misc_feature: GYAE6OF02JO2QF.23.76.G10.1.454.CMB.1.raw
  modified_base (226)..(226): a, c, t, g, unknown or other
  misc_feature (226)..(226): n is a, c, g, or t
  modified_base (508)..(508): a, c, t, g, unknown or other
  misc_feature (508)..(508): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcgagtgaaggtttccngcaaggcttctggatacaccttcactacctatgctatgaattgggtgcgacacggcccctaggacaaggggtcttgaggtggatgggatggatacgaacaccaacacgtagggaaacccaacggtaatcggacccgagggtccttacgacgacgggtacggtttgtccgtttctccgttggtacctacctcgttagtaccagtcctaagtcggtactagtactctacgacagtatcgagcgagaccgtaaaggcctggaacgacacgtgcgtagtatttcgngtgacggagtcgttgaggagcgtaggtggcgttagggcccggaaggggtccggggtattcgggaccggtacggtcggggtaccgaacccgggg

SEQ ID NO: 255416 - DNA, 564 bp, Homo sapiens
  misc_feature: GYAE6OF02I3RGA.23.76.G10.1.454.CMB.1.raw
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (396)..(396): a, c, t, g, unknown or other
  misc_feature (396)..(396): n is a, c, g, or t
  modified_base (480)..(480): a, c, t, g, unknown or other
  misc_feature (480)..(480): n is a, c, g, or t
  modified_base (494)..(494): a, c, t, g, unknown or other
  misc_feature (494)..(494): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacaccttcactacctatgctatgaattggtncganaggcccctggacaagggcttgagtggatggggatggatcgaacaccaacacgtagggaacccaacggtatcgacccagggccttcacgtaggacggtttgtcttctccttggacctacctntcgtcagcatggctatatctgcagatcagcagacctaaagggctaggaggaccagtcgccgtgttacgttctggttgcgtaagngttacgaggtacgngaggttcgcgtgggtaccgagggggtacggggagtttcggaccttacgggtcggggaccctaaccggggg

SEQ ID NO: 255417 - DNA, 901 bp, Homo sapiens
  misc_feature: GYAE6OF02IGZAX.23.76.G10.1.454.CMB.1.raw
tcagacgcgagtatcacgaccggtgctcgatttagtcactcatacagggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacaccttcactacctatgctatgaattgggtgcgacacggcccctggacaagggccttgaggtggatgggatgggatcaacaccaaacacgtacggggaaaccctaacgtatacggacccgaagggccttacgaacgtaacggggtaaccggtttttcggttacctttccgttaccctttacggggaaccctaccccgttcttacggtttacccgtaacggcctaaagttccggggtacctaaagtttaaacttcccgtttagggacccgtaaaggtaacggttaccgtaaacgggtcccgtaaaaccgggtaaccccggtttaaaaacgggggacccgtttaagggggaaaccggggttaaacccgaaacccgtttaccggggttaccccgggttttaacggtttaaaccgtttttttcccggttaaggggtttaccggtaccggggttaaaggggtaaccggggtttttaccggaagggggtaacggtaccggtaaacgggggtttacgggggtacccgggtttacgggggtttaacccccggggtaaggggggggttaccccggggggggggttaatttttaaacccggggtaaccgggttttaaaccccgggggttccggggggggtaaccccggttaaaaccccccggggggggg

SEQ ID NO: 255418 - DNA, 690 bp, Homo sapiens
  misc_feature: GYAE6OF02HXC1G.23.76.G10.1.454.CMB.1.raw
  modified_base (436)..(436): a, c, t, g, unknown or other
  misc_feature (436)..(436): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacaccttcactacctatgctatgaagttgggtgcgacacggcccctggacaagggcttgagtggagtgggatggatcaacaccaacacgtacgggaacccaagtagtcgcccgaagggccttacacgaggtacggttttcgtcttccgtcgttggacctacctctgtcagtctagtcggctagtactctgcgtagntacgagcacgacctaaaggcgtagaacgggtacctaccggtggtacccgtttagtaacgtttttccgagggttccggtaacggaacgggtttaccgggttacgtaacggggtacggttacccggaaggggtttccgggtaccggttaccgggggttacccgggaacggggggggtcccggggggttaagttttacccggggaacccggttttacccgggggtaccgggggggaccccggttaaaccccgggggg

SEQ ID NO: 255419 - DNA, 600 bp, Homo sapiens
  misc_feature: GYAE6OF02I4UB0.23.76.G10.1.454.CMB.1.raw
  modified_base (238)..(238): a, c, t, g, unknown or other
  misc_feature (238)..(238): n is a, c, g, or t
  modified_base (275)..(275): a, c, t, g, unknown or other
  misc_feature (275)..(275): n is a, c, g, or t
  modified_base (375)..(375): a, c, t, g, unknown or other
  misc_feature (375)..(375): n is a, c, g, or t
  modified_base (397)..(397): a, c, t, g, unknown or other
  misc_feature (397)..(397): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagccgtggggcctcgagtgaaggtttcctgcaaggcttcnggatacaccttcactacctatgctatgaagttgggtncgacacggccccgtgacaagggcttgagtggatgggatggatacaacaccaacacgtacgggaaaccaagtatcgccgaggcttacacgaggtcggtttntcgttctacctggacctacctntgtacagactagtgacatatcgtagtacagtatcagacacgtaccaaagctaggacggacacgtacgccggttagttacgttcgtagttcggacgtaggtacggttcgaggtacgacggtaaggttaccggcggttacgggtaccggtacggggggtacgggtagttaccgggtacgtaacgggtccggggacgtaaccgggg

SEQ ID NO: 255420 - DNA, 689 bp, Homo sapiens
  misc_feature: GYAE6OF02FY3LP.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacaccttcactacctatgctatgaattgggtgcgacaggcccctggacaagggcttgagtggatgggatggatcaacaccaacacgtacgggaaccccaacggtactggcccgagggtccttaccgaacgtacggggtaccgggttttcgttccgtttaccgtcccgtttacgggaaccctacccttccgttacgtaccacggtcctaagtcgggactaattactctcggacaggactacgacgtaccgaacgtaccgtaaacgggctacggacgggtacctaccgtcggtcccggtttagttaacgttttcgttagggtcgtacgggtaaggtacgggttacgagggtacgcggtaagggttcggtaccggttacgggttaccgggagggggtaccggggggtactttacgggacccgttacgggttcggggtacccgtaaccggggg

SEQ ID NO: 255421 - DNA, 722 bp, Homo sapiens
  misc_feature: GYAE6OF02I2GFI.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagagcctggggcctcagtgaaggtttcctgcaaggcttctggatacaccttcactacctatgctatgaattgggtgcgacacggcccctggacgaagggcttgagtggagtgggatggatacaacaccaacacgtacgggaaacccaacggtatcggacccgagggtccttcgaacgtacggtacgggttttgtctttcgtccttgggtaccctaccgttctgtacacgtccagtcggactaattacgtcttacgactaagacttccgaacgtacgaaccggtacccgtaaaagggtctacgggtaaggaacctacggtcggtacccggttaggtttactttttccggtaggttcggtaccgggtaaaggttacgggtttaccgtaggggtacggtaccggtaggggttacgggtaccggttacgggggttacccggggtaaggggggggtaccggggggtttacgtttaccggggtaacccgggttaaccggggtaccggggggtaccccgggttaaacccggggg

SEQ ID NO: 255422 - DNA, 538 bp, Homo sapiens
  misc_feature: GYAE6OF02F23M2.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacaccttcactacctatgctatgaattgggtgcgacaggcccctggacaagggcttgagtggatgggatggatcaacaccaacacgtagggaaccccaacgtatcgcccgagggcttcacgaggtacggttttgtcgtttctccttggacctacctctgtcagcatggcatatcgtgcagatcagcagcctaaaggctagacggacactgtccgtgttacttcgtgtgcgaggtagttcgaggagcgaggtgcgtcggtcgaggggtcggggactggacgtcggtcgggcgtaacggg

SEQ ID NO: 255423 - DNA, 577 bp, Homo sapiens
  misc_feature: GYAE6OF02JKQLY.23.76.G10.1.454.CMB.1.raw
  modified_base (211)..(211): a, c, t, g, unknown or other
  misc_feature (211)..(211): n is a, c, g, or t
  modified_base (322)..(322): a, c, t, g, unknown or other
  misc_feature (322)..(322): n is a, c, g, or t
  modified_base (340)..(340): a, c, t, g, unknown or other
  misc_feature (340)..(340): n is a, c, g, or t
  modified_base (468)..(468): a, c, t, g, unknown or other
  misc_feature (468)..(468): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctnagtgaaggtttcctgcaaggcttctggatacaccttcactacctatgctatgaattggtgcgacaggcccctggacagggcttgagtggatgggatggatcaacaccaacncgtaggaaccctaagtancgcccagggtcttacgacaggtacggtttgtacttctaccgttggaacctaccttgtcgtcagtctatggactagtatctgcgagactcgagctacgaccgtaagcgtagacggacacgtctccggtnttacgtttctgtcgtacgagaggttacgaggacgtcgtacggtggtcgttcgggtacggtaggggtcggggtacttcggtaccgtacgggtcggggcccgtaaccgggg

SEQ ID NO: 255424 - DNA, 704 bp, Homo sapiens
  misc_feature: GYAE6OF02HQ33A.23.76.G10.1.454.CMB.1.raw
  modified_base (327)..(327): a, c, t, g, unknown or other
  misc_feature (327)..(327): n is a, c, g, or t
  modified_base (638)..(638): a, c, t, g, unknown or other
  misc_feature (638)..(638): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcttgcaaggcttctggatacaccttcactacctatgctatgtaattgggtgcgacaggcccctggaccgaagggcttgagtggagtgggatggatcaacaccaanacgtagggaaacccagtatcgacccgaggtcctacgacgacggtacggtttcgtcgttccgttccgttggacctaccgttccgtgttcgacgctagttcggctaacgttattccgtaggacctaacgtacgttacaacggaccgtaacgtacccgtaaaacgggtcgttaacgggaaccggttaccgaaccgttcgggtacccgtttagttaccgttttacgtacggttccgggtaaacggtaacgggtttaacggttcgtaacggggtaccgttacgtagggttccggtacggttccgggttaaccgggngggggtaccggggttacttacgggtaaccggttacgggtaccgggggtacccgttaaacccggggg

SEQ ID NO: 255425 - DNA, 562 bp, Homo sapiens
  misc_feature: GYAE6OF02FGCMQ.23.76.G10.1.454.CMB.1.raw
  modified_base (243)..(243): a, c, t, g, unknown or other
  misc_feature (243)..(243): n is a, c, g, or t
  modified_base (272)..(272): a, c, t, g, unknown or other
  misc_feature (272)..(272): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacnccttcactacctatgctatgaattgggtncgacaggcccctggacaagggcttgagtggatgggatggatcaacaccaacactagggaacccaacgtatcgcccaggcttcacaggtacggtttgtcttctccttggacctacctctgtcagcagtggcatactctgcagatcagcagcctaaaggctgacggacacgtgccgttgttactttcgttgtgacggagtaggttcgaggacgtcggtaaggtgggccgttgggtaccggagggggtccgggggattacgggacgttacgggtcggggacccgtaaccgggg

SEQ ID NO: 255426 - DNA, 612 bp, Homo sapiens
  misc_feature: GYAE6OF02IA5RQ.23.76.G10.1.454.CMB.1.raw
  modified_base (425)..(425): a, c, t, g, unknown or other
  misc_feature (425)..(425): n is a, c, g, or t
tcagacgcgagtatcacgaccggtgctcgatttagtcactcatacaggggacccaacaaccacacccctcctaagaagaagcccctagaccacagctcccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacacttcactacctatgctatgaattgggtgcgacaggcccctggacaagggcttgagtggatgggatggatcaacaccaacacgtacgggaaacccaacgtatcgcccgagggtccttcaacgagggtacggttttgtcttcttccgttggactacctctgtccagcatggcatatctgcagntcagcagacctaaggctgaaggacacgtgtccgtgttactttcgtagttcggacggagtagggttcgacgggtacgtacgtcgggttacgggaccggttccggggttaccgggacgggggggtccggggggttagtttacgggtaaccggtttaccgggttacggggggacccggtaacccgggggg

SEQ ID NO: 255427 - DNA, 582 bp, Homo sapiens
  misc_feature: GYAE6OF02FU6F4.23.76.G10.1.454.CMB.1.raw
  modified_base (411)..(411): a, c, t, g, unknown or other
  misc_feature (411)..(411): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctggggtctgagttgaagaagcctggggcctcagtgaaggtttcctgcaaggcttctggatacaccttcactacctatgctatgaattgggtgcgacaggcccctggacaagggcttgagtggatgggatggatcaacaccaacactgggaacccaacgtatcgcccgaggcttcacgaggacggtttcgtcttctccttggacacccgtctgtcagcagtcggcatatcngcagatcagcagaccgtaaaggcctggacggacacgtcgaccgttgttactttcgtgtcggcggtaaggtcggtttcgagggtacgcggtaggttcggccgttacgggttccggaaggggggtccggggtatttccgggaacgttcgggtacgggggcccgtaaccggggg

SEQ ID NO: 255428 - DNA, 729 bp, Homo sapiens
  misc_feature: GYAE6OF02F8MB6.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacaccttcactacctatgctatgaagttgggtgcgacacggcccctggacagggcttggagtggagtgggatggatcaacaccaacacgtacgggaaccctaacgtactcgacccgagggtccttacgacgtacgggttacgggttttgtccgtttccgttcccgttacggaccctacccgttcgtcgttaccacggtcctagttcggactaagttactcgttagaccgtaagtactccgagtaccgaacggtaacccgttaaaacgggtcctaagggaaccggaaccgtaccggttaccggtacccggttttacgtttaacgtttttccgttagggttcggtacgggtaagggttaccgggtttacgagggtacggtacggtaacgggttcgggtaccggttcggggtaccgggtacgggggggtacgggggtacgtttaccgggtaccgggttaccggggtaccgggggtacccgtaacccgggggg

SEQ ID NO: 255429 - DNA, 756 bp, Homo sapiens
  misc_feature: GYAE6OF02JLW1P.23.76.G10.1.454.CMB.1.raw
  modified_base (234)..(234): a, c, t, g, unknown or other
  misc_feature (234)..(234): n is a, c, g, or t
  modified_base (620)..(620): a, c, t, g, unknown or other
  misc_feature (620)..(620): n is a, c, g, or t
  modified_base (631)..(631): a, c, t, g, unknown or other
  misc_feature (631)..(631): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtcgcaactggtcgcaatcgtgggtctgagttagaagaacgtccgtgggcctgagtggtaacggtttccngacgtaaggtcttcgtggactacctaccttcacttacctatgtacttagtagtaggtttgggacgtacgaaccgtaccgggccccgtaggaaccggtaagggtccgttaggtaaggtcgggaggtagggagtacgggaataccgaaaccgtaaccaaaccgacgggtaaccggaaccgaaacggttacgtaccggaccgtacgggttacttaccgaacggtacgggttaccggtttcgttcttccgttacccgttggaacccttcgttaccgtgtcgtacagtcgtagaccgttctaacgttcgagactaactagtccgaagtccgaacggttaacccgaaggtccgtaggacggtacttacgtcggttacgttaatttcgttcgngggttacccgnggttaaagtcgggttaacgtaggcgttaccggtgggtacggttaaccgggtgggtaaccggggtcggggttacggggtacgttaacgggtccggtaaccggggtcccgggtaccggtaacccggg

SEQ ID NO: 255430 - DNA, 662 bp, Homo sapiens
  misc_feature: GYAE6OF02H0CIO.23.76.G10.1.454.CMB.1.raw
  modified_base (278)..(278): a, c, t, g, unknown or other
  misc_feature (278)..(278): n is a, c, g, or t
  modified_base (333)..(333): a, c, t, g, unknown or other
  misc_feature (333)..(333): n is a, c, g, or t
  modified_base (352)..(352): a, c, t, g, unknown or other
  misc_feature (352)..(352): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaggcttctggatacaccttcactacctatgctatgtaagttgggtgcgacncggcccctggacaagggtcgttgaggtggagttggggatggatacaacaccaacncgtacgggaacccaagtancgccgaggtctcgacgaggtcgtttgtctttctccgtcgacctccgttcgtcgtcacgctagtcggctatacttcgtagacgtagtactacgacgtactaacgaaccgttaaaggcgtaggaacgtactaccgtcggtaccggtttagtttacgtttccgtaggtcggtaaccggtacggttacggggttacgagggttaacggtccggtaagggttccgggtacggttacggggtacccgggagggggggtccggggttaacgttaccgggtaaccgtacggggtaccggggacccggttaacccgggg

SEQ ID NO: 255431 - DNA, 637 bp, Homo sapiens
  misc_feature: GYAE6OF02GM2W5.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacaccttcacctacctatgctatgaattgggtgcgacacggcccctggacaagggcttgagtggatgggatggatcaacaccaacacgtacggaacccaagtatcgacccgagggtccttcgacgaggtacggtttcgtctttctaccgttgggacctaccttcgtgtaccagctaagtggtactagtatctgacgagtactacgagacagaccgtaaaggctaggacggacacgtcggtaccgttagttacgtttctggtcgtacggtaaggtacgggttacgagggtcgtaccggtagggttcgggtaccggttacggggttaccgggaaggggggtccgggggttatttacgggtaaccggttacgggtacgggggtacccgtaaccccggggg

SEQ ID NO: 255432 - DNA, 673 bp, Homo sapiens
  misc_feature: GYAE6OF02JJPIZ.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagccgtggggcctcagtgtaacggtttcctgcaaggtcttctggactaccaccttcactacctatgctatgaagttgggtgacaacgacggccctaggacgtaacgggtcttggagtggagtgggatggactaccgaacaccaacgaccgtacggaaccctacgtatcggaccgaggtctacgacggtacggttacgtttcgtaccttcgtaccgtgacctcctcgtgtacacgctacgtgtactatcgtcgtgactagtactacgacgtaacgtacgtaccgtaggacgtacggaacgtacgtacgtcgttaccggtttactttacgttcgtcggttacggtacggtacggttacggtacggaggtacgtacggtcgggttcggtaccgggtaccggggttaggggtaccgggttacggggttacgtacccggttacgggacccggggttacccgggaccgggttaaccccggg

SEQ ID NO: 255433 - DNA, 628 bp, Homo sapiens
  misc_feature: GYAE6OF02HML8G.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatcgtgggtctgagttgaagaagccgtggggcctcagtgaaggtttcctgcaaggtcttctggatactaccttcactacctatgctatgtaattgggtgcgacacggccccgtggacgaagggcttggaggtggagtgggatggatacaacaccaacacgtacggaaccaacgtactcgccgaggtctacgacgacggtacggtttcgtcgttcgttccgttggacctaccttcgtcgttccgagtcgacgtggactatatcgtagctagatcgagacacgaccgtaagcgtagaggtactacgtcgacgtttagttactttcgtggttaggacggtaggttacggttacgaggtacggagtacgggtcggtaccggttcgggtccgggtaagggggtcggggttagttaccggaaccggtttacgggtaccggggaccgtaacccgggg

SEQ ID NO: 255434 - DNA, 592 bp, Homo sapiens
  misc_feature: GYAE6OF02IBY22.23.76.G10.1.454.CMB.1.raw
  modified_base (287)..(287): a, c, t, g, unknown or other
  misc_feature (287)..(287): n is a, c, g, or t
  modified_base (367)..(367): a, c, t, g, unknown or other
  misc_feature (367)..(367): n is a, c, g, or t
  modified_base (457)..(457): a, c, t, g, unknown or other
  misc_feature (457)..(457): n is a, c, g, or t
  modified_base (532)..(532): a, c, t, g, unknown or other
  misc_feature (532)..(532): n is a, c, g, or t
  modified_base (582)..(582): a, c, t, g, unknown or other
  misc_feature (582)..(582): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagagccgtggggcctcagtgtaacggttttcctgcaaggtcttcgtggactaccacctttcactacctatgctatgtaagttgggtgcgacncgggcccctggacaagggtcttggaggtggtagtggggatggactacgaaccaccaactacgtacgggaaaccctaagtncgccgaggtcttcgacgaggttacgtttcgttctcgttccgtgacctcctcgtcgtcagtcagtgactatactcgtagctaagctagacncgacgtaacgtaaggcctaaggacgactagtcgtccgttgttattccgagtgacggtaaggtgactagggatcgnggtcggacgtcgggacggtggggacggtattccggacggtggtaccgggngtaacccggg

SEQ ID NO: 255435 - DNA, 610 bp, Homo sapiens
  misc_feature: GYAE6OF02GWZ3B.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagccgtggggcctcgagtgaaggtttcctgcaaggcttctggatacaccttcactacctatgactatgtaagttgggtcgacgacgacggcccctaggacaagggcttgagtggatgggatggatcaacaccaactacgtaggaacccaacgtatcgaccgaggtcttacgacgaggtacgtttagtctttcctcgttcggacctaccgtcgtacgtacgagactacgtcggctatacgttctagactagtactcagcagtacgtaaacggctaggacgacacgtcgaccgttgttacgttcgtagtcggacgtaaggtacggtacgaggtacgtcgtagggtcggtacgttcgggtaccggagggggtacgggtagttcggacggtacgggtcggggacccgtaaccgggg

SEQ ID NO: 255436 - DNA, 685 bp, Homo sapiens
  misc_feature: GYAE6OF02GYS46.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacaccttcactacctatgctatgaattgggtgcgacacggcccctggacaagggcttgagtggatgggatggatcaacaccaacacgtagggaacccctaacggtactcggacccagggtccttaccgaacgtacgggtaaccggttttgttccgtttccgttccgtttcgggaaccctacccttcgttcgttaccgaggtctaagttcgggacctaagttactcgtcgtaccgtaagtacgtcgaacgtaccgaacggtaccttaaacgggccgtaggaacggtacctaacggttcgtacccggttgttaacgtttccgtggttcggtacgtaaggtacggtttcgagggtacgtacggtaggtcgggtcgttacgggtaccggtacgggggtacgggggtaattcgggaaccggttacgggtcgggggacccgtaaccggggg

SEQ ID NO: 255437 - DNA, 612 bp, Homo sapiens
  misc_feature: GYAE6OF02FLAZX.23.76.G10.1.454.CMB.1.raw
  modified_base (280)..(280): a, c, t, g, unknown or other
  misc_feature (280)..(280): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagccgtggggcctcagtggaaggtttcctgcaaggcttctggatacaccttcactacctatcgctatgaattgggtgcgacncggcccctggacagggcttggagtggagtgggatggatcaacaccaacacgtacgggaaccctaacggtatcgacccgtagggccttacgacgacgggttacgtttcgtctttccgtccgttggacctcctctgtcagctagtcggactagtactctgcagatcgacgcgtacgaaccgtaaagggctaggacggaactacgtcggtccgttagtttactttcgtggtcgtaggacggtagttacgagggacgtcggtaggtcgggtcgtacgggtccgggaggggtcggggttattccggtacgtacgggtccggggtaccgaacccgggg

SEQ ID NO: 255438 - DNA, 848 bp, Homo sapiens
  misc_feature: GYAE6OF02FSYJK.23.76.G10.1.454.CMB.1.raw
  modified_base (201)..(201): a, c, t, g, unknown or other
  misc_feature (201)..(201): n is a, c, g, or t
tcagacgcgagtatcacgaccggtgctcgatttagtcactcatacaggggacccaacaaccacacccctcctaagaagaagccctagaccacagctccacaccatggactggacctggaggatccgtcttcttggtggcagcagcaacaggtgcccactcccaggtgcaacctggtgcaatctgggtctgagttgaagaancctggggcctcagtgaaggtttcctgcaagggcttctgggatacaccttcacctacctatgctatgaattcgggtgcgtaacgacggcccctaggacgaaagggcctttggagttcgggaatggggtacgtaggtactacgaaacgacccaaagtaccgttacggggaaacccctaacggtaactcggacccccgaagggtccctttacgaaccgtaggggtaaccggttttcgttaccttttacgtaccccgttttagggaacccgttaaccccttccgtttaccggttacgacggtaccgtacgtacggtaccgaacttacttaccgttacggtccgtaagggtaacttacccgacggtaacctacggttaaccccgtaaaacgggtccggtaaccgtaaccgggggtaactaacccggtacggttacccggttacggttttaaccgttttccggtttacggttaacggtacccggtaagggttaaccggggttaccgttacggggtacggtacggttaacggggttccgggtaccggttaccggggttacccgggaacggggggttaccggggggggttaccgtttagggttaaacccggtttaccggggttaccggggggtacccgggttaaaccccgggggg

SEQ ID NO: 255439 - DNA, 733 bp, Homo sapiens
  misc_feature: GYAE6OF02G11ZK.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagccgtggggcctcagtgtaaggtttcctgcaaggtcttcgtggataccaccttcactacctatgctatgtaagttgggtgacgacgacggtcccccgtaggaaccaagggtcttaggaggttggagtggggatgggataccaaccgaccaaactaccgtacggaaaccctaagtacgtcggcccgagggtccttacgaacgtacgggtacggttttacgtcgtttccgtccgttacggaccctacccgttacgttcggtaccgtacggtactacggtacgggtacctaagttacgtcgtagtaccgaagtacgtaccgaacggacctaacggacccgttaaaagggccttacgggaacggtactaccggttcgtaccgtttagttacgtttcgttggtacggtacggttaagggtacggttacgacggtacggacggtacgggtcggtccggtacggggtacccgggaggggggttaccgggggttattaccgggtaacggtaccggggtccgggtaacccgggtaacccgggg

SEQ ID NO: 255440 - DNA, 723 bp, Homo sapiens
  misc_feature: GYAE6OF02J17CQ.23.76.G10.1.454.CMB.1.raw
  modified_base (350)..(350): a, c, t, g, unknown or other
  misc_feature (350)..(350): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagagcctggggcctcagtgaaggtttcctgcaaggcttctggatacaccttcactacctatgctatgaattgggtgcgactacggcccctggacagggtcttgagtggatgggatggatcaacctaccaacgaccgtacgggaaccctaagtacncggacccgtagggtccttacgacgtacgggtaacggttttcgtacctttccgtaccgtttacgggaccctaacccgttcgtacggtaccgacggtactacgtcggtactaacgttctacgtcgactacgacgtacgagtaccgtacggtacccgttaaaggtccgtaagggtaccggtaccgtaccggttacggttacccggttaggtttaccgtttacggttacggttcggtaccggtaaggttaccgggtttaccacggggtagaccggttagggttacggttcggttacccgggttccgggtacgggggtaccggggttacgttaccgggtacggttacccggggtacggggacccggttaacccggggg

SEQ ID NO: 255441 - DNA, 695 bp, Homo sapiens
  misc_feature: GYAE6OF02HFF2O.23.76.G10.1.454.CMB.1.raw
  modified_base (149)..(149): a, c, t, g, unknown or other
  misc_feature (149)..(149): n is a, c, g, or t
  modified_base (226)..(226): a, c, t, g, unknown or other
  misc_feature (226)..(226): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacnggtagcccactcccaggtgcaactggtgcaatctgggtctgagttgaagagccgtgggcctcgagtgaaggtttccngcgaaggtcttctggatacaccttcactacctatgctatgaattgggtgcgacacggcccctaggacaagggtcttaggagtggagtgggatggatacaacaccaacacgtacggaaacccaacgtatcgacccgaagggccttaccgaacgacgggtacggttttcgtcctttcttccgttaggacctaccctcgtcgtcaggtctagtcggactatacgtcgtgacgagtactaccgacgacacgtaccgtaaaggactaggaacggtacctaagtccggtacccggtttagttacgttttacgtggttacggaacggttaacggttaacgggttaaccggagggtacggtaccggtaggttacggggtcccggttagggggtacccgggtaacgggggggttgggggttaactttccggggaacccgggttaacgggtaccgggggtaccccggtaaacccggggg

SEQ ID NO: 255442 - DNA, 688 bp, Homo sapiens
  misc_feature: GYAE6OF02IOAR4.23.76.G10.1.454.CMB.1.raw
  modified_base (225)..(225): a, c, t, g, unknown or other
  misc_feature (225)..(225): n is a, c, g, or t
  modified_base (266)..(266): a, c, t, g, unknown or other
  misc_feature (266)..(266): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccgaggtgcaactggtgcaatctgggtctgagtgaagagccgtgggcctcagtgtaaggtttccngacgaaggtcttctggatacctaccttcgactacctatcgnttaacgtgtaagttgggtgacgtacgaccggtccccgtagggaaccgtaaggggtcctttaggacggtaggtacggttaggggtacgtaggacctaacggaaccaccgaaacgtcgtaaccggaaaccctaagtacgtcggaccgaggtacctcgaacggtacggttaggtttctccgttacgttccgtacggtactaccgtctgtaccaggtcctaagtcggtacgtacttagtactcgacgtaacgtacgtacgacgtagtaaccggaccgttaaaggcgtaggaccaacggtccgacggttcgtacgttacttcggtacgtcggacggtacggtacgttacggacgagtcggaggttcgacggcgggtacggtagggcgggttactaccggtacggttacggtccggggactaacgggg

SEQ ID NO: 255443 - DNA, 708 bp, Homo sapiens
  misc_feature: GYAE6OF02IN8KP.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagccgtggggcctcagtgaaggtttcctgcaaggcttctggatacaccttcactacctatgctatgaattgggtgcgacacggcccctggacgaagggcttggagtggagtgggatggatcaacaaccaactacgtacgggaaacccaacgtagtacgcccgaggccttacaacgtacgggtacggttttcgtcctttccgttccgttacggtacctacccttcgttacgtacacggactagttacggacctaagttacttcgttacgacgaggtataccgaggaccgtaacgacccggttaaaaggccgtaaggaccgggtaacgtaccgttacgtacccggttagtttaactttcgttacggttacggtacgtaagggttacgggtttacgaggtacgggtaccgtaacgggttacggcgggttacgggtaccgggtacggggggtacgggggttacgtttccggggtaaccggttacgggttaccgggggacccggttaacccgggg

SEQ ID NO: 255444 - DNA, 653 bp, Homo sapiens
  misc_feature: GYAE6OF02F925Y.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgccaatctgggtctgagttgaagaagccgtaggggcctcgagtgaaggtttcctgcaaggcttcgtgatacaccttcactacctatgcttatgaagttgggtcgacgtacacggcccctggacaagggtcttgacggtggagtgggatggatacaacaccaacgacgtacgggaacccaaggtatcgaccccgtaggacttacgaacgtacgggtacgttttcgtacctttcgtaccgtttaggaccctacccgttcgttacggtcctagacctagtcggactagtacttcgtagctagtactcgagtcacgtaacgtaaggcgtagacgacgtcgtcggaccgtttgttaactttcgtaggtcgacggttagggtacggttacgaggtacgcgtaagggtcggtaccggtacgggttacgggacggggtacggggttagttaccggacggtacggggtacgggacccgtaaccgggg

SEQ ID NO: 255445 - DNA, 669 bp, Homo sapiens
  misc_feature: GYAE6OF02JE39M.23.76.G10.1.454.CMB.1.raw
  modified_base (235)..(235): a, c, t, g, unknown or other
  misc_feature (235)..(235): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagagcctggggcctcagtgaaggtttcctgcaaggcttcnggatacaccttcactacctatcgctatgaattgggtgcgacgacggcccctggaacgaaggggcttggagtaggagtggggatggatcaacaccaacgacgtacgggaaccctaacggtatcggaccgtagggcccttacgacgtagggtacgttttcgtcttccgtccgttaggtacctccgtctcgtacacgactagtcggctagtatcgtcgctaggactacgacgtccaagtaccgtaaacggcgtaggaacgggtacctacgttcgtacccggtttagtttacgtttcgtacggttggtacggtaggtacgggtttacgagggtacgtacggttaagggtcgggtcgtttacggggacccggttaaggggggtcgggggttaacttacgggtaaccggttacgggtaccggggtaccggtaacccgggg

SEQ ID NO: 255446 - DNA, 612 bp, Homo sapiens
  misc_feature: GYAE6OF02HO4B5.23.76.G10.1.454.CMB.1.raw
  modified_base (236)..(236): a, c, t, g, unknown or other
  misc_feature (236)..(236): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgtaatctgggtctgagttgaagaagcctggggcctcagtgaaggtttcctgcaaggcttcnggatacaccttcactacctatgctatgaattgggtgcgacaggcccctggacaagggcttggagtggagtgggagtggatcaacaccaacactgggaaccctaacggtactacgcccgaggtcttcgacgtagggtacggtttgtcttctccttggacctaccgtctcgtcacgcagtcggactatatctgctagactcacgacacgtacctaaagggactggaaggacctacgcgtaccggtgtttacgtttcgtagttggacggtacgtagggttacgagggtacgtcgtagggtcggtcggtacggtccgggaaggggggtcggggtagttacgggacggttacgggtcggggaccggtaccgggtaacccgg

SEQ ID NO: 255447 - DNA, 562 bp, Homo sapiens
  misc_feature: GYAE6OF02JZGFJ.23.76.G10.1.454.CMB.1.raw
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
  modified_base (344)..(344): a, c, t, g, unknown or other
  misc_feature (344)..(344): n is a, c, g, or t
  modified_base (423)..(423): a, c, t, g, unknown or other
  misc_feature (423)..(423): n is a, c, g, or t
  modified_base (477)..(477): a, c, t, g, unknown or other
  misc_feature (477)..(477): n is a, c, g, or t
  modified_base (482)..(482): a, c, t, g, unknown or other
  misc_feature (482)..(482): n is a, c, g, or t
  modified_base (493)..(493): a, c, t, g, unknown or other
  misc_feature (493)..(493): n is a, c, g, or t
  modified_base (503)..(503): a, c, t, g, unknown or other
  misc_feature (503)..(503): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgacgttgaagaagccgtggggcctcagttgaaggtttcctgcaaggtcttctggatacaccttcactacctatgctatgagttgggtncgacncggcccctaggacagggcttgagtggatgggatggatacacaccacacgtacggaaccagtancggaccgaggtctacgacgacggtcgtttcgtcttctacgtgactacctcgtacgtcagactagtcgactagtctcgtnacgtagactcagaccacgacgtaagcgtgacgacagttacgcgttattcgttcngtcgngaagtacggtnacggagtcgnggtcgtcggtacgggtcggagggtcggtagtcggacggtcggacgggtacggtaaccgg

SEQ ID NO: 255448 - DNA, 739 bp, Homo sapiens
  misc_feature: GYAE6OF02JB6LE.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagccgtggggcctcagtgaaggtttcctgcaaggtcttcgtggataccaccttcactacctatgctatagaagttgggtcgacgactacggtccccctggaaccgaagggtcttggagttggagtgggactggactcaaccgaccaaacgtacgtacgggaaaccccaacgtagtcgacccgagggtccttacgaacgtacggtaccgggttttctcgtttccgtccgtttacgggaacctcccgttcgttagtaccacgacgtacgtacggaccgtattacgttcgtacgtacgtacggtacgtacgtaacgtaccgtaacggtaacccgttaaaaggggtccgtaacggaacggttaaccgtacggttaccggttacccgtagttttaccggttttcgtaacgggttcgtacgggttaagtacgggttacgtacgggtacggtaccggtaagggttccggtacggttcggggtaccggtaggggggtaccggggttagtaccggtacggttacccgggttaggggacccgtaaccgggg

SEQ ID NO: 255449 - DNA, 763 bp, Homo sapiens
  misc_feature: GYAE6OF02IZQZV.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgagaagcctggggcctcagtgaaggtttcctgcaaggtcttcgtggatacaccttcactacctatcgctatgaagttgggtgcgacgacggcccccgtggaacgaagggcttaggtacggtgggagtggggagtgggattaccgaaccaaccaaccgaacgtacgggaaacccctaacggtaacgttcggacccgacggtccgttacgaaccggtacggggttaccgggttttcgtaccgtttccgttacccgttacggtaccctacccgttacccgttaggttccgacgggtacctaacgttacggggtcctaacgtttaccgttggtactaacggacgttactaccggtaacaccggtaaccgttaacccggtaaaaggtcccgttaagggaaccgtaacgtacgtcgtacgttagttcctttacgtcggtacgtacggtacgggttaggtaccggaggtaacggtagtaacggggttcggtacggttacgggtaccggggtacgggggtacgggggttacttaccggggttacggtacccggggtcggggaacccggttaaccgggg

SEQ ID NO: 255450 - DNA, 639 bp, Homo sapiens
  misc_feature: GYAE6OF02GTFJX.23.76.G10.1.454.CMB.1.raw
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
  modified_base (548)..(548): a, c, t, g, unknown or other
  misc_feature (548)..(548): n is a, c, g, or t
tcagacgcgagtatcacgaccggtgctcgatttagtcactcatacaggggacccaacaaccacaccctcctaagaagaagccctagaccacagctccacaccatggactggacctggaggatcctcttcttggtggcagcagcaacaggtgcccactcccaggtgcaactggtgcaatctgggtctgagttgaagaagcctggggcctcgacgtggaaggtttcctgccaaggcttctgggatacaccttcactacctatgctatgaattgggtgcgtacaggcccctggaccaagggcttagagtggatgggatgggatcgaacncaacnctagggaacccaacgtactgcccaagggccttacgacacgggacgtttgtacttctccgttggactaccgtctcggttccaagtccgtaacgttcggacctaataacgtcttgggaccctaggacttcagtaccgacgcccgttaaaaggccttacggaagggacctaacggtcgccgttacgttatttccgttgttcggccgtagggtaccggttnacggggtacgcggtaaggtcggtcgtaggggtaccgagggggtacggggtattcgggaacgtttacggaccgggggtccgtaaacccgggg

SEQ ID NO: 255451 - DNA, 943 bp, Homo sapiens
  misc_feature: GYAE6OF02IKIPE.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatcgtgggtctgagttgaagaagccgtgggcctcgagtgtaaggtttcctgcgaaggtcttcgtgggtactacgtacctttcaccttacctatcgacttagttagaagtttgggacggtaccgacgaccgggtcccccgtagggacgaaacggggtccgtttaggagggtacgggtaagttcggggaagttgggtaactaaccgaaacgtaaccccgtaaacgtaaccgggtttaaccggggaaacccctaaaccggggttagtaaccggaccccggtaaaggggttccctttaaaccggaaccgggtaacgggggtttaaccgggttttttcgggttacctttaccggtttacccgtttacggggtaaaacccttccgtttaccggtacgtttaccgaacggtacgtacgggttacgaccttaacgttaccgttacggttacgacgtaaccggttaactaccggaaccggaccgtaacggttaacccggtaaaacggggttcccgaaagggtaaacccggtacgttacccgggtacccggtttaacgtttccggttttaacgttttcccgggttaacgggtttcgggaaacccgggttaagggtttaaccgggttacccggttagggggaaaccgttcggtaacggggttccgggacgggttaacccgggggacccgggttagggggggaaccgggtttaacggttttaccggaaccggggtttaccgggtacccggggggtaaccccgggtttaaacccgggg

SEQ ID NO: 255452 - DNA, 755 bp, Homo sapiens
  misc_feature: GYAE6OF02H6VEX.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttctggtggcagcagcaacaggtgcccactcccaggtgcaactggtgcaatctgggtctgagttgaagaagcctggggcctcagtgaaggtttcctgcaaggcttctggatacaccttcactacctatgctatgaagttgggtgacgacacggcccctggacaagggtcttgagtggacgtgggatggatcaaccaaccaacacgtacgggaaacctaagtactcgaccgaggtccttacgacgtacgggtacggttttcgtacctttccgtaccgtttaggaaccctaccgttcgtcgttaccgacgtaccgtaagttcgggtacctaagttacgttccgttaggaccgtaaggtactacgtaacggtccgtaaaccgtaaccggtaaaagggtcccgttaagggaaaccggtaccttaccggttacgggttacccggttttagttttaccgttttacggtacgggttaaccgggtaccggtaaggggttacgggttaccgagggtacggttacggtaacgggttccgggtcggttaacggggtacccgggtaaggggggttacggggttacttaccgggtaacccgggtttaacggggtcccgggggaaccgttaaccccggggg

SEQ ID NO: 255453 - DNA, 747 bp, Homo sapiens
  misc_feature: GYAE6OF02IFYXZ.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagagccgtggggcctcagtgaaggtttctgcaaggtcttcgtggatacaccttcactacctatgctatgtaagttgggtgcgacgacggccccgtggaacgaagggtcttggagtggagtgggagtggatacaacaaccaacacgtacggaaaccccaacgtataccggaccgacgggtccttacgacgtagggttccggttttacgtcctttccgttccgttacggtaccctacccgttcgtacgtacgtagttacgtcggacttagttacgttcgtagtactaacgtacttaccgtacgtacgtaacgtaacccgttaaaaggtccgtaaggaacggtaaccttacggtcggttaccgtttaggttacttttcggacgggtttacgaccgggtaaaggttacgggttacgacgggtacgtaccggttacggggttcgggtacccggttcgggggtaacccgggtagggggggtaccggggttaacgtttacggggtaacccgtttaccgggggtccgggggtaccccggttaaccggggtaacccccggg

SEQ ID NO: 255454 - DNA, 704 bp, Homo sapiens
  misc_feature: GYAE6OF02JFPV0.23.76.G10.1.454.CMB.1.raw
  modified_base (246)..(246): a, c, t, g, unknown or other
  misc_feature (246)..(246): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagagcctgggcctcagtgaaggtttcctgcaaggcttctggatacaccttnactacctatgctatgtattgggtcgcgacacggcccctggaaccaagggtcttggaggtaggagtggggagtggactacaaccgtaccaacgacgtacgggaacccgtaagtactcgacccgagggtccttacgacgtagggtacgggttttcgttactttccgtaccgtttcggacccgtacccttcgttcgttaccgacgacctaggtcggacctaagtttaatcccgtgacgtaagacctacgtacgcgtaacgtaaccgttaaaggctaggaacggtacctacgtaccgggtcgttacgtttagtttaccgtggttacggtacggtagggtaccgtttacggagggacgtaccggtaagggttcggtccggtacggggtacccggtaggggggtacccggggttagttaccgggtaccggttaaccgggggtggggtaccccggtaaccggggg

SEQ ID NO: 255455 - DNA, 776 bp, Homo sapiens
  misc_feature: GYAE6OF02IUD92.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagccgtggggcctcgagtgtaaggtttcctgcgaaggcttcgtaggactacctaccttacactacctatcgctataggtaagttgggtgaccgacgaccggtccccgtaggaaccgtaagggtctttaggaggtgggtagtggggagtacgggactaccgaaccgaaccaacgtaccggtaaccgggaaaccctaagtacgtaccgacccgtaggtccttacgacggtacgggttaccggtttagttccgttaccgttccgttacggaccctaccgttcgttacgtccgacgtacgtaagtcggaacttagttacgtcgtacgactaacggtactaccgaagtacctaacggtaacccgtaaaggtccgtaagggaaccgtaacgtaccggttacgggttacccgtttagtttaccggtttcggtagttccgggtaacggttaggttaccgggttacgacgggtaacgtacgggtaacgggtcggtacccgggttacgggtaccggggtaacggggggttcgggttaaggttacccggtaacgggtacggggtacccggggtaaccggtaacccgggg

SEQ ID NO: 255456 - DNA, 687 bp, Homo sapiens
  misc_feature: GYAE6OF02JDRWF.23.76.G10.1.454.CMB.1.raw
  modified_base (263)..(263): a, c, t, g, unknown or other
  misc_feature (263)..(263): n is a, c, g, or t
  modified_base (366)..(366): a, c, t, g, unknown or other
  misc_feature (366)..(366): n is a, c, g, or t
  modified_base (402)..(402): a, c, t, g, unknown or other
  misc_feature (402)..(402): n is a, c, g, or t
  modified_base (465)..(465): a, c, t, g, unknown or other
  misc_feature (465)..(465): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaaacaggtgcccactcccaggtgcaacgtggtgcaatctgggtctgagttgaagagccgtggggcctcagtgaaggtttcctgcgaaggtcttcgtggatacctaccttcactacctntgcttatgaagttggtgcgacgacggcccgtaggaacgagggtcttaggagtggagtgggatggacacgaactaccaacgtacgtaaccgggaacctacggtntacgacccgagggtctcgaacgtaggtaccggtttntaccgtttccgtccgttcggtaacctacccgttcgtcgtacgagctagtcggtactaacgttntaccgttgtacgaaagtcgtactacggaaccgtaccggtaaccggtaaacgtcgtacggaacgggttaccaaccgggttccttaccggtttgttaacgtttggtacggttcggaccggtaaggttccgttacgggagtacggtacgtagggtcgacggttcgggacggtacgggggtacggtaggtaccgtacgggtaccgggttacgggccgtaaccgggg

SEQ ID NO: 255457 - DNA, 767 bp, Homo sapiens
  misc_feature: GYAE6OF02JW6MW.23.76.G10.1.454.CMB.1.raw
  modified_base (236)..(236): a, c, t, g, unknown or other
  misc_feature (236)..(236): n is a, c, g, or t
  modified_base (320)..(320): a, c, t, g, unknown or other
  misc_feature (320)..(320): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcaggcagcaacaggtcgcccactcccagggtcgcaacgtggtgacaagtcgtggggtctgaggttagaagacgccgtggggcctcgagtgtaagttcngcgaaggtcttgaggtactacctccttcacttacctatggtacctatacggtaagttgggtacgccgtacgaccgggtccccgngggtaacgaacgggttcgttagagggtaggagttggggtaactagggtaacctacgaaaaccacccggtaaaacctcggtaacgggggtaaacccctaacgtaacggtcccggaacccgtacggggtaccttaccggaaccgttcgggttaacggtttttccggtactttcccgttacggtacggtacccctacgtttcgtacggtactcgcgtacgcggtactaacgtcgtacacgtacgacgtagtacctacgacgttacgaacggtacgtacggcgtaacggacgttacgtaccggtacgtttacgttacgttcgtcggttaacgagggttaacgttaggtaccggacggttacgacggtgtccgggtacggtccgggtaccgggtaagggtacgggttacgaccggttaccggtaacggggttcccgggacggttaacccggg

SEQ ID NO: 255458 - DNA, 825 bp, Homo sapiens
  misc_feature: GYAE6OF02H09TW.23.76.G10.1.454.CMB.1.raw
  modified_base (164)..(164): a, c, t, g, unknown or other
  misc_feature (164)..(164): n is a, c, g, or t
  modified_base (228)..(228): a, c, t, g, unknown or other
  misc_feature (228)..(228): n is a, c, g, or t
  modified_base (282)..(282): a, c, t, g, unknown or other
  misc_feature (282)..(282): n is a, c, g, or t
tcagacgcgagtatcacgaccggtgctcgatttagtcactcatacaggggacccaacaaccacacccctcctaagaagaagcccctagaccacagctccacaccatggactgggacctggaggatcctcttcttggtggcagcagcaacaggtgcccactcccnggtgcaactggtgcaatcgtgggtctgagttgaagaagcctggggcctcgagtgtaagtttccngacaaggtcttgtggactacctccttctactacctatgctagtgtaagttgggngacgtacgaccgggccccgtagggacgtaacgggtcgttaggaggttcgggagttggggaactagggaacttaccaaacctaacccgaaaccgtaccggtaaccggggaaaccccttaacggttacgtacccggacccggtacgggtacccttacgtaaccggtaacggggttaccggtttttacgtcccgtttacccgttccgttaacggtaccctacccttcggtcgtacctaacggtcgtagtcggactagtccgttgaccgactagtacgtacgacggacgtaacgaacgttaaacggcgtaacggtaaccgtacgtcccggttacggtacccggtttagtttaccttcggttacgggtacgtaaaccgggttacggttaacgggttaccggaggggtacccggtacgtaaccgggggttttccggaacgggggttcccgggtaaccggggggtaaggggggttacccggggttaggttaacccgggaacccgggggtttaaccgggttaccgggggggtaccccgttaaacccggggg

SEQ ID NO: 255459 - DNA, 638 bp, Homo sapiens
  misc_feature: GYAE6OF02IJPWD.23.76.G10.1.454.CMB.1.raw
  modified_base (359)..(359): a, c, t, g, unknown or other
  misc_feature (359)..(359): n is a, c, g, or t
  modified_base (374)..(374): a, c, t, g, unknown or other
  misc_feature (374)..(374): n is a, c, g, or t
  modified_base (407)..(407): a, c, t, g, unknown or other
  misc_feature (407)..(407): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctggagttgaagagcctggggcctcagtgaaggttcctgcaaggtcttcgtggataccaccttcaccttacctatgcttatagaagttgggtcgacgacgacggtccccctgggacaagggcttaggaggtggagtggatggatcgaacacaacacgtacgggaacccagtancgccaggtctacganacggtacgttgtacttctacgttggactacctntcgtcagcagtcgccagttacgtctgacacgtactcgtacgcgacgtaccgtaacggtctacggacggactaccgtcgtaccggttagttactttccgtagttcggaccggtaggttacggttaccggagggtacgtacggtagggttccggtccgtacgggttaccggaacggggggtcggggttaacgttccggaacggttcgggaccggggtacccgtaacccggggg

SEQ ID NO: 255460 - DNA, 711 bp, Homo sapiens
  misc_feature: GYAE6OF02GVV2M.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaacgtggtgcaatctgggtctgagttgaagaagcctggggcctcgagtgaacggtttcctgacaaggtcttcgtggaactacctaccgttcaaccttacctattcgactatgtaactttggggtcgacgacgacgggtccccctagggaaccgaaggggtcttaggacggttgggagtggggatgggactaccgaaccaaccaacgtacgtacgggaaacccctaagtacgcgcccgtaagggtccttacgacgtacgggttacggtttacgtccttccgtccgttacggacctacccgttcgtacgtcacgtcgtagtggtaacctatcgtccgttgactagtactacgagacgacgtaaccggaagtcgtacggaacgtacctcgtccggtcgtttagttagtttccgtaggtcggtagtaggtacgtttacggaggtacgcgggtaacgggtcggtaccgggtcggtaccggggtagggggtacggttacgttaccgggaccggtttaaccggggtcggggtaacccggtaacccggggg

SEQ ID NO: 255461 - DNA, 835 bp, Homo sapiens
  misc_feature: GYAE6OF02FMTZP.23.76.G10.1.454.CMB.1.raw
  modified_base (150)..(150): a, c, t, g, unknown or other
  misc_feature (150)..(150): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacgnggtcgcccactcccaggtcgctaactggtgcaatcgtgggtctgagttagaagacgccgtgggcctgagtaggtagtttcctgcgaaggtcttcgaggatacctaccttcaacttacctagtcgtacttagtacgtaaggttgggtacgaccgaccgaccgggtacccccgtagggaaccgtacgggtcgttacggaaggttagggacgttagggggacttacgggaactaacccgaaccgtaacccgaacgtacccggtaaccgggaacccctaaggttacgccggacccgtagggtaccttacgaacggtacggttacggtttccgtccgtttccgtacgttacggtaccctaccgttcggtaccgttaccgacgtaccgtaggtccgtaacgtaacgttccgtacgttcggacccaaggttacccaggtaacggtccgtaaccgaacccggttaaggccgtaacggtaaccggtaccgttaccggttaccgttaccgttcgtttaacgttttccgggcggtaacggttcccggaaaggggttttacccgagggtaaccgggtacggtacgggttaacgggtcggtacccgggggttcgggtacggggaccggggggttcgggtaacgtttacccgggtccggggtaacccggggacccggggttaacccggtaacccggggg

SEQ ID NO: 255462 - DNA, 679 bp, Homo sapiens
  misc_feature: GYAE6OF02HN7XD.23.76.G10.1.454.CMB.1.raw
  modified_base (235)..(235): a, c, t, g, unknown or other
  misc_feature (235)..(235): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcgttggtggcagcagcaacaggtcgcccactcccaggtcgcaacgtggtgcaatcgtgggtctgtagttagaagacgccgtgggcctcgagtgtaacggtttccngacgaggtcttcgtggactactaccttcacttacctagtcgtctaatgtaagttggggtagacgaccgacggtccccgtaggaacggacgggtcgttaggaggtcggagtgggtagtaggactaccgaaactaaccgaacgtaccggtaccgggaaacccgtaacgtacgtcggaccgtacggtcctacgaacggtaggtacggtttcgtccttcgtccgtacgtacctaccgttctgtcagtacgtacgtcgtactattacgtacgtcgacgacgtatacgtacaccggtaacgtaaaccgtaggtacacgacggacgtcgtcgtacgttagttcgttcgtgttcgtacgacggttacggtacgtacggagtcggaggtcggtgttaccgggcggtaggggcgggttacgtaggtaccggtcgggtacggaccgtaacccggg

SEQ ID NO: 255463 - DNA, 673 bp, Homo sapiens
  misc_feature: GYAE6OF02GDY0L.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgtaaggtttcctgcaaggcttcgtggatacaccttcactacctatgctatgaagttgggtgtacgacaggtccccctggacgaagggtcttagagtggagtgggatggatacaacaccgaactacgtacgggaaccctaacgtatcgacccgaggtaccttacgaacgtacggtacggttttcgtacgtttactccgtttagaccctaccgtcgtacggtcgacgtacgtagtcggtctataacgtctgacaagtactacgagcgtaacgtaccgtaaaggcgttacgaacggtacctacgtcggttccgttagtttaaccgtttcgtaggtcggtaccggtaaggtacggttacgtagggacgaccggtacgggttcggtcggtccgggtacggacggggggtacggggtacgttacggtaacccggttacgggtaccgggggtacgtaacccggggg

SEQ ID NO: 255464 - DNA, 738 bp, Homo sapiens
  misc_feature: GYAE6OF02I58YQ.23.76.G10.1.454.CMB.1.raw
  modified_base (664)..(664): a, c, t, g, unknown or other
  misc_feature (664)..(664): n is a, c, g, or t
  modified_base (670)..(670): a, c, t, g, unknown or other
  misc_feature (670)..(670): n is a, c, g, or t
tcagacgcgagtatcacgaccggtgctcgatttagtcactcatacaggggacccaacaaccacacccctcctaagaagaagcccctagaccacagctccacaccatggactggacctggagatcctcttctggtgcagccagcaacaggtcgcccactcccaggtgcaactggtgcaatcgtgggtctgtacgttagaacgaacgccggtcggggcctcgagttacggtaacggtttcctgacgtaaggtccttcgtaggtactacctaccttcaaccttactatgtctagttacgtaaggttcgggtacgccggacgtaccgggtacccccgtaggaaccgtaggggtcttcgggtaaggttcggaggtagggtactacgggtaacctacgaaaccctaaccgaacgaccggttaacgggaacctaacggtcgtaccggaccctagggtcccttaacgaccggtacgggttaacggttttcctccttttaccgtcccggttaacacccgtcctttacggtacgtacccacgtacgtacggcgtacctacgttacgtcccgtaagtaccgtagtactacgacgtaactaccgtaacggttacgacgtcgggaacctacgtcgtaacggtccgttagtttactcggtgtacgacgtgtaccgtanacggtncggttacgcggttactcgggtacggcgggttaggcttaccggacggtaagggtccggacccggtacgg

SEQ ID NO: 255465 - DNA, 715 bp, Homo sapiens
  misc_feature: GYAE6OF02G1UVH.23.76.G10.1.454.CMB.1.raw
  modified_base (546)..(546): a, c, t, g, unknown or other
  misc_feature (546)..(546): n is a, c, g, or t
  modified_base (551)..(551): a, c, t, g, unknown or other
  misc_feature (551)..(551): n is a, c, g, or t
  modified_base (556)..(556): a, c, t, g, unknown or other
  misc_feature (556)..(556): n is a, c, g, or t
  modified_base (656)..(656): a, c, t, g, unknown or other
  misc_feature (656)..(656): n is a, c, g, or t
tcagacgcgagtatcacgaccggtgctcgatttagtcactcatacaggggacccaacaaccacacccctcctaagaagaagccctagaccacagctccacaccatggactggacctggagatcctacttctggtgcagcagcaacaggtgcccactcccaggtgcaactggtgacaagtctgggtctagtacgttagaagaacgtccgtgggggacctcgtaggtagtaacggttttccagacgtaagggtccttacgtagggaactaccgacctttcaaccttaccgtagtcgtaccttagtagtaagttgggtcgaccgacgtaccggcccccgttaggaccggtaaagggtcctttagggaccggttggtaaggtggggtagttacgggtactaccgaaaccgtaccgaaaaccgtacgggttaaccggggaaacccctaagtacgtaccggaccgtaacggtctaacgacgtacggtacgtttcgtccttaacgttcgtagaccctactcgtacgtacgagtctagtacgagtactagttcngtacngtaancgaacgtcgacgtaccgtaaggtctaggacgacgtacgtacggtaccttagtaccgttgtacgtcgtacgaggttccgtaggacgacgttgacggttcgnggtcggacgggagggtacggttacgtaagttcccgggaaggtaccgggccgtaaccggg

SEQ ID NO: 255466 - DNA, 672 bp, Homo sapiens
  misc_feature: GYAE6OF02IELXO.23.76.G10.1.454.CMB.1.raw
  modified_base (282)..(282): a, c, t, g, unknown or other
  misc_feature (282)..(282): n is a, c, g, or t
  modified_base (575)..(575): a, c, t, g, unknown or other
  misc_feature (575)..(575): n is a, c, g, or t
tcagacgcgagtatcacgaccggtgctcgatttagtcactcatacaggggacccaacaaccacacccctcctaagaagaagcccctagaccacagctcccacaccatggactggacctggaggatcctcttcttggtggcagcagcaacaggtgcccactcccaggtgcaactggtgcaatctgggtctgagttgaagaagccgtggggcctcgagtgtaacggtttcctgacaaggtcttcgtggataccaccttcactacctatgctatgtaagttgggngcgacacggcccgtaggacgacgggtcttggaggtggacgtggggtatggataccaacaccgaacaccgtacggaaccctaagtacgacgcccgaggtcctacacggtacggtacgtttcgttactccttaccgttacgacctaccgttcgtacgtaccacgtcgtagtcgcttatacgtacgtagcgtagtacgtacgagaccgtaacggtaccgtaaacggtcgtacggacggtacgacgttacgggtacgttagttagtttcgttagtaggtaccggtagtacgggttanagggtacggtgtacgggtcggtacggtccgggtacggggaagggtcggggttaacgttggacccggtttaacgggccggggtaaccgtaacccgggg

SEQ ID NO: 255467 - DNA, 775 bp, Homo sapiens
  misc_feature: GYAE6OF02I8RUT.23.76.G10.1.454.CMB.1.raw
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgagagcctgggcctcagtgaagtttccngcaaggcttcgtggatacaccttcactactangtctatgtaagttgggtgcggaacgacgggtcccctagggaccgaagggtcttcggagtgggatggggatggactacgaacaccaagacgtacgggaaaccctaacggtacacggtcccgaagggtccttaccgaacggtacggggttaccggttttacgttcctttaccgttcccgttacgggtaccctacccttagttcgtacgacgtccgtagtcgggaactagttactcggtagtaccgaaggttactaccgaaggttacgtaaacgggttaaccccgtaaagggtaccgttacgggaaaccggtaaccttaccggttacgggttaccccgtttaagggtttaccttttaccggttagggttacgggtaaaccggttaaggggttaacgggttaccgggtaacgggtggttaaccggttaaggggttccgggttaccgggtggggtaacccgggtagggggtaccgggttagggttaccgtacgggtaaccgggtcggggtaaccccggtaaccgggg

SEQ ID NO: 255468 - DNA, 940 bp, Homo sapiens
  misc_feature: GYAE6OF02G6VTS.23.76.G10.1.454.CMB.1.raw
  modified_base (177)..(177): a, c, t, g, unknown or other
  misc_feature (177)..(177): n is a, c, g, or t
tcagacgcgagtatcacgaccggtgctcgatttagtcactcatacagggggacccaacaaccacacccctcctaagaagaagcccctagaccacagctccacaccatggactggacctggaggatccgtcttcttggtgcagcagcaacaggtgcccactcccgagtgcaactggtnacaatcgtaggggtctaggtaggttacgaacggaagccgtggggcccttgaagttggtaaacggtttcctggacgtaacggtctttacgtagggtacttaaccgtcctttacaaccttaccttaagtcgacttaagtaggtaagtttgggggtcacccgtacgtaaccgggtcccccgtggaaaccgaacggggttccttagggtaaggttcgggtacgttggggtaactagggtaacctaaccttaaccgtaacccgaaaccggtaccgtaaaccgggaacccccgtaaagtccgtacccgaccggtacggttccgttaaccaccgggtaacgggttaaccggtttttcgttaccgttcccgtttaaccggttacgggtaaccccttacccggttacgtttccggtaaccgtacggtccggtaaacgtttcggggaacctttaagttaacgttccggttacgacgttaaccgtaccgtaccgtaagttacccggacccggttaaacggtaacgtcgtaaaccgggtaaccgtaccgtaaaccggtccggtttacggttaaccttttcgtttccggggtcgttacgggttaccggtaacggggtttaaccgaaccgggtacgggtctaacggggtcgggttaacgggttccggtaaccgggggacccggggtttaaagggggggtcccggggtttaaccgtttacgggtaacccgggttttacccggggggtaccggggtacccccggttaaaccccgggggg

SEQ ID NO: 255469 - DNA, 886 bp, Homo sapiens
  misc_feature: GYAE6OF02IBZ6W.23.76.G10.1.454.CMB.1.raw
  modified_base (240)..(240): a, c, t, g, unknown or other
  misc_feature (240)..(240): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccacctcccaggtcgacaacgtggtgacatcgtgggtctgagttagaagacgccgtggggcctacgtaggtagtaacggtttccgngacgaacggtcttcgtaggtactacgtaccttacctacgttacctatcgcttagtagtaacggtttggcggtaccgacgaccggtccccggttacggaacggtaacgggtcgttaggtaacggtagggaggttagggtagtggaacttaaccgaaaccgaacccgtaaaccgtaacggaaaccgggtaaaccccgtaaggtaaccgttccggaccggaacggttcccgtaaccgaccggttaacgggttccgttttacggttccttacggtttacccgtacgtaaccctacgttcgtccgtactacgaacgtcgtacggtacttactacgttacgtacgtacgtacgtacgtacgttacgaccggtaaaccgttaaccggtaaccgggtacgtaaccgggtacggtaacccgtaaccgggttaccggttaccgtttaacgggtttaccgttttacccggttaggttaccgggtaacggtttaacggggtacgggtttagggaaacccgggtcggtaacgggtccgggttacgggtttaccgggtaccggggttacccggggttagggggggtaacccgggtttacgggtaccggtttaaacccggggttcggggtacccggggttacccggggttaaaccccgggg

SEQ ID NO: 255470 - DNA, 723 bp, Homo sapiens
  misc_feature: GYAE6OF02HUCS8.23.76.G10.1.454.CMB.1.raw
  modified_base (489)..(489): a, c, t, g, unknown or other
  misc_feature (489)..(489): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttgggtggcagcagcaacagggtcgcccactcccaggtgcaactggtgacaatccgtgggtctgagttagaagaagtccgtcggggcctcgaggtgtaacgggtttcctgacgaaggtcttcgtagggaactacctacctttcaacttacctagttgcctagtagtaaggttgggacgcgacgaccggccccgtagggacgtaagggtcttaggaggtcgagtagggtcgtaggactaccgaacaccgtaaacgacggtacgggaaacctaacggtactccggaccgtagggtaccttacgaacggtagggttaccggttttgtaccgtttccgttacgttccggaaacttacccgtnttccggtacagtacgtagtcggaactgtaactcgtagtacaagcttacgacgtacacgtaacgaaacggtcgtaaggacgaacgtacgtaccgtcgttagttacgttcgtaggttcgaacggtacgggtacgttacggaggtcggtacgaacggttcgtcgggtacgggtccgggaggggtccggggttaacgttaccggtaccggtacggtaccgggggtacgtaacccgggg

SEQ ID NO: 255471 - DNA, 905 bp, Homo sapiens
  misc_feature: GYAE6OF02JJ1XB.23.76.G10.1.454.CMB.1.raw
tcagacgcgagtatcacgaccggtgctcgatttagtcactcatacaggggacccaacaaccaccacccctcctaagaagaagcccctagaccacagctccacaccatggactggacctggagatcctcttcgttggtggcagcagcaacgaggtcgcccctacctcccaggtgccaaccgtgggtgacaatcgttgggtctgtagtttagaagacgccgtcgggcctagacgtaggtaacggtttcctgacgaacgttcgttcgtacggtactaccctaccttccacttaccgtatgctagtagtaaggttggtcgaccgacgacggcccgtaggaacgaggtgttcggaggtggagtaggtatagtactaccaaccgaccgtaacgaccgtaaccggaacctaacggtctccgaccggccggtaccgtacgtaacgtacgggttacgtttgttacccgttcgtacccgttgtaaccctccgtttcgtacgttcgacgtaccgttacgtcggtactagttacccgtagtacgtaacgtacgtacgaccgtaacgtaaccggttaaacccgtaaccgaaccgggttaccggtaaccggtaccgtttaaccctaccgggtaccggtttacccgtttttacggttaacccgtttttacggttaacccggggttaacgggttaaacgggtttacgggttaacccggggtttaaacgggaccgggttcccggggttaacgggtttaacccggggtaacccgggggttgggttttaaccccgggggggtaaacggggttacccgggggggggttaacggggtttaaccccggggtttaaaccggtttacccccggggggtaaccgggggtttttaaccccggggtaaacccccgggttaacccccgggggg

SEQ ID NO: 255472 - DNA, 669 bp, Homo sapiens
  misc_feature: GYAE6OF02GGTKV.23.76.G10.1.454.CMB.1.raw
  modified_base (188)..(188): a, c, t, g, unknown or other
  misc_feature (188)..(188): n is a, c, g, or t
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
  modified_base (302)..(302): a, c, t, g, unknown or other
  misc_feature (302)..(302): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (352)..(352): a, c, t, g, unknown or other
  misc_feature (352)..(352): n is a, c, g, or t
  modified_base (365)..(365): a, c, t, g, unknown or other
  misc_feature (365)..(365): n is a, c, g, or t
  modified_base (376)..(376): a, c, t, g, unknown or other
  misc_feature (376)..(376): n is a, c, g, or t
  modified_base (389)..(389): a, c, t, g, unknown or other
  misc_feature (389)..(389): n is a, c, g, or t
  modified_base (420)..(420): a, c, t, g, unknown or other
  misc_feature (420)..(420): n is a, c, g, or t
  modified_base (497)..(497): a, c, t, g, unknown or other
  misc_feature (497)..(497): n is a, c, g, or t
tcagacgcgagtatcacgaccggtgctcgatttagtcactcatacagggggacccaacaaccacacccctcctaagaagaagcccctagaccacagctcccacaccatggactggacctggaggatcctcttcttgggtggcagcacgcaacagggtcgcccaccttcccagggtgcaacgttgggtncaatcgtgggtctggtagttgaagacgccgttggggcctcaggttggaacggtttctggacaaggtcttcgtgactacnccttcacctacctntgctatagagttggagccgancgggccctaggacgaggtctaggngtggagtggntggatacacaacaacncgacgaaccagtntgaccgagctnacggtagcgtttncttactcgtacgcctcgtctcgtacgacgtntagttcgaaccgttagttacccggtatacgtacgtacgatcccgagtacgtacgacgtaaggtctaaacggcgtacncgtacgttacgttacgtttacgttacgcgggttacgtaccggtagggtacgtaccgggtagtaacgggtcgttaggggtacccggtacgggttagggacccgggggttggggttaaaccggggtggttacgggtaccggtacggggttaaccgggggtccgaacccgggggg

SEQ ID NO: 255473 - DNA, 763 bp, Homo sapiens
  misc_feature: GYAE6OF02G7A5Y.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatcgtgggtctgagttagaagaagccgtggggcctcgagtgaaggtttcctgacgaaggtcttcgtggatacctaccttcacctacctatcgtctatgtaagttgggtgccgacgacggtcccctggacgagggtcttggaggtggagtgggagtggactacaacaaccgaacgaccgtacgggaacccctaacggtacgtaccgaccggaacggtctaccgacggtaacgggttacggttttcgttcctttaccgttccgttacggacccttacccgttcgttacggttcgacgtacgtacgttcgggtaacttaacgttaccgttcgtacggacgtagtaacgtccgacgtaaccgaacgttaacccggtaaaggtcgtacgggaacggaacctcggttaaccgttccgggtttaacttttcggtttacgttacgggtacggtaaccggtagggtttaccgttaacgggagggtacggtaacggttcggggtcggtaccggtacgggttaccggggtaaggggtcggggtttaacgtcccgggtaacgggttacgggtcccggggtaacccggtaacccgggg

SEQ ID NO: 255474 - DNA, 823 bp, Homo sapiens
  misc_feature: GYAE6OF02FWBQM.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacaccttcactacctatgctatgaattgggtgcgacaggcccctggacaagggcttgagtggatgggatggatcaacaccaacgacgtacgggaacccctaaacggtatcgaccccgtaagggcctttaccgaacgtacgggtaccggtttttgtccttttaccgtcccgtttacgggaacctacccgttcgttacgttaccgtacggtccgtaacgttcgggtaccaacgtttaacgtccgttacgggtaccgtaaacggtactttacccggaaggtacccgtaaccggttacccggttaaaacgggtaccgggttaaccggtaacggggtaaccggtaacccgtttaacggggtcccgtttaaccgggtttacgtttttaccggttttcggggtacggttaaccgggtacgggttaacggggtttaccggttacgggggtaaggtaccgggttaacgggttacggggttccgggtttacccggggttaccggggttaaccggggggtacggggggttaacgggtttaacggttaccgggttaacccgggttaccgggggttacccgggtaaaccccggggg

SEQ ID NO: 255475 - DNA, 892 bp, Homo sapiens
  misc_feature: GYAE6OF02IZ3A9.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacaggtgcccaactcccaggtcgacaacgtggtgacaaacgtcgttaggggtctgtaggtttagaaaggaaacggtcccgtgggggcccttacgaggttcggtaaacgggttttcctggacgtaacggtctttcgtaggaacctaacctcctttactaacctaccgtatcgtctaacgttagtaacggtttgggcgaccggtaacgacccgggtacccccgttagggaacggtaaaccggggtgttttacgggaggttaggggacggtaggggtagttacggggaacttaccccgaaaccaaacccggtaaaccgacccggttaacggggaaaacccccgtaaacggttaacgggtacccgacccgggtaacgggtaaccccttacgaaaccggtaaccgggttacgggttttcgttacctttccgttacccgtacgggtaaccttacccctacggtttcgacgtacgacgtacgtccggtaaacttctacggttcctacgaacgttaacgtcgtaccgtaacgtacgtaaccgggttaaccgtaaagggttcgaaacgggtaaccgacggttaacccggacgtttaacccggttgttttacccgttacgtcgggttacggtacgggtaacgggttacggtaccggaggtacggtaccggtcggtaccgggttacgggtcccgggaacggggtacgggtcgtaggttaccgtacgggccgggtaaccggaccggttaaccccgggg

SEQ ID NO: 255476 - DNA, 989 bp, Homo sapiens
  misc_feature: GYAE6OF02HVHHO.23.76.G10.1.454.CMB.1.raw
tcagacgcgagtatcacgaccggtgctcgatttagtcactcatacaggggacccaacaaccacacccctcctaagaagaagccctagaccacagctccacaccatggactggacctggaggatcctcttcttggtggcagcacgcaacaggtcgcccaccgtcccgaggtcggaccaacgtgggtcgtactaacgttcgttcggggttaccgttggtaaggtttaggaaaaaggtaaacggacccggttacggggggtcccttaaccggtaaggttacgggttaaaacggggttttccgtacggtaaccggtaaacgggttcgtttaccggtacggggtaaacttaacccgttaccccgtttaaccttaaaccttaaaccggttacgtacggttaaccttaaacggttaggttaaaaccggttttcggggggtacggtaaccggtaaccgggtaccccgggtaacccccggtacgggggtaaaccggtaaccggggtttaccgtttggggaaggggttaccggtaagggttacgggggtaacgtacgggtaactaaaccgtaaaaccggaacccgtaaaccgtaacccggggtaaccgggtaaacccggtaaaccggttaccggtaacccggaccccgggttaacgggtaccttaccgggtaaaccggggttacgggttaccgggttttcggttacccgtttaccgtaccggtttaaccgtaacccgttaccttcgtacgtccggtaactacggtacgtacggacgtaactacttacgtaccgagttacaggtacaagaccgtaggtaacccgtaagcgtacgggtaaccgctaaccggtcgtaccgtttgttaagttaccgttggacgttaggacggttacggtagttaacggcggtaccgtaaggtccggttaccgggtacgggttaccgggtagggaggtttcccggttaaggtcgggtaaccgggtccgggaccccggttaacgg

SEQ ID NO: 255477 - DNA, 720 bp, Homo sapiens
  misc_feature: GYAE6OF02HWOAV.23.76.G10.1.454.CMB.1.raw
  modified_base (502)..(502): a, c, t, g, unknown or other
  misc_feature (502)..(502): n is a, c, g, or t
  modified_base (620)..(620): a, c, t, g, unknown or other
  misc_feature (620)..(620): n is a, c, g, or t
tcagacgcgagtatcacgaccggtgctcgatttagtcactcatacaggggacccaacaaccacacccctcctaagaagaagcccctagaccacagctccacaccatggactggacctggaggatccctcttcttggtggcagcagcaacaggtcgcccactcccaggtgaccaactggtgcaatctcgggtctgagttgaagagccgtggggcctcgagtcgtaaggttcctgcaggcttcgtagactaccacttccactacctatcgctacgtagtaagttgggtcggtcacgaccgtcccgtacggacgaagggtcgttcggaggtaggtaggtagggtacgtaggtactaccgtaacaacccgtaacgaacgtacccgggaaccctaaaccggtcgtaccgaccggtacggtctacgacggtacgggttacgtttcggttcttcgttaccgttcgtacctaccttcgtactcgtaactcgtaggtacgcgtacgttacncgtacgactaacgtacgacttaccgaacgaaccgtaccgtaaagggtccgagtaccgacgtaccgtacgtcgttagtttcgttacggtcgtacgtacggtacgtcggtacggtacggnttaacggacgggttggttaacgggtccggggtaagggacggggttcgggttaggttaccggtacccgggttacggggttaccggccgggttaaacccggg

SEQ ID NO: 255478 - DNA, 996 bp, Homo sapiens
  misc_feature: GYAE6OF02FXGLL.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggagactcctcttcttgggtggcagcagacaacgaggtcgcccaacctcccgaggtgaccgaaccgtggtcgcaatccgtgggtctggtagttgaagacgtccgtgggcctcgagtgtacggttcctgacgacgtcttcgaggtactacctaccgttaccaaccttaccgttactcgtacttacgtagtacggtttcggtacggacgtaccggaccgggtcccccgtacgggaaccggtaacgggtcgtttacgggacgggttaggggtaaccgggttggggacgttggtaaaccgtaccgaaaacccggtaacccgtaaaccggtacggtaaacccgggaaaccccgttacgttaacgtaccgacccggggtacgtacccgttacgaacgggttccggttaacgttttcggttaccctttcggttacccgtacggtacccgttaacccgtttcgtaccggtaaccctagggtacgttaaccggtacgtacgttaaccgttacgttaccggtaccgtaccgtaagtaacccgttaccggtaaccggtaacccgtaaccggttaaacccgggttaaccggtaacccggttaccggggtaaaaccgtcccggtttaacccgggttacgtttacggttttacccgggttttaaccggttttaccggttaccgggttacggttaacccgggttaccgggttaaccgggttacggggtaacggttccgggtaaaccgggtttcggggtccgttaaccccgggggtttacggacccggggggtttaccggggggtttaccggggttaaccggtttaccccgggggaacccggggttttaaacccggggttcccccgggggtaaccccgggtttaacccccggggg

SEQ ID NO: 255479 - DNA, 1197 bp, Homo sapiens
  misc_feature: GYAE6OF02GMS0J.23.76.G10.1.454.CMB.1.raw
tcagacgcgagtatcacgaccggtgctcgatttagtcactcatacaggggacccaacaaccacacccctcctaagaagaagcccctagaccacagctccacaccatggactggacctggaggatcctctctggtgcagcagcaacaggtgcccactccaggtgccaacgtggtcgcaactctgggtcctgacgttgaacggaagtccgtggggcctacgagtacggtaaccggtttcccgtagcctaaacggggtcctttaccggtacgggtaacctaccgtaacccctttaccgtaacccgttaaccttaacgttcgggtacccttaacgttaggttaaacggtttcgggggtaccgaaccgggtaacccgtacccgggggtaccccccggttacggggtaaaccccggtaaacggggggtttcctttaacgggggtaccgggttaccgggggttaaaccggtttacggggggtaaacggtttaccggggtaaaacctttaacccccggtaaaaaccccggaaaacccccgttaaaacccggtaaacccggggtttaaacccccggggaaaaaccccccgttaaacggggttaaacccggtaccgggtaccccccgggttaaccggggttaccccgttttaacccgggaaaccggggtacccgggggttttaacgggttttttaccgttaaccccggtttttcccgttaaaccccggtttaacccggggtaaacccctttaaccccggttcgttaacccgggtttccgaaaaccgtacccggttttaaaccgggcccggggtaactaaaccgtttaacggtttcccgtacggtaacccgtaacggtaccgttaacccggaaaggttaaccccgtaaacccggggtaaccttaaaccggggttaacccggttaccgggtaaccggaaaccccgtttaccggggtaacccgttacccgggttttaaccgtttaaccggtttacggtttaaccggggaccggtaaacccgggtttaggttaacccgggggtttacgaacgggggttaacccggttcggtaaaccgggggtttcggaacccgggtttccgggggtaacccggggttaaacggggggttacggggggtttaacctttaccccgggggtacgtttaaaccccggggggttacgggggtacccgggttaaaacccccgggggg

SEQ ID NO: 255480 - DNA, 918 bp, Homo sapiens
  misc_feature: GYAE6OF02IP511.23.76.G10.1.454.CMB.1.raw
  modified_base (236)..(236): a, c, t, g, unknown or other
  misc_feature (236)..(236): n is a, c, g, or t
tcagacgcgagtatcacgaccggtgctcgatttagtcactcatacaggggacccaacaaccacacccctcctaagaagaagcccctagaccacagctccacaccatggactggacctggaggatcctcttcttggtggcagcagcaacgaggtgcccacctcccgaggtgacaacgtggtgacatcgtgggtctgagttgaagagccgtcgggcctcgaggtgtaacggttttccngcgaggtcttcgtggtactacctaccttcactacctatgactagtgtagttggtcgacgacgaccggtcccgtaggacgtaacgggtcgttaggagggtaggtaggtagggagtagggtactaaccgaacctaaccgaaaccgtaaccggtaaccgggaaaccccgtaacggtacgtaccggacccggtacggttaccgttaaccgacggtaacggggttaccggtttttaccgtttccgttttcccggttaccgtttaccggtaaccccgttacccgttcggtttacggtaccgtacggtaccgtaaggttccggaacgttaacgtttgttacggttacggaccgttaacggtacgtaccggtacgtaacccggtaaccggttaaacccggtaagggttccgtaaacggggacgtttaaccccgtacggtttacccgggtttaaccggttacgttttttacccgtttcgggtttacggggaccgggttaaacggttaacgggggtttaacgttacgggggtaacggttaccggtacggggttacggggttaccggggttaccgggttaccggggggttaccgggggaaacgggggggtttacggggtttaaccggtttaaccggggaacccggggttttaacgggggttcccccgggggaaaccggggtttaaccccgggg

SEQ ID NO: 255481 - DNA, 512 bp, Homo sapiens
  misc_feature: GYAE6OF01BYNTG.12.86.H09.1.454.CMB.1.raw
  modified_base (202)..(202): a, c, t, g, unknown or other
  misc_feature (202)..(202): n is a, c, g, or t
  modified_base (506)..(506): a, c, t, g, unknown or other
  misc_feature (506)..(506): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaangccaccttctcctgcagggccagtcagagtcttagcacctacttagcctggtaccaacagaaacctggccaggctcccaggctcctcatctatgatgcatccaaaagggccactggcatcccagccaggttcagtggcagtggtctggggcagacttcactctcaccatcagcagactggagcctgaagtatttgctagtgtattattgtcagtcagtatggtagcgctaccgtactacgtttggccgtaggggtccagcgtggagagtagaaacgacgtgtggctgcacctatctgtcttctnttcccg

SEQ ID NO: 255482 - DNA, 529 bp, Homo sapiens
  misc_feature: GYAE6OF01BF0MM.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaangccaccttctcctgcagggccagtcagagtcttagcacctacttagcctggtaccaacagaaacctggccaggctcccaggctcctcatctatgatgcatccaaaagggccactggcatcccagccaggttcagtggcagtggtctggggcagacttcactctcaccatcagcagcctagacgcctagaagtatttgctagtttattactgtcagcagcgtagcaacgtggccttcggttctacgttttgggccgtaggggacctaaggctaggacgtagtacgaaacgtactggtaggctgaccactatctgtcttctagttcccg

SEQ ID NO: 255483 - DNA, 515 bp, Homo sapiens
  misc_feature: GYAE6OF01AKL36.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaacagaaacctggccaggctcccaggctcctcatctatgatgcatccaaaaggccactggcatcccagccaggttcagtggcagtggtctggggcagacttcactctcaccatcagcagcctagagcctgaagtattttgctagtttattactgtcagcagcgtagcaactggcctcggttcacgttttggccgtaggggaccaaggctggagatacgaaacgactggtggctgcacctatctgtcttcgattcccg

SEQ ID NO: 255484 - DNA, 518 bp, Homo sapiens
  misc_feature: GYAE6OF01B2AFG.12.86.H09.1.454.CMB.1.raw
  modified_base (202)..(202): a, c, t, g, unknown or other
  misc_feature (202)..(202): n is a, c, g, or t
  modified_base (484)..(484): a, c, t, g, unknown or other
  misc_feature (484)..(484): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaacagaaacctggccaggctcccaggctcctcatctatgatgcatccaaaaggccactggcatcccagccaggttcagtggcagtgggtctggggcagacttcgactctcaccatcagcagcctagagcctgaagattttgctagtttattactgtcagcagcgtagcaactggcctcggttcacttttggccagggtaccaagcgtggagatacaaacgactagnggctgtacaccgtaatctagttccttgcttcccg

SEQ ID NO: 255485 - DNA, 535 bp, Homo sapiens
  misc_feature: GYAE6OF01C0UWS.12.86.H09.1.454.CMB.1.raw
  modified_base (201)..(201): a, c, t, g, unknown or other
  misc_feature (201)..(201): n is a, c, g, or t
  modified_base (284)..(284): a, c, t, g, unknown or other
  misc_feature (284)..(284): n is a, c, g, or t
  modified_base (529)..(529): a, c, t, g, unknown or other
  misc_feature (529)..(529): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgctccaggggaaangccaccttctcctgcagggccagtcagagtcttagcacctacttagcctggtaccacagaaacctggccaggctccagctccncatctatgatgcataccaaaaggccactggcatcccagccaggttcagtggcaggtggtcgtggggcagacttcactctcaccatcagcagcctagacgcctagaagtattttgcgtagttttaattacttgtcagcagcgtagcaacgtcggtccgttcggttctacgttttggccgtacggggaccaggtcgtaggacgatacgaaacgtacgtggtaggctgcctactactctagtcttctnttcccg

SEQ ID NO: 255486 - DNA, 518 bp, Homo sapiens
  misc_feature: GYAE6OF01AX7NN.12.86.H09.1.454.CMB.1.raw
  modified_base (202)..(202): a, c, t, g, unknown or other
  misc_feature (202)..(202): n is a, c, g, or t
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
  modified_base (512)..(512): a, c, t, g, unknown or other
  misc_feature (512)..(512): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaacagaaacctggccaggctcccaggctcctcatctatgatgcatccaaaagggccactggcatcccagccaggttcagtgcagtggtctggggcagacttcactctcaccatcagcagcctagagcctgaagtattttgctagtttattactgtcagcagcgtagcaactggccttcggttctacgttttcggccgtaggggaccagcgtaggagatacgaaacgacgtgtacggtctgcacntctntcttcnttcccg

SEQ ID NO: 255487 - DNA, 506 bp, Homo sapiens
  misc_feature: GYAE6OF01D8DUD.12.86.H09.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaangccaccttctcctgcagggccagtcagagtcttagcacctacttagcctggtaccaanagaaacctggccaggctcccaggctcctcatctatgatgcatccaaaagggccactggcatcccagccaggttcagtggcagtggtctggggcagacttcactctcaccatcagcagcctagagcctgaagtattttgctagtttattactgtcagcagcgtagcactggcctcggttcacgttttggcctaggggaccagctggagatcaaacgactgtggctcgcacctatactgtcttcatcc

SEQ ID NO: 255488 - DNA, 595 bp, Homo sapiens
  misc_feature: GYAE6OF01DUGUL.12.86.H09.1.454.CMB.1.raw
  modified_base (315)..(315): a, c, t, g, unknown or other
  misc_feature (315)..(315): n is a, c, g, or t
  modified_base (392)..(392): a, c, t, g, unknown or other
  misc_feature (392)..(392): n is a, c, g, or t
  modified_base (410)..(410): a, c, t, g, unknown or other
  misc_feature (410)..(410): n is a, c, g, or t
tcagatacgacgtacacgaccggtgctcgatttagtgctatagacttgggtttggggaggaactgctcagttaggacccagagggaaccatggaagccccagctcagtccttctccttcctcctgctactctggcctcccaggtgccaccggagaattctggttgacacagtctccagccctacccttgttcttttgtcctccgaagggggaaagcgccctaccttctccgtgcgagggccagtcagagtcttagctacctacttagcctggtaaccaagaacgaaacctggaccaaggcctcccgaggtctccncatctatgatgcactaccgaaaagggccaacgtcggactactcccgagccctagggttcaggtcgcgaggtggtcgnggggcagtactcgactcncacatcagcagcctagacgctagtaagttatttgacttagtttactagtgtcagcgtagcgtagactacgtggtcctacggttctacgtttcggacgtagggaccaggtcgtaggagactaacgaacgtagtggtacgtcctacggctaaccgtagttccgttattcccgttactacgttccccg

SEQ ID NO: 255489 - DNA, 515 bp, Homo sapiens
  misc_feature: GYAE6OF01DSCHP.12.86.H09.1.454.CMB.1.raw
  modified_base (203)..(203): a, c, t, g, unknown or other
  misc_feature (203)..(203): n is a, c, g, or t
  modified_base (430)..(430): a, c, t, g, unknown or other
  misc_feature (430)..(430): n is a, c, g, or t
  modified_base (509)..(509): a, c, t, g, unknown or other
  misc_feature (509)..(509): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaaattctgttgacacagtctccagccaccctgtctttgtctccaggggaaanagccaccttctcctgcagggccagtcagagtcttagcacctacttagcctggtaccaacagaaaacctggccaggctcccaggctcctcatctatgatgcatccaaaagggccactggcatcccagccaggttcagtggcaggtgggctgggggcagacttcactctcaccatcagcagcctagagcctagaagtattttgcaagtttattactgtcagcagcgtancaactggcctcggttcacgtttgggccaggggaccaagctggagatcaaacgaactgtggctgcaccgatactgtcttnatcccg

SEQ ID NO: 255490 - DNA, 517 bp, Homo sapiens
  misc_feature: GYAE6OF01BD81N.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaangccaccttctcctgcagggccagtcagagtcttagcacctacttagcctggtaccaacagaaacctggccaggctcccaggctcctcatctatgatgcatccaaaagggccactggcatcccagccaggttcagtgcagtggtctggggcagacttcactctcaccatcagcagcctagagcctgaagtattttgctagtttattactgtcagcagcgtagcaacgtggcctcggttcacgttttggcctaggggaccaagcgtaggacgatacgaaacgactgtaggctcgacaccgatctgtcttcattcccg

SEQ ID NO: 255491 - DNA, 509 bp, Homo sapiens
  misc_feature: GYAE6OF01DU75X.12.86.H09.1.454.CMB.1.raw
  modified_base (503)..(503): a, c, t, g, unknown or other
  misc_feature (503)..(503): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtggtctggggcagacttcactctcaccatcagcagcctagagcctgaagattttgctagtttattactgtcagcagcgtagcaactggcctcggttctacttttggcctaggggaccagcgtggagatacaaacgaactgtggctgcacatctgtcttcnttcccg

SEQ ID NO: 255492 - DNA, 530 bp, Homo sapiens
  misc_feature: GYAE6OF01BYYZI.12.86.H09.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaangccaccttctcctgcagggccagtcagagtcttagcacctacttagcctggtaccaanagaaacctggccaggctcccaggctcctcatctatgatgcatccaaaagggccactggcatcccagccaggttcagtggcagtggtctggggcagacttcactctcaccatcagcagcctagacgcctgaagtatttgtctagtttattacttgtcagcagcgtagcacgtcggccgttcggttctacgttttcggccgtaggggaccaggcgtaggacgatacgaaacgtacgtgtcggtctgccaccgtatctgttcttctcttcccg

SEQ ID NO: 255493 - DNA, 576 bp, Homo sapiens
  misc_feature: GYAE6OF01B08QN.12.86.H09.1.454.CMB.1.raw
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctcgaggggaaangccaccttctcctgcagggccagtcagagtcttagcacctattagcctggtaccaanagaaacctggccaggctcccaggctcctcatctatgatgcatccaaaagggccactggcatcccagccaggttcagtggcaggtggtcgtggggcagacttcactctcaccatcaagcagcctagagtccgtagaaggtattttgacttaaggtttaacttacgtgttacgagccgagtcgttacggactaacgtcggccctttcggttcctaacgttttcgggaccgtaacggggaccctaaggcgtaggagacgttacgaaaccggtaacttggacggtcttcgacctaccgtacttctgttcttcgctttcccg

SEQ ID NO: 255494 - DNA, 541 bp, Homo sapiens
  misc_feature: GYAE6OF01A217S.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccaggcaccctgtctttatctccaggggaaanagccaccctctcctgcagggccagtgagaatgttaacaacaggtatctggcctggtaccagcagaaacctggccaggcctcccaggctcctcatgtacgttacttccagcagggccatggcatcccagacaggttcactggcaggtggtctgggacagacttcactctcaccatcaccagactggacgcctagaagtattttgactagtgtatttattgtctagctagtagtggtagcgcaccgtactacgttttggccgtaggggttccaaggtctaggagtagtagaaacgtacgtggtgctcgacacgtatcgttagtcttctagttcctaccccg

SEQ ID NO: 255495 - DNA, 522 bp, Homo sapiens
  misc_feature: GYAE6OF01C63D7.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtgcagtggtctggggcagactttcactctcaccatcagcagcctagagcctagaagattttgctagtttattacttgtcagcagcgtagcaactggccttcggttctacttttggccgacggggaccagtcctaggagagtacaaacgaactggtggcgtgcactatctgttcttcgtattcccg

SEQ ID NO: 255496 - DNA, 530 bp, Homo sapiens
  misc_feature: GYAE6OF01D4F76.12.86.H09.1.454.CMB.1.raw
  modified_base (202)..(202): a, c, t, g, unknown or other
  misc_feature (202)..(202): n is a, c, g, or t
  modified_base (525)..(525): a, c, t, g, unknown or other
  misc_feature (525)..(525): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaangccaccttctcctgcagggccagtcagagtcttagcacctacttagcctggtaccaacagaaacctggccaggctcccaggctcctcatctatgatgcatccaaaagggccactggcatcccagccaggttcagtggcagtggtctggggcagactcactctcaccatcagcagcctagacgcctagaagtattttgactagtttattactgttcagtcagcgtagctaacgtcgtccgtcggttctacgttttcggcccgtaggggaccctaggccgtggagatacgaaacgtaacttgcggtctgcaccatctatcttctntcccg

SEQ ID NO: 255497 - DNA, 604 bp, Homo sapiens
  misc_feature: GYAE6OF01A6J4H.12.86.H09.1.454.CMB.1.raw
  modified_base (363)..(363): a, c, t, g, unknown or other
  misc_feature (363)..(363): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccgaggggaaagagccaccctctcctgcagggccagtcagagtgttaatagcgacttagcctggtaccagcagatacctggccaggctcccaggctcctcatctatggtgcatctaccgagggccactggtactcccagccaggttcaggtggcaggtgggtctgggacagngttcactctcaccatcagcacgcctgcagtctagaagtattttgacttagttttattacgttgtcgtagtctaagttaataagttaacgttcggtttacctcgtccttaccgttacggttttccggggaccggggggtaccgtaaggggtgggtaacgtaacgtaaccgaaaacggtaccgttaggtacgggtccgttacggaccgtaccgtacgttcttagttcctttctcgtttccccg

SEQ ID NO: 255498 - DNA, 704 bp, Homo sapiens
  misc_feature: GYAE6OF01CTYGL.12.86.H09.1.454.CMB.1.raw
  modified_base (208)..(208): a, c, t, g, unknown or other
  misc_feature (208)..(208): n is a, c, g, or t
  modified_base (267)..(267): a, c, t, g, unknown or other
  misc_feature (267)..(267): n is a, c, g, or t
  modified_base (285)..(285): a, c, t, g, unknown or other
  misc_feature (285)..(285): n is a, c, g, or t
  modified_base (373)..(373): a, c, t, g, unknown or other
  misc_feature (373)..(373): n is a, c, g, or t
  modified_base (442)..(442): a, c, t, g, unknown or other
  misc_feature (442)..(442): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagtaaattctgttgacacagtctccagccctaccctgtctttgtctccgaaggggaaagngccacctttctcctgcagggccagtcagtagtcttagcacctattagcctggtaccaanagaaacctggccaggtcnccaggctcctctatctatgatgacactaccgaaaacgggccaacgtggacactcccagcctaggttcaggtcggctaggtcgggtcgnggggacaggtactttacgactctaccaccatccgaagccaggtacctagacgtaccgtaggtaaacgtntttttacggactttaaggttttactttacgtacgtccgtaaggtacgtaacggcgtttaacgaccgttaaccggttcgggtaccccgtttccgggtttacctttacgggttttaccgggacccggtaagggggtaaccctagggaccgtttaagggaaccgaacgttaaaccggtaaaaccggtacgttacgggtacggtaccgttacgggacccttaactaccggtttcttacggttacccttaccgttcgtttacccccg

SEQ ID NO: 255499 - DNA, 599 bp, Homo sapiens
  misc_feature: GYAE6OF01AGIBR.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaangccaccttctcctgcagggccagtcagagtcttagcacctacttagcctggtaccaacagaaacctggccaggcctcccaggctcctcatctatgatgcataccaaaaggccactggcactcccagccaggttcagtggcaggtgggtctggggcagactcactctacaccatcagcagcctagacgcatagaagtattttgacttagttttattacttgttacagtcgacgcgtagaccaacgttcggtaccttccggttccttacgttttcgggacccgtaacggggtacccaagggtccgtagggtacgtaacgtaaccgaaaaccggtaacgttcgggtacggccgttaccggacctaacccgtacgttaccgttcgttccgttcctaacccg

SEQ ID NO: 255500 - DNA, 652 bp, Homo sapiens
  misc_feature: GYAE6OF01DM7RG.12.86.H09.1.454.CMB.1.raw
  modified_base (175)..(175): a, c, t, g, unknown or other
  misc_feature (175)..(175): n is a, c, g, or t
  modified_base (229)..(229): a, c, t, g, unknown or other
  misc_feature (229)..(229): n is a, c, g, or t
tcagatacgacgtacacgaccggtgctcgattttagtgctatagacgttaggggtttggggaggaactgctcagttacggacccaggagggaaccatcggaaggccccagctcagcgttcctcgttccgtcctggctacgtctgggcctccgaggtcgccaccggagaaattcgngttgacacagtctccaggccacctgtacttgcctcgagggaagcgccacgttcnccgtgccgacgggccaggtcacgagtctagcacctacgttacgcctaggtaccaacgacgaaaccgtcggaccaaggcctaccgaggcctacctacaactcgtactggtagttggacaacgtaccgaaaacgggccaacgtcggacactcccgacgaccgaggttcaggtcggacgtacggttgggtcgtggggcacggtactttcgactcgtaccactagtccacgcgacgtcctagacgccgtacgtaacgtacgtttcgacttacgtttacgttacgtagtacgacgcgacgtcgtacgactacgtcggtccgtacggttcgtacgtttcggacgtacgggacagtcgtaggacgacgtacgaaacggtacgtaggtacggcgtaccgacgaaccgtacttactgttctcgtcgttcccg

SEQ ID NO: 255501 - DNA, 572 bp, Homo sapiens
  misc_feature: GYAE6OF01BF6O2.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaacagaaacctggccaggctcccaggctcctcatctatgatgcagtaccgaaagggccacgtggacatcccagccaggttcaggtggcaggtggtcgtggggcagacttcactctcaccatcagcagcctagacgcctagaagtattttgacttaagtttattacgtgttacgagtcgagtcgtacgacaacgtcggtccgttcggttctacgttttcggaccgtacggggaccgagcgtaggacgtacgtaacgaaacgacgttaggtacggtcgtacgaccaccgtactcgttacgttcttcgtcgttcccg

SEQ ID NO: 255502 - DNA, 538 bp, Homo sapiens
  misc_feature: GYAE6OF01A7PT9.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaacagaaacctggccaggctcccaggctcctcatctatgatgcatccaaaagggccactggcatcccagccaggttcagtggcagtggtctggggcagacttcactctcaccatcagcagcctagacgcctagaagtattttgctagtttattactgtcagcagcgtagcaacgtcgccttcggttctacgttttcggccgtaggggaccaaggtcgtaggagagtacgaaaacgtacgtggtacggctggccaccgtactctagttccttctcttcccg

SEQ ID NO: 255503 - DNA, 548 bp, Homo sapiens
  misc_feature: GYAE6OF01AHMD8.12.86.H09.1.454.CMB.1.raw
  modified_base (203)..(203): a, c, t, g, unknown or other
  misc_feature (203)..(203): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagngccaccttctcctgcagggccagtcagagtcttagcacctacttagcctggtaccaacagaaacctggccaggctcccaggctcctcatctatgatgcatccaaaaggccactggcactcccagccaggttcagtggcaggtggtctggggcagacttcactctcaccatcagcagcctagcgcctgaagtattttgacttagtttatttactgtcagcagtcgtagcaacgtcggcctcggttctacgttttcggaccgtacggggaccaggtcgtaggagtaacgtaccgaaaacgtacgtgggtacggtctcgaccacgtactcgtcttcttcgtcttcccg

SEQ ID NO: 255504 - DNA, 562 bp, Homo sapiens
  misc_feature: GYAE6OF01CZ50R.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagcccaccttctcctgcagggccagtcagagtcttagcacctacttagcctggtaccaacagaaacctggccaggcctcccaggcctcctcatctatgatgcataccgaaaagggccacgtggcactcccagccaggttcagtggcaggtgggtcgtggggcagtcttcgactctcaccatcagcagcctagacgccgtagtaagtagtttgtacgttagttttattactgtcagcgagtcgtagactaacgtcggtccgttcggttcgtacgtttacggccgtacgggactagtcgtaggagacgtacgaaacgtacgtggtacggctcgacaccgtattcttgttcttctcgttcccg

SEQ ID NO: 255505 - DNA, 603 bp, Homo sapiens
  misc_feature: GYAE6OF01CN31V.12.86.H09.1.454.CMB.1.raw
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
  modified_base (394)..(394): a, c, t, g, unknown or other
  misc_feature (394)..(394): n is a, c, g, or t
  modified_base (420)..(420): a, c, t, g, unknown or other
  misc_feature (420)..(420): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccgaggggaaangccaccctctcctgcagggccagtcagagtgttaatagcgacttagcctggtaccagcagatacctggccaggcctcccgaggcctcctcatctatgggtcncatcctaaccgagggcccacgttggtactcccagcctaggttcaggtggcaggtcgggtctggggacaggtacgttcacttctcaaccntcagcagcctgcagtctagtaagttntttgacttagtttatacgtgtacagtactagtaataacgttaacgttgttaccttgtccttacgtaccggttttacgggggaccgggggtaacctaaggggtcggaagtacgttaacgaaaacggtacgttggtacggtcttcggacctaaccgtagtccgttagttccttcgtacgttcccg

SEQ ID NO: 255506 - DNA, 684 bp, Homo sapiens
  misc_feature: GYAE6OF01EULZX.12.86.H09.1.454.CMB.1.raw
  modified_base (203)..(203): a, c, t, g, unknown or other
  misc_feature (203)..(203): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccgaggggaaangccaccttctcctgcagggccagtcagagtcttagcaccttacttagcctggtaccaacagaaacctggaccaggcctcccgaggcctcctcatctatgatgcataccgaaaagggccactcggcactcccagcaggttcagtggcaggtggtcgtgggcagctcactctcaccatcagcgtagacctagacgtccgttagtaagttacgtttttgacgtttaagtttttaactttaaccgttcgttacctaaggtcctaacggtcggttaacggaccttaaaccggttcgggtcccgtttacgggtttaccgtttacggtttttcgggacccggtaacgggggtaaccctaaggtccggtagggtaaacgtaacgtaaacccgtaaaacgggtaacgttagggttacgggaccttacgggaaccctaccccggttacgtttacccttacggttttccctttaccgtaaccgtttcccccc

SEQ ID NO: 255507 - DNA, 552 bp, Homo sapiens
  misc_feature: GYAE6OF01DDAVU.12.86.H09.1.454.CMB.1.raw
  modified_base (203)..(203): a, c, t, g, unknown or other
  misc_feature (203)..(203): n is a, c, g, or t
tcagatacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaangccaccttctcctgcagggccagtcagagtcttagcacctacttagcctggtaccaacagaaacctggccaggcctcccaggctcctcatctatgatgcataccgaaagggccacgtggcatcccagccaggttcaggtggcgaggtggtcgtggggcaggtacttcactctcaccatcagcacgcctagacgcctagtaagtatttgacttagttttattacgtgtcagtcagtcgtagactacgtcggtccttcggttctacgtttcggccgtacgggacagcgtggagactacgaacgacgtggtacggtcgtcgacaccgtactacgttgttcttcgtcttcccg

SEQ ID NO: 255508 - DNA, 528 bp, Homo sapiens
  misc_feature: GYAE6OF01CJKLF.12.86.H09.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttcncctgcagggccagtcagagtcttagcacctacttagcctggtaccaacagaaacctggccaggctcccaggctcctcatctatgatgcatccaaagggccactggcatcccagccaggttcagtggcaggtggtctggggcagacttcactctcaccatcagcagcctagacgcctagaagtatttgactagtttattactgtcagcaggcgtagctaacgtcggtcctcggttctacgttttcggaccgtacgggaccagcgtggagacgtacaaacgtacgtggtggtcgtgcactatctgtctctcttcccg

SEQ ID NO: 255509 - DNA, 565 bp, Homo sapiens
  misc_feature: GYAE6OF01BH7GD.12.86.H09.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
  modified_base (372)..(372): a, c, t, g, unknown or other
  misc_feature (372)..(372): n is a, c, g, or t
  modified_base (421)..(421): a, c, t, g, unknown or other
  misc_feature (421)..(421): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctattagcctggtaccaanagaaacctggccaggctcccaggctcctcatctatgatgcataccaaaagggccactggcatcccagccaggttcaaggtgcaggtgggtctggggctagacttcgacttcncacatcagcagcctagacgcctagaagtatttgctagtgtattattgtnagctagtataggtagacgctaccgtactacgtttcggaccgtacgggtacctagcggtaggacgtaagtaacggaaaacgtacgttaggtacggtaccgtcgacctaaccgtacgttaccgtgttaccttcgtacgttaccccg

SEQ ID NO: 255510 - DNA, 618 bp, Homo sapiens
  misc_feature: GYAE6OF01DLS7P.12.86.H09.1.454.CMB.1.raw
  modified_base (231)..(231): a, c, t, g, unknown or other
  misc_feature (231)..(231): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagngtcttagcacctacttagcctggtaccaacagaaactggccaggcctccaggctcctcatctatgatgcataccgaaaacggggccaactcgggaccactccccagcccgaagggtttccaagtggaccaggttcgggtccgtgggggacaggtacctttacgaccttctaccaacccagttacacggacacggccgtaaggacgccgttagtaaggttagttttgtacgttagtttaactttacgttgttcagacgtacgacgttacgactaacgttcggccttcggtttactacgttttcggaccggtacgggacctaggacgtaggagtataccgaaacgtacgtggtggcgtcgcacctattacgtagttcttctcttccccg

SEQ ID NO: 255511 - DNA, 540 bp, Homo sapiens
  misc_feature: GYAE6OF01D00TI.12.86.H09.1.454.CMB.1.raw
  modified_base (202)..(202): a, c, t, g, unknown or other
  misc_feature (202)..(202): n is a, c, g, or t
  modified_base (261)..(261): a, c, t, g, unknown or other
  misc_feature (261)..(261): n is a, c, g, or t
  modified_base (502)..(502): a, c, t, g, unknown or other
  misc_feature (502)..(502): n is a, c, g, or t
  modified_base (533)..(533): a, c, t, g, unknown or other
  misc_feature (533)..(533): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaanagaaacctggccaggcctccaggctcctcatctatgatgcataccaaaagggccacgtggacatcccagccaggttcaggtggcaggtggtcgtggggcagacttcactctcaccatcagcacgcctagacgtcctagatatttgactaacttatactgtacaactagtttatactttacctgttatttcgccgtggaccagtagtagtatactacgaaacgtactgtgctcgacaccctnttctcgttcttactacttccgttccccgctntcgtacg

SEQ ID NO: 255512 - DNA, 570 bp, Homo sapiens
  misc_feature: GYAE6OF01C45CQ.12.86.H09.1.454.CMB.1.raw
  modified_base (202)..(202): a, c, t, g, unknown or other
  misc_feature (202)..(202): n is a, c, g, or t
  modified_base (261)..(261): a, c, t, g, unknown or other
  misc_feature (261)..(261): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaanagaaacctggccaggctcccaggctcctcatctatgatgcataccaaagggccactggcatcccagccagttcagtggcagtggtctggggcaggtacttcgactctacgaccatcagcagcctagagtcctagaagtatttgtactagtttattacgttgtacagacagcgtagcgaacgtcggtccttcggttctacgttttcggaccgtacgggtaccgagtcgtaggtacgacgtacgaaacggtaacgttaggtacggtccgtcgacctaccgtacttccgtacgttccttcgtcgttaccccg

SEQ ID NO: 255513 - DNA, 584 bp, Homo sapiens
  misc_feature: GYAE6OF01EX7B2.12.86.H09.1.454.CMB.1.raw
  modified_base (203)..(203): a, c, t, g, unknown or other
  misc_feature (203)..(203): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagcccaccctgtctttgtctccaggggaaangccaccttctcctgcagggccagtcagagtcttagcacctacttagcctggtaccaacagaacctggccaggctcccaggctcctcatctatgatgcataccgaaaagggccacgtcggcactcccagcccgtaggttcaggtggcgtaggtgggtcgtggggcagtacttcactctcaccatcagcacgcctagacgcctagtaagttatttgtacgttagtttattacgtgtacagtcgagcgtagctacgtcgtccgtcgttctaccgtttcggaccggtacggggacctacggtcgtagggacgtaacgtaacgtaaacggtaacgttaggtacggtcgtacgccaaccgtactcttacgttccttcgtcttccccg

SEQ ID NO: 255514 - DNA, 640 bp, Homo sapiens
  misc_feature: GYAE6OF01DVFSE.12.86.H09.1.454.CMB.1.raw
  modified_base (200)..(200): a, c, t, g, unknown or other
  misc_feature (200)..(200): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccacctgtctttgtctccaggggaangccaccttctcctgcagggccagtcagagtcttagctacctattagcctggtaaccaacagaaacctggccaggcctccaggctcctcatctatgatgcactaccgaaaaggccacgtggacactcccagaccgaggttccaaggtggactaggtcggtcgtggggacacggacttcgactcacaccgatcacgcacgtacctagacgcctagtaagttatttagacgttagtttacttacgtgttacacggtacacggtacgtaacgactaacgttcggtcccgttaccggtttactaccggttttcgggacccgtaacgggggtaaccctaaggtccgtaggacgtaaccgtaaccgtaaaacggtacgttagggtacggtcgtacggtaccctaccgtaacgttcccgttagttcccttaccgtacgtttacccccg

SEQ ID NO: 255515 - DNA, 599 bp, Homo sapiens
  misc_feature: GYAE6OF01ERYT4.12.86.H09.1.454.CMB.1.raw
  modified_base (204)..(204): a, c, t, g, unknown or other
  misc_feature (204)..(204): n is a, c, g, or t
  modified_base (299)..(299): a, c, t, g, unknown or other
  misc_feature (299)..(299): n is a, c, g, or t
  modified_base (546)..(546): a, c, t, g, unknown or other
  misc_feature (546)..(546): n is a, c, g, or t
  modified_base (556)..(556): a, c, t, g, unknown or other
  misc_feature (556)..(556): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagcccaccctgtctttgtctccgaggggaaancgccaccttctcctgcagggccagtcagagtcttagcaccttactagcctggtaccaacagaacctggccaggcctcccaggctcctcactctangatgcataccaaaagggccactggccactcccagccgaggttcagtggcgagtgggtcgtggggcaggtactcgctcgtcaccgatccagcagtaccgtagacgtccgtagtaagtagttttagacgttaagttttactaaccgttgtacacgcgtagcgtagacctagtcggtcccttcggttacgtacgtttcggaccgtacggggaccaacggtcgtaggacgtacgtaaccgaaacgttaccngggtcgtcgnggtacctaccgtacttctacggtttccttcgtactttccccgg

SEQ ID NO: 255516 - DNA, 607 bp, Homo sapiens
  misc_feature: GYAE6OF01DLCPA.12.86.H09.1.454.CMB.1.raw
  modified_base (349)..(349): a, c, t, g, unknown or other
  misc_feature (349)..(349): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcactaccgaaaagggccaacgtggacactcccagccaggttcagtcggngaggtggtcgtgggggcaggtacttacgactctcaccgactcagcacgcctagacgtcctagaagttatttagtactaggttttacttacgtgtactagctagtacgtacgactaacgtcggtccgttcggttactacggttttcggaccggtacgggaaccgtacggcggtaggaacgtaacgtaacgaaaacggtacgtggttacggccttacgacctaaccacgtttcttacggttcctttacgtctttaccccg

SEQ ID NO: 255517 - DNA, 548 bp, Homo sapiens
  misc_feature: GYAE6OF01C85JR.12.86.H09.1.454.CMB.1.raw
  modified_base (202)..(202): a, c, t, g, unknown or other
  misc_feature (202)..(202): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
  modified_base (381)..(381): a, c, t, g, unknown or other
  misc_feature (381)..(381): n is a, c, g, or t
  modified_base (524)..(524): a, c, t, g, unknown or other
  misc_feature (524)..(524): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccgaggggaanagccaccttctcctgcagggccagtcagtagtcttagcacctacttagcctggtaccaacgagaacctggccaggcctcccgaggctcctcatctatgatgcataccgaaaggccagtggcactcccgagccgtaggttcagtggacgnggtggtcgngggcagtactcactctcactntcagcagctagacgtactagtagtagtttgtactagtttattacgtgtctagcagtcgtagctacgtcgtccgtcgttcgtacgtttggaccgtagggaccagtcgtagagtacgtaacgaacgacgtggtacgcgtcgtacncgtactcttgtctcgtcttacccg

SEQ ID NO: 255518 - DNA, 726 bp, Homo sapiens
  misc_feature: GYAE6OF01CA6D6.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttgggggaggaactgctcagttaggacccagagggaaccatggaagccccagctcagcttctcttcctctgctactctggctcccaggtgccaccggagaattctgttgacacagtctccagccacctgtctttgtctccgagggggaaancgccctaccttctcctggcgagggccagtcagagtcttagcaccttacttacgcctaggtaaccaacaacgaacctggaccaggcctcccaggcctcctcatctaatgatgacactaaccgaaaacgggccaacgtcggacctagtccccgagtacccgtagggttcaaggttcggacgtaggggtcggggtacggtcgggggacctaaggtacctttacgaccttaccgttaccaacctaagtccgaacggtaccaacggtcccgtaacggacgtaccgtacgtaagttacgtttacgtacgttaagttttaacttacgttgtactagtcgtaggtacgtacggtacgtaacgtcggtccgttcggtttaccgttaccggttttcggaccgggtaacgggaaccgtacggtcggtaacgggtaacgacgttaaacgaaaccggtaacggttacggtacggtactaccggtacctaaccgttaacgttacgttaccgtttaccttaccgttacccgttaccccg

SEQ ID NO: 255519 - DNA, 777 bp, Homo sapiens
  misc_feature: GYAE6OF01BP23F.12.86.H09.1.454.CMB.1.raw
  modified_base (202)..(202): a, c, t, g, unknown or other
  misc_feature (202)..(202): n is a, c, g, or t
  modified_base (289)..(289): a, c, t, g, unknown or other
  misc_feature (289)..(289): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaacagaaacctggccaggctccaggctcctnatctatcgatgacactaccgaaaacggcctacgtcggaccacctcccacgccgtacggttcaagggtcggacgtagggttcgggtcggtacgggggacaacggtacctttccgaaccttcctaccgaacctacgtaccgacggcgaacgtacccgtaaggaccggtaccgtaagggtaaacgtttagtttttacgacgttttaacggttttaactttacgttacggttacgtaacggaccgttaacgggacggtttacgaacgtaacccggttccgggttccccgtttaccgggttttaccgtttaacccgggttttccgggaaccccggggtaacggggtaaccccgtaaacggtccggttaaaggggaaaccgtaacggttaaaacccggtaaaaacggtaccggtttagggtaccgggtacgttaccgggaaccctacccgttaacgtttccgtacgtttaccctttactaccgtttacccccgg

SEQ ID NO: 255520 - DNA, 644 bp, Homo sapiens
  misc_feature: GYAE6OF01A8GLH.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaaccaacagaaacctggccaggcctcccaggcctcctcatctatgatgcataccgaaaagggccacgtggcactcccagccaggttcagtggcaggtggtcgtggggcacggtacttcgacttcctacgaccctatccagtccacgtacccgtaaggaccgtacccgtaggtaaacgttagtttttacggaccttaaggtttttaactttaccttggttaccaggtaccaggtaccgtaacgtacctaacgttcgggtaccctttccgggtttaccgtacgtttttcgggacccgtaggggtacccaaggtcgtagggaacgtactaacgaaacgtacgtggcggtcgtacgaccacgtacgttccgtgttaccttctaccgttccccg

SEQ ID NO: 255521 - DNA, 560 bp, Homo sapiens
  misc_feature: GYAE6OF01D3ZIJ.12.86.H09.1.454.CMB.1.raw
  modified_base (202)..(202): a, c, t, g, unknown or other
  misc_feature (202)..(202): n is a, c, g, or t
  modified_base (398)..(398): a, c, t, g, unknown or other
  misc_feature (398)..(398): n is a, c, g, or t
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
  modified_base (510)..(510): a, c, t, g, unknown or other
  misc_feature (510)..(510): n is a, c, g, or t
  modified_base (542)..(542): a, c, t, g, unknown or other
  misc_feature (542)..(542): n is a, c, g, or t
  modified_base (547)..(547): a, c, t, g, unknown or other
  misc_feature (547)..(547): n is a, c, g, or t
  modified_base (553)..(553): a, c, t, g, unknown or other
  misc_feature (553)..(553): n is a, c, g, or t
tcagatacgacgtacacgaccggtgctcgattttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaanagccaccttctcctgcagggccagtcagagtgttaatagcgtacttagcctggtaccagcagataccgtggccaggcctcccgaggcctcctcatctagtcggtgctatcctaccgagggcccagtggtactcccgagtcctaggttcagtggacaggttggggtctggggacagtacgttcacgtctaccacctntcagcacgcctgcagtctagtaagtntttagntagtttattactgtacagtctaagttaactaagtacgttgttacctgtcgttcgtacggttcggggacggggactagggngagtagtacgaagtctaggtcgcgtcgcactntactnttctcncttcccg

SEQ ID NO: 255522 - DNA, 552 bp, Homo sapiens
  misc_feature: GYAE6OF01BOKQJ.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaacagaaacctggccaggctcccaggctcctcatctatgatgcataccgaaaagggccacgtggcactcccagccaggttcagtggcaggtgggtcgtggggcaggtacttcactcctcaccactcagcacgctagacgcctagaagtatttgacttagtttattactgtcagtcgacgtcgtacgactacgtcggtccgtcggttctacgtttcggaccgtacgggaccagcgtaggacgatacgaacgtacgtagtcggctcgacaccgtatcttagtcttcgtcttacccg

SEQ ID NO: 255523 - DNA, 637 bp, Homo sapiens
  misc_feature: GYAE6OF01BM3W6.12.86.H09.1.454.CMB.1.raw
  modified_base (202)..(202): a, c, t, g, unknown or other
  misc_feature (202)..(202): n is a, c, g, or t
  modified_base (413)..(413): a, c, t, g, unknown or other
  misc_feature (413)..(413): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccacctgtctttgtctccgaggggaaangccaccttctcctgcagggccagtcagagtcttagcacctactagcctggtaccaacgagaacctgacaggctccaggctctcatctatgaatcgactaactaccgaaaaagggcctaacgtggacctacgtacccgagccgtaaggttcaggtcggactaggtcgggtcgtggggacctaagtaccgttcgacttacgtcaccatcgacncacgcctaagctaccgtagtaacgtatttgacgttagtttactactcgtactagtcgtaagtcgtaacgccgaacgttcgggccttaaccgggttaccgttaggtttccggaccggtaaggggtacccaacgggttcgaaggtaccgtaagtaaccgaaacggtcgtagggtacgtcgtacggtacctaacgtctaccgttagtcccttagtaccgttccccgg

SEQ ID NO: 255524 - DNA, 610 bp, Homo sapiens
  misc_feature: GYAE6OF01CKP3B.12.86.H09.1.454.CMB.1.raw
  modified_base (190)..(190): a, c, t, g, unknown or other
  misc_feature (190)..(190): n is a, c, g, or t
  modified_base (205)..(205): a, c, t, g, unknown or other
  misc_feature (205)..(205): n is a, c, g, or t
  modified_base (278)..(278): a, c, t, g, unknown or other
  misc_feature (278)..(278): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccagagaccaccggagaaattgtgttgacgcagtctccaggccaccctgtctttanctccgaaggggaaancgccaccctctcctgcagggccagtgagaatgttaaacaacaggtatctggcctggtaccagcaagaaaccgnggccaggctcccgaggctcctcatcgtacgttactccgagcacggccacgtggcactccagtaccaggtcacgtggctaggtggtctagggactaagtctttcgactcgtacaaccatccaacgaggtacgtggacgtctagaagttatttagagtagttacgttaattagttagttacgaagtacgtagttagtggtacgcgacctaaccgttacgttacgttttaccgggcgtacgggtacgaacggtacgtagggaacgagtaacgtaaagaaccggtgtcggacttcggacctaccgtacttctagttcttctcgttcccttacccgg

SEQ ID NO: 255525 - DNA, 632 bp, Homo sapiens
  misc_feature: GYAE6OF01A420M.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccgaggggaancgccaccttctcctgcagggccagtcagagtcttagcacctacttagcctggtaccaacagaacctggccaggctcccgaggcctcctcatctatgatgcactaccgaaaacgggccacgtcggccactcccagccgtaggttacaggtggcaggtggtcgtcggggcagtctcactctacaccatcacgcacgtcctagacgcctagtaacgttagtttacgtacgttagtttacttacgttcgtactagtcgaagtaccggtaacgaccgtaacgttcggtcccgttccggtttaccgttaacggttttccgggaccggttacggggaaccgtacggtcgtaggtacgtaacgtaaccgaaacgtacggttaggtcggtccgtacgacctaccgtacgttacttccgttacttccgtaccgttccccg

SEQ ID NO: 255526 - DNA, 589 bp, Homo sapiens
  misc_feature: GYAE6OF01BNYBI.12.86.H09.1.454.CMB.1.raw
  modified_base (523)..(523): a, c, t, g, unknown or other
  misc_feature (523)..(523): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccgaggggaaagagccaccttctcctgcagggccagtcagagtcttagccacctacttagcctggtaccaacagaacctggccaggctcccaggctcctcatctatgatgcataccgaaaagggccactggcactcccagccaggttcaggtggcgaggtgggtcgtggggcagtacttcgactctcaccatcagcagcctagacgtaccgtagaagttagttttcgacgttagttttaacttacgtgtacgagacaggtccgtagactaacgtcggtcccttcggttaccttacgttttcggaccgtacggggaccaggtacgtagggtanactaccgaaacggtacgttggacggtctacgaccaccgtattccgtattccttcgcgtttcccccg

SEQ ID NO: 255527 - DNA, 590 bp, Homo sapiens
  misc_feature: GYAE6OF01DJPJX.12.86.H09.1.454.CMB.1.raw
  modified_base (202)..(202): a, c, t, g, unknown or other
  misc_feature (202)..(202): n is a, c, g, or t
  modified_base (576)..(576): a, c, t, g, unknown or other
  misc_feature (576)..(576): n is a, c, g, or t
  modified_base (582)..(582): a, c, t, g, unknown or other
  misc_feature (582)..(582): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtcttgtctccgaggggaagngccaccttctcctgcagggccagtcagatctagcacctacttagcctggtaccaacagaaacctggccaggcctccaggcctcctctatctatgatgacagtaccgaaacggccacgtggcactccagctaggtcagtggcaggtggtacgtgggcaggtactttcgactctacacctatcgagtacacgtccgtaggacgtccgtacggtaagttagttttacgtactttaagtttagtttacgtgtactagtacgaggtacgtagtaccgtacgtcggtaccgttcggttaccgttacgtttacgggaccgtacgggaccgtagcgtaggatacgtacgaaacggtatggtcggcgtcgacactacttcgtntcttcncgttcccg

SEQ ID NO: 255528 - DNA, 702 bp, Homo sapiens
  misc_feature: GYAE6OF01DHVVB.12.86.H09.1.454.CMB.1.raw
  modified_base (204)..(204): a, c, t, g, unknown or other
  misc_feature (204)..(204): n is a, c, g, or t
  modified_base (294)..(294): a, c, t, g, unknown or other
  misc_feature (294)..(294): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttatctccgaaggggaaangccaccctctcctgcagggccagtgagaatgtaaacaacaggtatctggcctggtaccagcaagaacctggccaggcctcccaggctccncatcgtacgttactccagcagggccacgtggcatcccagacaggttcacgtggcaggtgggtctggggaacaggtaccttcgactctaccacctatccgaaccgagtaccgtgggacgtaccctaggtaaacgttagttttggacgttagttagttaatttagtttcgtacgtaaggtccgtaaggtttaagttgggtaacggtacccggtaccgtaacccgttaaccgtttaaccgggtttttccggggacccggttacggggttaaccccgtaaggtccgtaacggggtaacggtaagtaaccgggtaaaacggaacggttacgggttaacgggtctacccggtaccgtaacccgttaagttcccggttaacgtttcccgtttacctccgttccccgtttaccccg

SEQ ID NO: 255529 - DNA, 588 bp, Homo sapiens
  misc_feature: GYAE6OF01A6TBN.12.86.H09.1.454.CMB.1.raw
  modified_base (201)..(201): a, c, t, g, unknown or other
  misc_feature (201)..(201): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccacctgtctttgtctccaggggaaangccaccttctcctgcagggccagtcagagtcttagcacctacttagcctggtaccaacagaaacctggccaggctcccaggctcctcatctatgatgcataccaaaaggggccactggcacgtcccagccaggttcagtggcaggtggtctgggggcagcttcacttcgtcaccatcagtcagcctagagcctagtaagtatttgacttagttattacgtgtcagtcagcgtacgtcaacgtggcccttcgggtaccttacggttttcgggaccgtaggggaacccaggtccgtagggacgtacgtaaccggaaaacgtacgttaggtcgggtacctgggaccctaaccgtcgttaccttacggttcctttacgcgtttacccccgg

SEQ ID NO: 255530 - DNA, 849 bp, Homo sapiens
  misc_feature: GYAE6OF01D1STN.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgttctttgtctccgaagggggaaagcgccctaccttcctcctggcgacgggcctagtcgagtacgttcttacgcctaaccttacgttacgccgtaggtaaacccaaacgaacggaaccgtcggaccgacggtccctacccgacgggtcccttaccctactacttactagtacgtacgttacgacctaaccgtaaacccggaaaaacgggggtaccctaacggttccgggaaccctaaccgttaccccgacggtacccggtaacgggtttaccgaacgggttcgggtacggtaacgggggtttcgggtacggggttacggggggactaacgggttacctttaccgtaccttccgtaccaacgtactacgacgacgtacgtaccgtaaggacgtccgtaaggttaacgtttagttttacgtacgtttaagttttaacgttacgttcgtacgacgtacgtacggtaccggtaacggactaaccgggttcggttacccgtttacgggtttaccgtttaaccgggttttccgggaacccgggtaacggggtaaccgaacgggttccggtaagggtaacgtaaaccgtaaaccggtaaaccggttaacggtacgggtacggtcgtaccggaccctaacgtctttacgttactttacccttctaccgttcccccg

SEQ ID NO: 255531 - DNA, 819 bp, Homo sapiens
  misc_feature: GYAE6OF01BE4RM.12.86.H09.1.454.CMB.1.raw
  modified_base (209)..(209): a, c, t, g, unknown or other
  misc_feature (209)..(209): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtcgccaccggagaaattctgttgacacagtcctccagcccaccctgttctttgtcctccgaaggggaaancgcctaccttctccgtgcgagggccagtcagtacgtcttagcctaacctacttacgcctacggtaaccaaacgacgaaaccgtcggaccgacggtcctacccgacggtcctacctctactactatgatcgacaacgtaaccgaaaacgggccaacgtcgacctaacgtacccgacgtaccgtaacggttcgaacgggtacggtaccggtaaggggttccggggtacgggttacggggggtacctaacggtaccgttttacccaaccgttaccgtaccaaccctaataccgaacgtaccgaccggtaaccgttaacggacgttacccgtagtaaacgtttgtttaccgtaagtttaacgttttaattaccggttgtacgtaacgtacgacggttacggtaacgtaccgtaccggttcggttacccggtttaaccgggtttaccgttaccggtttaccggggaacccggttaacgggggtaccgtaacggtaccggtaacgggaaaccgtaacgttaaaccggtaaaacggtacgttacgggtacggtacctaccggacccttaaaccgttcgttacccttacgtttccgttacccgttaccgtttaccccg

SEQ ID NO: 255532 - DNA, 522 bp, Homo sapiens
  misc_feature: GYAE6OF01DY34W.12.86.H09.1.454.CMB.1.raw
  modified_base (202)..(202): a, c, t, g, unknown or other
  misc_feature (202)..(202): n is a, c, g, or t
  modified_base (515)..(515): a, c, t, g, unknown or other
  misc_feature (515)..(515): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaacagaaacctggccagctccaggctcctcatctatgatgcatccaaaaagggccactggcatcccagccaggttcagtggcagtggctggggcagacttcactctcacatcagcagcctagagcctagaagattttgactagtttattactgtcagcagcgtagcaactggcctcggttctacgttttcggccgtaggggaccaagcgtaggacgactacgaaacgtactagcggctgacaccgtatcgtgtcttnacttccg

SEQ ID NO: 255533 - DNA, 615 bp, Homo sapiens
  misc_feature: GYAE6OF01BUSCK.12.86.H09.1.454.CMB.1.raw
  modified_base (203)..(203): a, c, t, g, unknown or other
  misc_feature (203)..(203): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccgaggggaaangccaccttctcctgcagggccagtcagagtcttagcacctacttagcctggtaccaacagaaacctggccaggcctcccgaggcctcctcatctatgatcgcactaccgaaaacgggcccacgtggcactcccgagccctaggttcaggttggcgtaggtcggtcgtggggctagtctcgactctcactatcagcacgtccagcgtcctagtaacgttgtttgacgttaagttttacttacgtagtacaggctacggtaccgtaacgacgttcggtccttacggttccttacggtttcgggaccggtaacgggtacctaacggcgtacggagtaactaaccgaaaacggtcgtggtacggactcggactacccgtgttaccgttacgttaccttactcccttcgttaccccg

SEQ ID NO: 255534 - DNA, 777 bp, Homo sapiens
  misc_feature: GYAE6OF01DATWZ.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccacgccacccttgttctttgtcctccgaaggggaaagacgccctacctttctcctgccgacgggccagtcgagtagtctagcctacctattacgcctacggaaccaacgacgaaccgtggccgacggtcctccgacggtcctcctacacgttctagtgacgtgacctaacgttaacccggaaaacggggtccctacggtacggacctaaccgtaccccgaacggtccgtaacggttcgaacggtcgggaccgtaggggttcgggtacggtgggggtactacgttaccgttcaccgttcctaccgactacgtcgacgtaccgacgtaccgtaagaccggtaccgtaaggtaacgttacgtttacgtaacgtttaagttttaccgttacgttacgtacgtacgacgtacggtacgtaacgtaccgtaacggttccggtaccgtttccggttaccgtttacggtttccgggaccggtaacgggtaaccgtacggtacggtaggtacgtaaacgtaaccggtaaacggtaccgttgggtaccggtacgtaccggtaacccgtaccgttacgttccgttaccggtttccttaccgttcccgtttacccccg

SEQ ID NO: 255535 - DNA, 737 bp, Homo sapiens
  misc_feature: GYAE6OF01A16ZK.12.86.H09.1.454.CMB.1.raw
  modified_base (446)..(446): a, c, t, g, unknown or other
  misc_feature (446)..(446): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagccacctacttagcctggtaccaacagaaacctggccaggctcccaggctcctcatctatggtgcatctaccgagggccacgtggtactcccgagcccgaggttccaggttcgggactaggtcggggtcgtggggacaggtacgttcgaccttcgtccaaccatccgacgcctacgcccgtggtacctacggttccttagggaaagttntttttacggacctttaaggtttttaactttaaccgttcggttaaccgtaacggtacgttaagttaacctttaaaacgtttaaccggtttcgggttttacccttacggtaccgtttacccgggttaacccggtttttccggggggaacccgggggggtaaccctaaagggggttacgggaacggtaacgttaaaccgaaaaccggtaaacgtttcggggtacggtaccgtcggaccctaacccgtgttacccgtttacgttccttacctaccgttcccgttccccggtaacc

SEQ ID NO: 255536 - DNA, 766 bp, Homo sapiens
  misc_feature: GYAE6OF01COGVG.12.86.H09.1.454.CMB.1.raw
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
  modified_base (319)..(319): a, c, t, g, unknown or other
  misc_feature (319)..(319): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctgtgtctccaggggaaangccacctctccngcagggccagtcagagtagttaatagcgtacttagcctaggtaccagcagactaccgtggaccaggcctaccccgaggtcctacccgtacattcctagtcgggtnacctaacgtccgtaacccgagggccctaacgttggtacctcccgagcccgtagggtttccaggtggactaggttggggtctaggggaactaggtacgttccaaccttcgtaccaaccgtacgtccgaaggtcccaacggtcctacggtaccgtacggttaccttaaggtaaacgtttacgtttttacggacctttaaggtttttaactttaaccgttacggttacgtaacggtacgttaaggttaaacttaaacgtttaaccggttacgggtttaccccgttacgggttcccttaccggttaccggggtttaccgggggtaccggggggtaaccggtaaaggggttacgggtaaacgtaacggtaaaccgtaaacggtaacgttacgggttcggtaccgtcgtaccgtaccgttaacgttacgtttccgttccgtttaccgttaccg

SEQ ID NO: 255537 - DNA, 561 bp, Homo sapiens
  misc_feature: GYAE6OF01A86JK.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaangccaccttctcctgcagggccagtcagagtcttagcacctacttagcctggtaccaacagaaacctggccaggctcccaggctcctcatctatgatgcataccaaaagggccacgtggcactcccagccaggttcagtggcaggtgggtcgtggggcaggacttcgactctcaccatcagcagcctagacgtcctagtaagtagttttgacgttagttttattactgtacagctagcgtagctaacgtcggtccttcggttctacgtttcggaccgtagggacctacggcgtaggagtactacgaaacggtacgtggtcggtctcgaccactcgttcttagttccttcgacgttccccg

SEQ ID NO: 255538 - DNA, 839 bp, Homo sapiens
  misc_feature: GYAE6OF01BR4XG.12.86.H09.1.454.CMB.1.raw
  modified_base (211)..(211): a, c, t, g, unknown or other
  misc_feature (211)..(211): n is a, c, g, or t
tcagatacgacgtacacgaccggtgctcgatttagtgctatagacttgggtttgggggaggaactgctcagttaggacccagagggaaccatggaagccccagctcagcttctcttcctcctgctactctggctcccaggtgccaccggagtaaattctgttgacacagtcctccagcccacccttgttctttgtcctccgaaggggaaancgcctaccttctccgtgcgagggccagtcagtagtcttacgcctacctacttacggcctacggtaaccaaacgaacggaaaccgtcggaccgacggcctacccgaggtccctcctctacttctagtgtagtcgacctaacgtaaaccggaaaacggggtccctacggtacggacctaaccgtaccccgacgggtacccgttacgggtttaccgacgggttacgggtaccggtacggggggttcgggtccggggtacggggggtacctaaaccgggttaccctttacccgtaaccgtttaccctaacccgtaaaccccgtacgtaaccgtaaaccgggaccgtaaccgggtaaccgttaacggggtaccgttacccggttaaaggttaaacgttttacggtttttacggtaaccgtttaacgtttttaagtaccgtttacgttacgacgtaccgtaggtaccgtagtacctacggttcggtcccggtttcggttaccgtttacgggttcgggaccggtacgggtacctagggtcgtaacggtacgtaacgtaaccggaaacgttcggtcgggttaccggacgtaccgacccttacgttcttccggttagttcccttcgtacctttcccg

SEQ ID NO: 255539 - DNA, 667 bp, Homo sapiens
  misc_feature: GYAE6OF01BN3Q5.12.86.H09.1.454.CMB.1.raw
  modified_base (205)..(205): a, c, t, g, unknown or other
  misc_feature (205)..(205): n is a, c, g, or t
  modified_base (373)..(373): a, c, t, g, unknown or other
  misc_feature (373)..(373): n is a, c, g, or t
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
  modified_base (615)..(615): a, c, t, g, unknown or other
  misc_feature (615)..(615): n is a, c, g, or t
tcagatacgacgtacacgaccggtgctcgatttagtgctatagacttgggtttgggggaggaactgctcagttaggacccagagggaaccatggaagcccccagctcagcttctcttcctcctgctactctggctcccaggtgccaccggagaaattctgttgacacagtctccagccaccctgtctttgtctccgaggggaaanagccaccttctcctgcgagggccagtcagagtcttagcacctacttagcctggtaaccaacacgaaacctggccacggcctcccgaggcctcctcatctatgatcgcactaccgaaaagggccacgtcggacactcccgagcctaggttcaggtggcgaggtggtcgngggcagtctcnctcncacatcagcacgacgtacgacgtaccgtagtaacgttagtttgacgtttaagttttaacttaccgttagttaccgtaaggtcgtaacggtaccggtagtaccgtaaaccggttcggtcccggtttacggtttaccgttaaccggttttcgggaacccggttaacgggggaaccctaaggtccggttaacggaacgttaacgtaaaccgaaacggtacggttacgggngtacggtcgacccgtaccgtactttcgttacgtttccttccgtcttaccccg

SEQ ID NO: 255540 - DNA, 631 bp, Homo sapiens
  misc_feature: GYAE6OF01EJCIR.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccgaggggaagagccaccttctcctgcagggccagtcagagtcttagcacctacttagcctggtaccaacagaaacctggccaggcctcccaggcctcctcatctatgatgcataccgaaaagggcccacgtcggcactcccagccgtaggttcaggtggcgaggttcgggtcgtgggggctaacggtacctttcgaccttccgtaccaccctagttacacgtccaacggaccctaggaaccgtccgtagtaaggttacttttcgatttacgttttatttacgtgttacagtcgtaggtccgtagaccgtaacgtcggtacctttcggtacttaccggtttcggaccgtacggggaaccgtagcggtaggacgtaaccgtaaccgaaacgtacgttaggtacggctagacctcctactcgttgtcttcgtcgttaccccg

SEQ ID NO: 255541 - DNA, 787 bp, Homo sapiens
  misc_feature: GYAE6OF01DJZ6U.12.86.H09.1.454.CMB.1.raw
  modified_base (208)..(208): a, c, t, g, unknown or other
  misc_feature (208)..(208): n is a, c, g, or t
tcagatacgacgtacacgaccggtgctcgatttagtgctatagacttggggtttgggggaggaactgctcagttaggacccagagggaaccatggaagccccagctcagcttctcttcctcctgctactctggctcccaggtgccaccggagaaattctgttgacacagtcctccagccaccctgttctttgtctccgaaggggaaangccaccttctcctgccacgggccagtcagtacgtcttagcctaccttacttacgcctacggtaaccaaacacggaaaacctggaccaacggcctacccgacggccttcctctactctaatggactgacacgtaccggaaaacggccactcggcctactcccagacctaggttcgaaggtggcgtaggttcgggtcggtggggacacggtacttaccgtacctcctaccacctaactcgacgacctaacggtccgtaacggtacggtacccgttaagggttaacggtttacgtttttacgttacgtttaaacgtttttaagtttaccgtttacggtacgtaacggtaccgtacggtaaccggttaacgtacccggttaacgtccgggttacccgtttcgggttttacccgttaccgggtttttaccgggacccgggttaacggggaacccgtaccgggtacggtaacggggtaaacgtaaccgtaaaccggtaaaacggtaaccgttagggtacggttcggtaccgtaccgtacccgttacgttacgtttacgtttccctttcgtacccgtttaccccgg

SEQ ID NO: 255542 - DNA, 669 bp, Homo sapiens
  misc_feature: GYAE6OF01ASMVG.12.86.H09.1.454.CMB.1.raw
  modified_base (201)..(201): a, c, t, g, unknown or other
  misc_feature (201)..(201): n is a, c, g, or t
  modified_base (436)..(436): a, c, t, g, unknown or other
  misc_feature (436)..(436): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccacctgtctttgtctccgagggaaangccaccttctcctgcacgggtccagtccagtacgtcttagcacctattacgcctaggtaccaacagaaacctggaccaggtcctaccccaggtccttcctactatctagtacgatcgactagtacccgaaaaggggccctaacgtcggaccacttccccgagtcccgtaaggttccaaggttcggctacgggtggtccgtaggggcagtaccgttcacgtctaccgacctagtcncgtacacgcctagacgtacctagtaacgttatttcggactacgtttacgttactcgtcgtacggctaggtaccgttacgaccgtaactcggtccttaccggttacgtaccgttttcgggacgtacggggtacctacggtcgtagggaacgtacctaccggaaaccggtagttcggtacggtccgttaccgacgtaccgtactttcggtacgtttccttaccgtcgttaccccg

SEQ ID NO: 255543 - DNA, 554 bp, Homo sapiens
  misc_feature: GYAE6OF01D9FPX.12.86.H09.1.454.CMB.1.raw
  modified_base (203)..(203): a, c, t, g, unknown or other
  misc_feature (203)..(203): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagngccaccttctcctgcagggccagtcagagtcttagcacctacttagcctggtaccaacagaaacctggccaggctcccaggctcctcatctatgatgcatccaaaagggccactggcactcccagccaggttcagtggcaggtggtcgtggggcagcttcactctcaccatcagcagcctagagcctagaagtagttttgctaagtttattacttgtctagcagtcgtagctaacgtcggccgttcggttctacgttttcgggaccgtacggggaccagcgtaggacgtagtaactaaacggaacgttggtcggtctcgaccacctactcgttattccttcactttccccg

SEQ ID NO: 255544 - DNA, 668 bp, Homo sapiens
  misc_feature: GYAE6OF01BISQ1.12.86.H09.1.454.CMB.1.raw
  modified_base (205)..(205): a, c, t, g, unknown or other
  misc_feature (205)..(205): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagcccaccctgtctttgtctccgaaggggaaancgcctaccttctcctgcgagggccagtcagtagtcttagctacctacttagcctggtaaccaacaacgaaacctcggaccacggcctcccgaggtcctcctcatctatgatgactactaccgaaacgggccacgtcggcactcccgagccaggttacaggtcggacgtagggtcgggtcgtcgggggactacggtaccttcacgttctacccaacctagtacgacgtaccgacggtacccgtaggaccgtaccgtaaggtaaacgtttcgttttacgtacgtttaaggttttaactttacgtacggttacgaagtcgaacggtcgtaagactaacggtcggtccgtttcggttacttacgtttcgggaccgtacggggacaacggtggtacggagtactaaaccgaacggtcgtaggtcggctacggaccacgttcgtcgttagtccttccgtcttaccccgg

SEQ ID NO: 255545 - DNA, 586 bp, Homo sapiens
  misc_feature: GYAE6OF01C1V4W.12.86.H09.1.454.CMB.1.raw
  modified_base (152)..(152): a, c, t, g, unknown or other
  misc_feature (152)..(152): n is a, c, g, or t
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (256)..(256): a, c, t, g, unknown or other
  misc_feature (256)..(256): n is a, c, g, or t
  modified_base (345)..(345): a, c, t, g, unknown or other
  misc_feature (345)..(345): n is a, c, g, or t
tcagatacgacgtacacgaccggtgctcgatttagtgctatagacttgggtttggggagggaactgctcagttaggacccagagggaaccatggaagccccagctcagcttctcttcctcctgctactctggctcccaggtgccaccggganaaattctgttgacacagtctccagccacctgtctttgctcaggggaangccacttcncctgcaggccagtcagagtcttagcacctacttagcctggtaaccanagaaacctgccaggctccaggctcctcatctatgatgcataccgaaaagggccacgtggcatcccagccaggttcagtgcagtcggtangggcagacttcgactctccaccagtcagcaagcctagacgcctagagtagtttgtacgtagttttaacttacttcgtactagcgacgcggtaacgactaacgtcgggtccttacgggttacttaccgttttggacccgtaggggtacccgaggtaccgtaggtaacgacgttacgaaacgtaacgttaggtacggtcgttacgacctacctacgttcgttactttcttacctcgttacccc

SEQ ID NO: 255546 - DNA, 680 bp, Homo sapiens
  misc_feature: GYAE6OF01EZLYV.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccgaggggaaagagccaccttctcctgcacgggccagtcagagtcttagcacctacttagcctggtaccaacagaaacctggccaggcctcccaggcctcctcatctatgatgcactacccgaaaaggggcccacgtcggaccactccccgacgcccgtaggtttccaggttcgggacgagggtcgggtcggtgggggcaggtaccgttccgacctcctaccaccactcagccacgacccgtaggacgacccttaggtaagtttagtttttacgaccgtttaagtttttaaccgttacgttgttaccgaacggtccgaggtaccggtagtacccgtaacggttcgggtcccgtttaccgggtttacgttacggttttcgggaccggtaacggggaacccgtaggtcggtaggtacgtaacgtaaccgtaaacgtacggtcgtacggtcctcgacgaaccctgttccgttagttcccttcgtccttcccg

SEQ ID NO: 255547 - DNA, 652 bp, Homo sapiens
  misc_feature: GYAE6OF01DBJX5.12.86.H09.1.454.CMB.1.raw
  modified_base (204)..(204): a, c, t, g, unknown or other
  misc_feature (204)..(204): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccgaaggggaaancgccaccttctcctgcagggccagtcagagtcttagccacctacttacgcctggtaaccaacacgaaacctggccaggcctccgaggcctcctcatcgtacgttactccagcgaggccacgtggccactcccagacgtacggttcacgtcggacgacgggttgggtacgtgggaacacggtaccttcgacctttcaccaccactccaaccgaggtaacgtgggacgtcgtaaggtaagttacgttttagactagttagttatttattcgtacgagtctagttagtcgggtacgcgtaccgtaccgttacgttacgttttccgggaacccggtacggggtaccaaggtcgtaggacgtaacgtaacgaaacgtacgtcggtcggtacgtacgacctaaccgtacgttaccgttcgttccttactacctttacccgttcccgtcttaccg

SEQ ID NO: 255548 - DNA, 654 bp, Homo sapiens
  misc_feature: GYAE6OF01C8BXT.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccgaggggaanagccaccttctcctgcagggccagtcagagtcttagccacctacttagcctggtaaccaacgacgaaacctggccaggcctcccgagcctcctcatctatgattgcactaccgaaaagggccacgtggcactccagccaggtcagtggctagtggtctgtgcagtacttcgacttccacacctactcgtagccacgaccgtacgacgtaccgtagtaagttagtttttacgacgtttaacgtttactttacgttacggtacgtacgtacgacggtaccgtacgtaccgtaacgttccgggtaccgttccggtttaccgttaccggtttttcggaccgggtaacgggtaccgtaacggtcgtagggaacgtaacgtaaccggtaaacggtaacgttaggtcggtaccgtacgacccgtacttacgttccgttacgtttccgttccgttacccg

SEQ ID NO: 255549 - DNA, 852 bp, Homo sapiens
  misc_feature: GYAE6OF01C4E5B.12.86.H09.1.454.CMB.1.raw
tcagatacgacgtacacgaccggtgctcgatttagtgctatagacttgggtttggggaggaactgctcagttaggacccagagggaaccatggaagccccagctcagtcttctcttcctcctgctactctggcctcccaggtgccaccggagaattctgttcgactacagtcctccacgcctacctgttctttcgcctcggaaggggaaagtcgccctacctttctcctgaccgacggggtccagtcaggtattcttacgcctaccttacgtacgcctaggtaacccaactaacggaaacctcggacccaacggtcctacccgacggtcctaccctactacgttacttaatcgtattcggacctaactaaaccggaaacggcctacggttacggacctacgtacccgaggtccctagggtttaccgaaggttcggacttagggggttcgggtaccggttagggggaccttaacggtaccttttacgaccccgtttactaaccccgtacctaaacgttcccgaggaccgtaccggtacccgtaaggtaccggttaccgtaagggttaactttacgttttacgttaacggtttaacgttttaacggtttaactacggttaccgtaacggttaacgtacggtaacgttaccggaccgttaacgggttccgggttccgtttaccgggtttacccgtttacgggttttaccggggaaccggttaacggggtaacctacgggtacgttacgggtaacgtaacggtaaacccgaagggtaccgttaggtaccggtccgggtacaacccgttacgttaaccttccggttaccgtttctaaccgtttcccgtttacccccg

SEQ ID NO: 255550 - DNA, 738 bp, Homo sapiens
  misc_feature: GYAE6OF01CB7JP.12.86.H09.1.454.CMB.1.raw
  modified_base (209)..(209): a, c, t, g, unknown or other
  misc_feature (209)..(209): n is a, c, g, or t
  modified_base (487)..(487): a, c, t, g, unknown or other
  misc_feature (487)..(487): n is a, c, g, or t
  modified_base (696)..(696): a, c, t, g, unknown or other
  misc_feature (696)..(696): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtcgccaccggagaaattctgttcgacacagtctccacgccacctgttctttcgtctaccgaaggggaaancgcctaccttctcctgcgacgggtccagtcagtacgtcttacgctactacttacgtcctaggtaaccaaacgacgaaaccgtcggaccacgggtacctccgtaacggtccttacctctaactcttaagtcgaagtcgactaaccgtaaccggaaaacggcctacgtacggacctaacctaccgacgtacccgtaggttacgacggtaggaccggttagggtcggggtaccggtaggggaacctacggtacctttacgacctttcaacccaacgttacncggaactacgacgtaaccgtacgacgtaccgtagggtaactttagtttacgtaactttaagtttaacttcgtaagtacgtaagtaactaagttaacttaaacgttagttccggttactcggttaaccttaccggttaccgtttacccggtaccggaacggtaaacgtaaagtacgtaacgtacgtaaaccgtaaacgcgttcgagtacnctaccgtacttacgtcgttacttacgttactccttccgtacc

SEQ ID NO: 255551 - DNA, 587 bp, Homo sapiens
  misc_feature: GYAE6OF01CJMWV.12.86.H09.1.454.CMB.1.raw
  modified_base (202)..(202): a, c, t, g, unknown or other
  misc_feature (202)..(202): n is a, c, g, or t
  modified_base (392)..(392): a, c, t, g, unknown or other
  misc_feature (392)..(392): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaacagaacctggccaggctcccaggctcctcatctatgatgcataccaaagggccacgtggcactcccagtccaggttcaggtggcaggtggtctggggcagctttcactctcaccatcgagcacgcctagacncgtagaagtatttgactagtttaattactgtctagcaggcgtagactaacgtcggtccttcggttcctacggttttcggacccggtaacggggtacctaaggtcgtaggacgtacgtaacgaaacggtaaccgttggtacggtccgtacgaccgaaccgttacgttccgttacgttccttcgtcgtttacccccg

SEQ ID NO: 255552 - DNA, 685 bp, Homo sapiens
  misc_feature: GYAE6OF01EE49M.12.86.H09.1.454.CMB.1.raw
  modified_base (206)..(206): a, c, t, g, unknown or other
  misc_feature (206)..(206): n is a, c, g, or t
  modified_base (666)..(666): a, c, t, g, unknown or other
  misc_feature (666)..(666): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgttctttgtctccgaagggggaaanagcccaccttctcctgcgagggccagtcagagtcttagccacctacttacgccttaggtaaccaacacgaaacctggaccacggcctcccgaggccctacctcacttcctagtgattcgactacgtaccgaaaagggcccacgtcggacacctcccagccgtacggttcaggtcggcgtagtcgggtacggtgggggactacggtacctttccgacttccgtactaacctacgtacaacgccgtaacgacccgttaggacgtaccgtaggtaagttacgttttagacctttaagttttactttaacgtgtaccgtagtacgtaggtaccgtacgtaccgtacgtacggtcccgttcggttaccgtacggtttacgggacccggaacgggtaaccgaaggtcgtaggacgtaacgtaaccgaaacggtcgtggtacggctacggccctaacgtcttacttnttcttccgtcgttaccccg

SEQ ID NO: 255553 - DNA, 621 bp, Homo sapiens
  misc_feature: GYAE6OF01A5TMA.12.86.H09.1.454.CMB.1.raw
  modified_base (201)..(201): a, c, t, g, unknown or other
  misc_feature (201)..(201): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtcttgtctccaggggaaangccaccttctcctgcagggccagtcagagtcttagcacctacttagcctggtaccaacagaaacctggccaggctcccaggctcctcatctatgatgcataccgaaaaggccacgtggcactcccagccaggttcagtggctaggtggtcgtggggcacgtacttccacgttcaccgactatcagcctagccgtagacgtcctagaagttagttttcgacttagtttaacttacgttgtacgtacgtacgtagtacggtggggtctcgtacgtcgtactttccgtacgtttcccggaccgttacgggtaaccgtaaaggtacgtaacgttacgtaaccgtaaaacggtacgttggtacggtacgtcgtacccgtaacctacgttccgttacgttacctttactacgttcccgtttacccg

SEQ ID NO: 255554 - DNA, 710 bp, Homo sapiens
  misc_feature: GYAE6OF01DVSMA.12.86.H09.1.454.CMB.1.raw
  modified_base (201)..(201): a, c, t, g, unknown or other
  misc_feature (201)..(201): n is a, c, g, or t
tcagatacgacgtacacgaccggtgctcgatttagtgctatagacttgggtttggggaggaactgctcagttaggacccagagggaaccatggaagccccagctcagcttcctcttcctcctgctactctggctcccaggtgccaccggagaaattcgtgttgacacagtctcagccacctgtctttgtctcgagggaagngcctacttctctgcagggccagtcagatcttagctacctactagcctaggaaccaagtacgaaacctggaccaacggcctacccaggctcctctacgtactagtcgatcgactacaaccgaaaagggtccacgtggacctactcccgaagtccgtacggttcgaggttacgggcgtagggttcgggtcggtacggggtactaacggtacctttaccacgttacctaccgaactacgtacgtacgacgaacggttacctaacgggtacgtaaccgttagtaaacggtttacgttttacggtacttaagggttttaactttacgttacggtaacgtacggtacgtacgggtacggttaacgacgtaaacggttcggtaccgtttaccggttccgtttaacggttttcgggaccgttaccggggaactacggtacggtaggagtaaacgtaacgtaaacggtagtcggtcggtcgtaccgtacacttagtccttaggttcctactgtccccg

SEQ ID NO: 255555 - DNA, 702 bp, Homo sapiens
  misc_feature: GYAE6OF01B28Z2.12.86.H09.1.454.CMB.1.raw
  modified_base (203)..(203): a, c, t, g, unknown or other
  misc_feature (203)..(203): n is a, c, g, or t
  modified_base (234)..(234): a, c, t, g, unknown or other
  misc_feature (234)..(234): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctggttgacacagtctccagccaccctgtctttgtctccgaggggaanagcctaccttctccgtgcagggccagtcagngtcttagccacctacttagcctaggtaccaacacgaaacctggccaggcctcccaggctcctcactctatgatgcactaccgaaaagggccacgtggaccactccccgagcccgtagggttccagtggacgaggtcggggttcgtcgggggactacggtacctttcgaccgttcgtaccgaaccctattccgaacggtccgaacgtacccgtaaggtacgtacccgttaaggtaaacggttactttttaggaccgtttaagtttttaactttacgttagtacctaggacgtaggtaccgtaagtccgtaaccggtcgggtcccgtttacgggtttcccgttaacggttttcgggacccggtaacggggtacccgtaacggtcggtacgggtaacgtactaaaccggaaacggtaccgtaggtcggccttcgaccaccgtacttcttcgtaccttcgtaccgtttcccg

SEQ ID NO: 255556 - DNA, 804 bp, Homo sapiens
  misc_feature: GYAE6OF01B55IG.12.86.H09.1.454.CMB.1.raw
  modified_base (205)..(205): a, c, t, g, unknown or other
  misc_feature (205)..(205): n is a, c, g, or t
  modified_base (269)..(269): a, c, t, g, unknown or other
  misc_feature (269)..(269): n is a, c, g, or t
tcagatacgacgtacacgaccggtgctcgatttagtgctatagactttgggtttggggaggaactgctcagttaggacccagagggaaccatggaagccccagctcagcttctcttcctcctgctactctggctcccaggtgccaccggagaaattctgttgacacagtctccagccaccctgtctttgtctccgaaggggaaanacgcctaccttctcctgcgagggccagtcagagtctagctactacttacgcctacggtaccaanagaaacctcggaccaggcctccaggcctcctcactctatgatcgacactaccgaaaacggccacgtcggccactcccgacgcccgtagggttcgaggtggacgtagggtcgggtcgtagggggctaaggtacctttacgaccttccgacctaacccgacgttaccgaacgccgtacgaccgtaacggacgtacgtagtaagtttacgtttacgtacgtttaagtttaacttacgttacgttacgacggtacgtaacggtacgtaacggtaacgtaaccgggttccggttacccggttttacccgggttttaccgttttaacccggggtttttacccggggaaccccgggggttaaacggggtaaaccccggtaaacggggttacccggtaaggggttaaaccggtaaaccgttaaaaccggtaaaaacccgggtaaccggtttacgggttaccggaccgttacccggtaacccgtaaaccgttacccgtttcggtttacccttttaccgttacccgttaacccgtttccccccgg

SEQ ID NO: 255557 - DNA, 933 bp, Homo sapiens
  misc_feature: GYAE6OF01EBR2G.12.86.H09.1.454.CMB.1.raw
  modified_base (213)..(213): a, c, t, g, unknown or other
  misc_feature (213)..(213): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtcgccgaccggagtaaattctgttgacacacgtcctccacgccaccctgttctttcgtctaccgaaggggaacncgcctaccttctcctgcgacgggcagtcaggtacgtcttacgacctaccttacgttacgccgttacggtaaaccaacgaacggaaacccgtcggaccgacggtcccgtacccgacggtaccctcccttacgtacttacgttacgtacgtacgttcgaaccgtaacgtaaaccccgggaaaaaccggggcccctaaccgggttaccgggtaaccctaacccgttaccccgtaacggtaccccggttaacgggtttaccggacggggttacgggtaccggtacgggggtttccggggttacggtacggggggtacccgtaacggtttacccgtttacccgtaacccttacccgtaacccgtaaccccgttaagttaccccggaaaccggtacccggtaaccggtaacccgttaaccggtaccggtaacccgtttaagggttaacgtttacgttttttacgtaccggttttaaactttttaacgtttaacccgtgggtttaaccgtaaccgtacggtaccgggtacgtacccggtaacgttccgggttacgttccccggtttacggtttacccgttttacgggtttacccgggtaacccgggtacgggtaacccgtacggtacgggtaacggtaacggtaccgtaaacggtaaccgttacgggtacgtcgggtaccgccgaccgtacctttacgccctttagttccttaccgtcccttacccg

SEQ ID NO: 255558 - DNA, 677 bp, Homo sapiens
  misc_feature: GYAE6OF01C3GAZ.12.86.H09.1.454.CMB.1.raw
  modified_base (400)..(400): a, c, t, g, unknown or other
  misc_feature (400)..(400): n is a, c, g, or t
  modified_base (603)..(603): a, c, t, g, unknown or other
  misc_feature (603)..(603): n is a, c, g, or t
tcagatacgacgtacacgaccggtgctcgatttagtgctatagacttgggtttggggaggaactgctcagttaggaccagagggaaccatggaagcccagctcagcttctcttcctcctgctactctggctccgaggtcgccacggagtaaattcgtgttgacacagtctccacgccacctgttctttgtctccggaagggaacgcgcctacctttcgtcctcgcgacgggccgagtcagtacgtcttacgcctaactacttacgccgttaggaaccaacaacgtaaccgtcggaccgacggtcctccgaggtcctcctactactctagtgtactcgaactactaacggaaacggcctacgtcggaccacgtaccgacgtccgtaaggttcgaaggtcgngtacggggttcgggtcggtacggggtacaacggttaccttacgtaccgtctaaccgacgtactacgacgcaacggtaccgttaacggacgttaccgtaagtaacgtttacgtttacgtaacgtttacgtttattacgtgtaccgagcgagttcgacgtactcggtcgtccgttcgtacttacgggttcggacgtaacggtacngtacgtagggtaacacgtaacgaagtcgtggactacggctaacgacttcgtacttgttctccgtcgttaccccg

SEQ ID NO: 255559 - DNA, 919 bp, Homo sapiens
  misc_feature: GYAE6OF01EKT9N.12.86.H09.1.454.CMB.1.raw
  modified_base (205)..(205): a, c, t, g, unknown or other
  misc_feature (205)..(205): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctggttgacacagtctccagccaccctgtctttgtcctccgaggggaaanagcctaccttctcctgcgacgggccagtcagacgtcttagccaccttacgttacgccgtcggtaaccaaacaacggaaacccgtggacccagggcctcccgaggcctcctcacgtctatgattcgactacgtaccgaaaacgggtcccacgtcggaccaccgtcccgagacccgtaggtttccgaagggttcggcgtagggttcggggtcggtcgggggtactacggttacctttccaaccgtttcctacccgaaccctagttacccgacgtccgtaacgtacccgtaaggtaaccggtacccgttaagggtaaacggtttaacgttttttacccggtaacgttttaaacggttttttaaccgttaacccggtttacggttaccggttaacggtaccggtaaccggggtaacccgttaacgggtaaccccgttaaccggtttaccgggtttaacccccggtttaccgggttttaacccggttaaccgggttttttacccggggacccgggttaaacccggggggtaaacccgtaacgggttccccggtaaaggggtaaaccggttaacgtaaaacccgggttaaaacccggtaaccgggtttacggggttaacccggtaccggtttacccggggtaacccctaaaccggttaccccgttttacggttaacccgttttcccgttttaccggttaacccctttttaccccccccgg

SEQ ID NO: 255560 - DNA, 858 bp, Homo sapiens
  misc_feature: GYAE6OF01C1A2Y.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttagacacagtctccacgccaccctgttctttgtccgtaccgaagggggaaagacgcctaccttctcctcgacgacgggaccagtcgagagttcttacgcctaccttacgttacgccctacggtaacccaacacgaaaccgtcggaccgaggccctcccgacggcccttccctactacttcgtaatgactcgacaacgtaaccgaaacggccctaagcggaccaccgtcccaacggtaccgtagggtttaccaagggtcgggtacgtaggggtcgggttccgggtcgggaactacggttactacccgttactccctaaccgtacctagtacccgaacggcctaacggacccgttaaggtaccggtaccgttaaacgggttaacggtttacgtttttacggtaccgttttaaggtttttaacttaccggtttacggttaaccgtacgggtaacggttaccggtaacggtttaaccggaaccgttaaaccgggttccggttacccggtttttaccgggtttaccggtttacgggtttttacccggggaacccgggttaacgggggtaacccgacggttacggtaggtaaacggtcgttaaaacccggtaaacggtaacgggttcggttacggtccgtaaccggtaaccctaccgttaaccttcgtttacccgtttaaccctttcgtcccgttttacccccgg

SEQ ID NO: 255561 - DNA, 820 bp, Homo sapiens
  misc_feature: GYAE6OF01DEFDN.12.86.H09.1.454.CMB.1.raw
  modified_base (152)..(152): a, c, t, g, unknown or other
  misc_feature (152)..(152): n is a, c, g, or t
  modified_base (203)..(203): a, c, t, g, unknown or other
  misc_feature (203)..(203): n is a, c, g, or t
tcagatacgacgtacacgaccggtgctcgatttagtgctatagacttgggtttggggaggaactgctcagttaggacccagagggaaccatggaagccccagctcagcttctcttcctcctgcctactctggctcccaggtcgccaccgganaaattctgttcgacacagtctccagccacctgtctttgctccgaggggaancgcctaccttctcctgcacgggccagtcagagtcttagaccaccttacgttagcctaggtaacccaagacgaaaaccgtcggacccaacgggtcctacccgacggtccttaccctctaactctaatacgtagttacggacctaaacttaacccggaaaaaacggggcccctaacggttacgggaccaaccgttaccccgaaggtaccccggtaagggtttacccgaaagggtcgggtacgtacgggggttcggggtaccggttacggggggactaacggtaccttttacccgaacttcctacccgtaacctacttaccgaagtaccgaacggtaccgtaacggtaaccgtcccgttaaaggtaacggttaacttttcggtaacttaacggttttaattaccgttacgggtaccaacggtaccgaaggtaccggtaacgtaaccgtaacggttcgggtaaccctttccgggttaccttacgggttttacgggacccggtaacggggtaaccccaaggcccggttaaaggacggaacttaaccggaaaacggtaacgtgggtacggtactacgaccgtaaacttcgttacgttacgttacctttaccgcgtttaccccg

SEQ ID NO: 255562 - DNA, 737 bp, Homo sapiens
  misc_feature: GYAE6OF01EJ01Y.12.86.H09.1.454.CMB.1.raw
  modified_base (212)..(212): a, c, t, g, unknown or other
  misc_feature (212)..(212): n is a, c, g, or t
tcagatacgacgtacacgaccggtgctcgatttagtgctatagacttgggtttgggggaggaactgctcagttaggaccagagggaaccatggaagccccagctcagcttctcttcctcctgcttactctggcctcccagggtcgccaccgggagtaaattctgttgacactagtctccagccacctgtctttcgtctaccgaaggggaaancgcctaccttctcctagcgagggccaggtcagactcttacgcaccgttattacgcctaggtaaccaaacacgtaaaccgtgccgtacggcctacccgaggtcctacctcaacgtctaatcgaatcgactaacgtaaccgaaaacggggtcctaacgtacgggacctacgtacccgacgtaccgtaggtttaccaaggttcggcggtaacgggtcggtcggtacggggtagtacgtaccttccgacttccgtacgaactacgtacgagtccaggtacccgtaaggcctacggtagtaagtttacgtttacgtacgttaagtttacttaacgtgttacaagtacgtacgtacggtacaccgtaacggttcggtaccgttccgtttaacggttcgttaacccgggaacggtaaccgggtatacggtacggtagggtaactaaaggaaccctaaagggtaccttaggtcgggtactacgggaaccctacgtaactttcgtacggtttcctttctaacccggtttccccg

SEQ ID NO: 255563 - DNA, 754 bp, Homo sapiens
  misc_feature: GYAE6OF01A8ALK.12.86.H09.1.454.CMB.1.raw
  modified_base (206)..(206): a, c, t, g, unknown or other
  misc_feature (206)..(206): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccacgccacccttgttctttgtctccgaggggaaanacgcctaccttctcctgacgacgggccagtcagtacgtcttacgctacctactgcctacggaccaagaacgaaccgtggaccgacggcctacccgacggcctccctacacttcctatgtaattcgactaacgtaaccggaaaaacgggccctaacggtcggacctaccgtacccgacggacccgtaaggttaccgtagggtcgggacgtcggggttcggggtcggtacggggtacgtaacggtacccttaccgtaacctcctaccaaccgtactacgacgacgacgtacgacggtacgtaccgtaagaactttaagttttcgaactttacgttttaacttacgtacgtacgacgtacgtcggtacgttacgacccgttaacgggttccggtcccgtttacggtcccggtttaacggttaccggacccggggtaacgggtacctaacggtcgggtaaacggtactaaaccgtaaagaaacccggtagtaccgggtggtacccgagtaacccagttccttactccgtttaacacccggttcttacccccg

SEQ ID NO: 255564 - DNA, 652 bp, Homo sapiens
  misc_feature: GYAE6OF01CSYFV.12.86.H09.1.454.CMB.1.raw
  modified_base (150)..(150): a, c, t, g, unknown or other
  misc_feature (150)..(150): n is a, c, g, or t
  modified_base (206)..(206): a, c, t, g, unknown or other
  misc_feature (206)..(206): n is a, c, g, or t
  modified_base (269)..(269): a, c, t, g, unknown or other
  misc_feature (269)..(269): n is a, c, g, or t
  modified_base (353)..(353): a, c, t, g, unknown or other
  misc_feature (353)..(353): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccgganaaattctgttgacacagtcctccagccaccctgttctttgtctccgaaggggaaancgccctaccttctcctgcgacgggccagtcagagtcttagcctacctattgcctggaaccaanagaaacctggaccagcctccgagcctcctcactctatgatgacactaccgaaaggccacgcggcactcccacgccgtaggttcnggtcggcgtagggttcggtcggtggggactacggtacttcgtacctcctaccacctactcgacgacacggtacctacggtacgtaccgtacgtaagttagttttacgtacgtttaacgttttaacgttaccgttagtacgtacgtacgtacggtacgtaacgactaccgtcggtcccgttacggttccgttacggttttcgggaccgtacgggaaccgtacggtacgtaggagtaaacgtacgaaacgtacgtggtacggtctcgacctacgtacttcgtattccttcgtccgttcccg

SEQ ID NO: 255565 - DNA, 590 bp, Homo sapiens
  misc_feature: GYAE6OF01BOIEM.12.86.H09.1.454.CMB.1.raw
  modified_base (201)..(201): a, c, t, g, unknown or other
  misc_feature (201)..(201): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccagggaaanagccaccttctcctgcagggccagtcagagtcttagctacctacttagcctggtaccaacagaaacctggccaggctcccaggctctcatctatgatgcataccgaaaaggccactggacacgtcccagccaggttacgagtggcaggtgggtcgtggggcagaactttcactctcgaccatacagcagcctagacgcctagaagtatttgactagtttaattactgtacagctaggcgtagacgtaactcggccttcggttactaccgttttacggacccgtaaggggaacccaggacctagggacgtacgtaaccgaaaaacgtagtaggtcggtccgtacgaccctaccgtaaatccgttacggttcttaccgtagtttacccccg

SEQ ID NO: 255566 - DNA, 592 bp, Homo sapiens
  misc_feature: GYAE6OF01BOQXJ.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaatttctgttgacacagtctccagccaccctgtcctttgctccaggggaangccaccttctcctgcagggccagtcagagtcttagcacctacttagcctggtaccaacagaaacctggccaggctcccaggcctcctcatctatgatgcataccgaaaagggccacgtggcactcccagcaggttcagtgcaggtcggctgggcaggctcactctacacatcagcacgctagacgacctagaacgttatttcgacttagtttacttacttgtcagctagcgtagacgaacgtcggtccgttcggttacgtcgtttacggccgtaacggggtaccgaggtcgtcggaacgtactaaaccgtaacgtacgttacggtacggtccgtaccgtacccttaacccgtacgttccgttacgttccgttacccgttcttacccccgg

SEQ ID NO: 255567 - DNA, 650 bp, Homo sapiens
  misc_feature: GYAE6OF01AF40A.12.86.H09.1.454.CMB.1.raw
  modified_base (203)..(203): a, c, t, g, unknown or other
  misc_feature (203)..(203): n is a, c, g, or t
  modified_base (436)..(436): a, c, t, g, unknown or other
  misc_feature (436)..(436): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccgaggggaaangcctaccttctcctgcagggccagtcagagtcttagccacctacttagcctaggtacccaacagaaacctggacccaggcctcccgaggtcctccctcattcctagtgactgctactaccgaaacggccacgtcggcactcccagccaggttcaggtggcgtaggtggtcgtggggcagtcttcactctaccgacctatcgagcacgtacctagacgtaccgtagtaacgttnttttacgactttaagttttacttacgtcgtacgacgtacgtacgtacgtacgtacctacgtccggtaccgtttccgggttacctcggttttaccgggaccggtaacggggtaaccctaggtaccggtaggaacgtaaccgtaaccgtaaacggtaccgtgggtacggccgttcgaccctacgttacttccgttacgttccttcgtccttccccg

SEQ ID NO: 255568 - DNA, 672 bp, Homo sapiens
  misc_feature: GYAE6OF01CQBG2.12.86.H09.1.454.CMB.1.raw
  modified_base (150)..(150): a, c, t, g, unknown or other
  misc_feature (150)..(150): n is a, c, g, or t
  modified_base (165)..(165): a, c, t, g, unknown or other
  misc_feature (165)..(165): n is a, c, g, or t
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (226)..(226): a, c, t, g, unknown or other
  misc_feature (226)..(226): n is a, c, g, or t
  modified_base (257)..(257): a, c, t, g, unknown or other
  misc_feature (257)..(257): n is a, c, g, or t
  modified_base (290)..(290): a, c, t, g, unknown or other
  misc_feature (290)..(290): n is a, c, g, or t
  modified_base (423)..(423): a, c, t, g, unknown or other
  misc_feature (423)..(423): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccgganaattctgttgacacngtctccagccacctgtcttgctcgagggaacngcctacttcncctgacgaggccagtcagngtcttagctacctacttagcctggtaaccanacgaaactggaccaggcctacccgagcctaccnctatcctatggactgcctaacgtaccgaaaacgggccctagtcggactactcccgagccagggttcagggtgcgtaggttgggtcgtacggggctacgtacttcgtaactccgtacaaccgatccgaggaccncgtacccgtaggtacgtccgtaaggtaaagttaccgtttttagacgtttaagtttaccgttaacgttcggtactacgtaactaaggtaaatttaacgtacgtttcgttaccgtcgtaacttcgttaccgggttcggggtacgggtaaaccggagggtcggaaagtccgaacggaaacgtacgtacgggtacgtgtaccgtcgactacggttctaccgtttcttaaccttcgttccccgttccgtaaccg

SEQ ID NO: 255569 - DNA, 604 bp, Homo sapiens
  misc_feature: GYAE6OF01AQKRU.12.86.H09.1.454.CMB.1.raw
  modified_base (202)..(202): a, c, t, g, unknown or other
  misc_feature (202)..(202): n is a, c, g, or t
  modified_base (320)..(320): a, c, t, g, unknown or other
  misc_feature (320)..(320): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagcccaccttctcctgcagggccagtcagagtcttagcacctacttagccctggtaccaacagaaacctggccaggctcccaggcctcctcatcatgatgcataccaaaagggccacnggcactcccagccaggttcagtggcaggtggtctggggcaggacttcactctcaccatcagcagcctagacgccgtagaagtattttagacgttagttttattacgttcgtacgagtcgacgtcgtacgctaaccgtcggtccgttacggttccgttaccgttttcggacccggtaacggggtacctaacggcgtagggaacgtataaccgaaaccgtacgtggtacggtccgttacggcctaacccgtacgttccgttagttcccttaccgtcgtttaccccg

SEQ ID NO: 255570 - DNA, 873 bp, Homo sapiens
  misc_feature: GYAE6OF01DA8WS.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggcctcccaggtcgccaccggagaaattctgttgacacagtctccagccaccctgtctttgtctccgaggggaagagccctaccttctcctgcgacgggccagtcagagtcttagctacctacttagcctaggtacccaacgacgaaacctcgggaccaacgggcctacccgacgggtccttaccctactaacttccgtaagttcgaacgttcgaaccgtaaacgttaaccccggaaaaaacggggccccaaacggttacccgggacctaaacccgttaccccccggaaaggtccccggttaaagggttttcccgaaggggttcgggaccgtaaggggtttcgggggtccgttacgggggggaacctaacgggttaccctttaccggtaaaccgttcccgttaacccgaacccctaacggttcccgaaacggtaccccgtaacggtaccccgttaacgggaccggttaccggttacgggtaaacggtttacgtttttacggtacgtttaacgggtttttaactttaaccggttagttaccgtacggtacgtaacggtacgtacggtacgtaaccggtcggtaccgttcggttaccgttacgttttaccgggaccggtacggggtaaccgtagggtaccgttaggtaaccgtaacgtaaccgtaaacggtaccggttaggtaccggtcgtacgtaccctaaccgtacgttaccgttacgttaccgtttaccgtacgtttccccgg

SEQ ID NO: 255571 - DNA, 717 bp, Homo sapiens
  misc_feature: GYAE6OF01E1B7Y.12.86.H09.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagtaattctgttgacacagtctccagccaccctgtctttgctccgaggggaangccaccttncctgcagggccagtcagagtcttagcacctattagcctggtaccaacagaaacctgccacggctcccaggcctcctcactctactgtactgaccagtaccgaaaagggccaacgtcgggaccacgtcccgagtccgtacggttacagggtggtacgacggttgggttacgtggggaccgtaagtacctttcaacgttctaccgtaaccgattccgaagccaacggaccgttagaacggtaccgtaggtaacggttattttacggtacgttaagtttttactttaacgttacgttacgaacggtacgtaacggtacgtaacgtaccgtaaccggttcggtaccgttaccgggttttacctacggtttttacgggacccggtaacggggtaccctaggtcgtaggtaacgtacgttaaccgaaacggtaacgttgggtacgggtaccgttaccgtaaccgtaaccgtacgttaccgtttagttcccgtttacgtacgtttaccccccgg

SEQ ID NO: 255572 - DNA, 643 bp, Homo sapiens
  misc_feature: GYAE6OF01AL0VB.12.86.H09.1.454.CMB.1.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (552)..(552): a, c, t, g, unknown or other
  misc_feature (552)..(552): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccgaggggaaangcccaccttctcctgcagggccagtcagagtcttagcaccttacttagcctggtaccaacagaacctggccaggcctcccaggctcctnatctatgactgcacgtacccgaaaacgggccaacgtcggaccactccccgagcccgtaggttcaggtggctaggtcgggtcgtgggggacaggtgttccgactctaccgacctatccgagcacgccgtgtcacgttctaggtaacgttagttttcgacgtttaagttttaatcgttacgtactagtactaagttaacttaataacgtttggttcctggtccgttaccgtacgggtttacgggggacggggaccgtagggnggtaacgacgttaaccgaaacggtacgttcggtaggacgttcgaccgtacctacgttccttagttacccttctacgtttcccgttaccccg

SEQ ID NO: 255573 - DNA, 812 bp, Homo sapiens
  misc_feature: GYAE6OF01BATIS.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagtaaattctgttgacacagtctccaggccacccttgttactttactcctaccggaaggggaaacgacgcccaccctctccgtgcgacgggccagtagaagtaattagttaaacaacgtaggttactcgtcggcgtacgggtaaccagacgaaacgtaaccgtcgggaccgacggtaccctacccgacggtccttaccctagttaacgttccggtttaacccggtttaacccttacccggaacgggtaccgtaacggggccccgtacggtacggacctaaccgacccggacgtaccgtaacggttccacggtcggacgtacgggtggttaccgtaggggaccacgttacttcgacttccactacacgtctaaccgacggtacgtcggacgtaccgtaaggtaagtttacgttttacgacggttaagttacgtttaacgtttacgtacggttaccgtaaggttaccgttaaggtacgttacgggttaacgaccgtaacccgttaaccgtttacgttaccggtttacgggaccgggttaaccggtacgtaaccgtaggtacgggaagtacggtaccggtaaaacggtacggtcgggtaacgccggttacggaaaccctacgttacggttactaccgttacctttaacttcccgttcccgttacccg

SEQ ID NO: 255574 - DNA, 918 bp, Homo sapiens
  misc_feature: GYAE6OF01AYM92.12.86.H09.1.454.CMB.1.raw
  modified_base (142)..(142): a, c, t, g, unknown or other
  misc_feature (142)..(142): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtcnccgaccggagtaaattctgttgaccacgagtcctccacgccctacccttgttctttgcctaccgaagggggaagtacgccctacctttcctccgtcggcgtacgggccctaggtcacgtacggttactttacgccctaacctttacgttacggtccgttacggtaaacccaaccgtaaacggtaaacccgtcggaccgacgggacccttacccgacgggtccttaccctactaacttacttacgtacgtacgttacgtaccgtaaccgtaacccgggtaaaaccggacccgtacgtacgggtacctaccgtaccccgacggtccggtaacggtttacgaacggttcgggtacggtaagggttcggggtacggttacggggacgtaacggttaccttcccgtaaaccttccttccgaaaccctacggttaaccacgggtaccgtaaccgggtaccgtaacgggtaacccggtacccgttaaggggttaaacgtttacggtttttaccggttaaacgttttaaacggtttttacctttaacgtaccggttaacgtacggtaccgtaacggaccgttaaccgggtaccgttaaccggttcgggttaaccccgtttaccgggttaccgttttaccggggtttacccgggaacccgggttaaacgggtacccgaaggttccggaacgggtaacgtaaccgtaacgtaaaacggtcggttaggaccggttccgactacccgacgttacttacgttacgttcccttacctaacgtttcccccg

SEQ ID NO: 255575 - DNA, 818 bp, Homo sapiens
  misc_feature: GYAE6OF01D8QMV.12.86.H09.1.454.CMB.1.raw
  modified_base (211)..(211): a, c, t, g, unknown or other
  misc_feature (211)..(211): n is a, c, g, or t
tcagatacgacgtacacgaccggtgctcgatttagtgctatagacttgggtttgggggaggaactgctcagttaggacccagagggaaccatggaagccccagctcagcttctcttcctcctgcctactctggctcccaggtgccaccggagaaatttctgttgacactagtcctccagcccacccttgttctttgtctccgaggggaaanacgcctaccttctcctgcgacgggccagtcaggtacgttcttacgcctaccttacgttacggcccgttacggtaaaccaaaccgaacgtaaacccgtgggacccgacggcccttaccccgacggtccttaccctcaattccgtaacgtgacttcgaccgtaacgtaacccggaaaacggggccctaacggtcggacctaccttaccccgaagtcccgttaacgggttccgaagggtcggtacgtaggggtcgggttcggtcgggacgacgtacttccgacgttccaccactctatacggctacggtacccgttacggacgtaccgttaggtaacgttttcggttttcgaacgttttaagttttacgttaacgttcgttaccgtacgtacgtacgggtacggtaacgtaccgtacggttccgggttacccgttccggggttttacctttccggggtttaccgggaaaccccgggttaaggggacccgttaacgggtcggtaacgtaacggaccgttaaaccgaaacggttacggttcggtacggtcctacgaacccccgttacttcgttaccgttacccggtttctttaccgttcccggtttaccccg

SEQ ID NO: 255576 - DNA, 709 bp, Homo sapiens
  misc_feature: GYAE6OF01DN84G.12.86.H09.1.454.CMB.1.raw
  modified_base (207)..(207): a, c, t, g, unknown or other
  misc_feature (207)..(207): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctccaggtgccaccggagaaattctgttgacacagtctccacgccaccctgttctttgtccgtccgaaggggaaanacgcctaccttctcctgcgacggccagtcagtacgtcttagcctaaccttacttacgtccgtacggtaaccaaacgaacgaaaccgttcggacccgacggtcctacccgacggtcctccctacacttcgtatgactgacaactaaccggaaaacggcctaacgtcggacctacctcccgacgaccgtaacggttcgtaggtcggacgtacgggtcgggttacgacggggactaacggtacttccgtacctccgtacaacctacgtacgacgacgtacgacctacggacgtaccgtagtaagtttgtttagtacgtttagtttacttacgttgtacgagtacgagtacgtacgactacgtcgtcccgttaggttcctacggtttacggaaccggtacggaactacggtacgtaaggagtaccgtaaacggaaacggttcgtacggtcggtaccgtgaacccgtactacggttacttacccgttcttaccgttccgttaccccg

SEQ ID NO: 255577 - DNA, 830 bp, Homo sapiens
  misc_feature: GYAE6OF01BRL6B.12.86.H09.1.454.CMB.1.raw
  modified_base (213)..(213): a, c, t, g, unknown or other
  misc_feature (213)..(213): n is a, c, g, or t
tcagatacgacgtacacgaccggtgctcgatttagtgctatagacttgggtttgggggaggaactgctcagttaggacccagacggaaccatggaagccccagcgcagcttctcttcctcctgctactctggctcccagataccactgggagaaatagtgatgaagcagtctccacgcccaccctgtctgtcgtcctaccggaaggggaaacncgccctaccctcctccgtcgccgacgggccagtcgaagtaggttagttaagagtaccgtaacgtttacggccgttacgggtacccagtacacgtactaccgcggaccgacggtccctacccgacggtccctcctcctacttcgtacggtggtacaccgtactacccgtacccggacgggtaccctcgttaaccgggtacctaccccggtacgtacccgttaacgggttacggtacggttcgggaacggttacggggggtttccggggttaccgggtaacgggggtaaaccgtaacggggtttaacctttaccccgtaccgtttaccccttaaccccgaaaccgttaccgtacccggtaacgtccccgtaaccgggtccccgtccggtaccggttaacgtttaccggtaaggtttaacgtttacgttttacggtaaccgttttaagttttaaccgtttacgtagttacgtagtaacttaaggttaactttaacgttacgttccgttactcgttcgtacgttacgggttcgggacggggtaccgtagggtagacggtacgtaacggaagtaccgggtggtaccggtacgtaccggtctacgttcgttccgttcgtaccg

SEQ ID NO: 255578 - DNA, 823 bp, Homo sapiens
  misc_feature: GYAE6OF01DW52Y.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctccaggtgccacggagaaattctgttgacacagtctccagccaccctgtctttgtctccgaaggggaagcgccctaccttctcctgcgagggccagtcagtacgttcttacgacctaccttaacgttacgccgttacggtaacccaaaacgacggaaaaccgtcggacccgaacgggtcctaccccgaaggtcccttccctactacttactactaggtactcgtacaaccgttacccggaaaaacggggccctaacggttacggaccgtaacgtaccccgaacggccgtaacgggttcgaaggtcgggacgtacggggtcgggtcgggtacgggggactacgttacgtttccaaccttccgttccaccgtactacgaacggaccgaacgtcccgtaaggaccggtacccgttaaggttaacggtttacgtttacgtacgtttaacggtttttaacttaccggttagttaccgacggtacgtacgggtccgttacgacccgttaacggtcggtcccgttaccgggttttacccgtttacggttttccgggaaccggggtacgggtaacccgttacggcgggttaacggaacggtaaccgttaacggaaacggttaaccggtgggttcgggtaccgtacgtacccgaaaccgttgttacccgttacggtttaccttccgtacgtttcccccgg

SEQ ID NO: 255579 - DNA, 692 bp, Homo sapiens
  misc_feature: GYAE6OF01E3GBN.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccgaggggaaagagccaccttctcctgcgaggccagtcagagtcttagctacctacttagcctggtaaccaaacaacgaaaccgtcggacccgaggcctacccgacggtcctccctcactctatgatcgcctaacgtacccgaaaacgggccacgtcggccacgtcccagtccgtacggttaccaggtcggcgtaggtcgggtcgtggggctacgtaccttctacctcctaccgtaccattccgagaccaacgtaccgtagaccggtaccgtaaggtaacgttagttttacgtacgtttaaggttttaactttacgttcgtacgtagtcgtacgtcgtaacgtaccgtaacgtcggtccgttaccggttcttacgttttcgggaccggttaacgggaccgtaacggtcgtacggacgtaacgtaaccgtaaacggtaacgttgggtacggtcgacgtaccctaaccgtactacgttacgttccttaccgtctttaccccgg

SEQ ID NO: 255580 - DNA, 859 bp, Homo sapiens
  misc_feature: GYAE6OF01E35SA.12.86.H09.1.454.CMB.1.raw
  modified_base (254)..(254): a, c, t, g, unknown or other
  misc_feature (254)..(254): n is a, c, g, or t
tcagatacgacgtacacgaccggtgctcgatttagtgctatagacttggggtttggggaggaactgctcagttaggacccagagggaaccatggaagcccccagctcagcttctcttcctcctgctactctggcctcccagataccactggagaaatagtgatgaagcagtctccacgcccaccctgtctgtcgtctacggaggggaacacgccctaccctctcctgcgacgggccagtcaggtagtagttaanacgcgtacttacgccgtacggtaccacgcagacgtacccgtcggacccgaggccctacccgacggtccctccgtcctacttcgtagttcggtcgcctacttacccgtaacccggacgggacccctacggttcggtaacctccccgacggtacccgtaagggtttccgaagggttcggtacgtaggggttcggggtacggtcggggaacgtaacggttacggtttaccctaccgtttaccctaccgtaaccctacgtaccgtaacgaccgaccgtacccgtacggtacctacggttaccgttaggtaaacgtttagtttcgttacgtttacgttttaactttaccgttgtttacgaacgttacgtaaagtttaaacttaaaccgtttaaccggttaccggtttaccgttacggtaccccgtttaccggttacccggggtttaaccggggggtacccgggggttaacggtaaccgggggggttaaacggtacgggtaaaacccgttaaacccgggtaaaccggttaaccggggtttacggtacgggttaccccgttaccgggtaccccaaaccggtttcccgttacccggtttcgtttaacccccgg

SEQ ID NO: 255581 - DNA, 803 bp, Homo sapiens
  misc_feature: GYAE6OF01AER92.12.86.H09.1.454.CMB.1.raw
  modified_base (242)..(242): a, c, t, g, unknown or other
  misc_feature (242)..(242): n is a, c, g, or t
tcagatacgacgtacacgaccggtgctcgatttagtgctatagacttgggtttgggagggaactgctcagttaggacccagagggaaccatggaagccccagctcagcttctcttcctcctgctactcgtcggctcccaggtcgcccgaccggagaaatttcgtgttcgacacgagtcctccacgccctacccgttgttcctttcgtcctaccggaaggggaaaacgcgccctacccttccnccgttgccgacgggccgtacgtccgaggtacgttccgttacgcctaccgttacttacggtcccgtacggtaacccaacgaacgtaaccgtcggcccgagtccctcccgaggtccttacctactaacctcttagtacgacgttggacctacgtaaccgaaacgggtcccctacggtacggacctaccgcccctaagtcccgttaggtaccgagggttacgacggtacgggtcgggtccgtacggggactacggttacctacgtccttaccgtcgaaaccttcgaaccgtcgaccgtaacccggtacgtacggtacctacggttaacgttaaggttaccgttttacgaacggtttttaacgtttaaccgtttacgttaccgttacgtaacgtccggtaacgtaccggtaccgtaccggtaaccgtccgggtttccttaacggttcccgtacgggtttccggaccggtaacgggacctaggtaccgtcggaatacggtactaacgggttgtggttacgaccgttcgaagttccgtattcccgagttcgtcttaacccggtcccg

SEQ ID NO: 255582 - DNA, 852 bp, Homo sapiens
  misc_feature: GYAE6OF01BF4D8.12.86.H09.1.454.CMB.1.raw
  modified_base (200)..(200): a, c, t, g, unknown or other
  misc_feature (200)..(200): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggcctcccaggtcgccaccggagaaattgtgttgactcagtctccagccacctgtcttgtctcgagggaangcaaccgtctctgcaggcagtcagagtgttaacagtattacgtagccttaggtaccagacgagacgaccgttggaccgacggtcctcccgacggtcctacccgtaccgtacttaccgtaaggtcggtacgacctactaccggttaacccggacgggtccctaacgttcggttaaccgtcccgaggtacccgtaggttaccgaggtcggccgtagggttcgggtccggtagggacgtaggtacccgtttaccgaccgtttccaaccgacccgttaggtacccgaacgtaccccgtaacggtccccgttaggtacccgttacggttacgggttaacgttaaaacggttcgggttttttaacgtaccgttttaacggtttttaacttcggttaacggtaccgtacgtaaccgtaaattttaacttaaaccgttacggtttacgttacccgtcgttaaccgttaccggtttaaccggggttttccgggggaacccggggtaaacggtaaccgggggtacggggtaacgttaaacccggtaaaccggtaaaacccggttcgggttagggttaaccggtaccggtaccgttaaccccggtaacccggtttattacccggttaccggtttcctttccccgttaaccgtttacccccggg

SEQ ID NO: 255583 - DNA, 877 bp, Homo sapiens
  misc_feature: GYAE6OF01D2HYE.12.86.H09.1.454.CMB.1.raw
  modified_base (213)..(213): a, c, t, g, unknown or other
  misc_feature (213)..(213): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacactagtctccagcccacccttgttcctttgtcctaccgaagggggaaacncgtccctaaccgtttcctcccgtaggccgacggggtaccctaggtaccgaacggtacggttcctttaacggacctaaccctttaaccgtttacggcccgttaacgggtaaacccaaacgaaaccggtaaaacccgttccggggacccgaacggggtccccgtaccccgaagggtccccttaccctaacgtacttacctaagttcgaacgttccggaacctaaccgtaacccggaaaaacggggtccctacggtacgggacctaccgttaccccgaacgtcccgtaacggttaccgacgggtcggtacggtacgggttcggggtaccggtggggacctacggtacctttccgaccttcgtaccacgtacgtcgaaggtccctaacggtaccgtaaggcgtacccgttaaggtaacggttttacttttacggtaaccgtttaaggttttaacttaccggtgttaaccgaacggtcgtacggttaaccgtaacgtaacccgttaaccggttccggttaacccggtttacgggtttaccttaccggggttttaccgacccggggttaaacgggacccgtaagtccgggtaaggtacgtaaccgtaacgtaaaccggtacgtcggacgtctacgacctacgtcttacgtctttcgtccgtcgttacccg

SEQ ID NO: 255584 - DNA, 889 bp, Homo sapiens
  misc_feature: GYAE6OF01C73ZA.12.86.H09.1.454.CMB.1.raw
  modified_base (166)..(166): a, c, t, g, unknown or other
  misc_feature (166)..(166): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgactanagtcctccagccacccttgttctttcgtcctaccgaaggggaaagcaccctacctttcctccgtgaccgacgggacctagtcgaggtacttaccttagcctaaccgttacttacggaccgttacggtaaacccaagtaaccggaaaccgtcggacccgacggtaccctacccgtaacggtcccttacccgtactattaccttaagtcggtatcgtaaccaacgtaaaccggaaaaccgggccgtaactcgggacctaaccgtacccgaacgtccggtacggtacggtacggtggcggtacgggttgggtcggtggggactacggtcttacgtactcctacgacctacgtcgacgacctacgtaccgtacggtactccgttaaggttacgtttaacgtttacgttaacgtttacgtttttaaccggtttattggtaaccgttaacggtcccggtaacggtttccgggtaaaccgttaccgtaccgggtttacggggtttaaccccggttttccggttttaccgggtttaccgggtttacccggggtacggtaaaccccggggggtactacgggtttaacgtaacggggtaacctaaaccgggttaaaaccgtaaaccgggttacggtaccggggttacggcccgttaccggtaacccctttaaccgggtaactttccggttttacccgttttccttaaaccctttcccgggttttaaccccccg

SEQ ID NO: 255585 - DNA, 793 bp, Homo sapiens
  misc_feature: GYAE6OF01A7Z9S.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtcgccaccggagaaattctgttgacacagtctccagcccacccttgttcctttgtctaccgaggggaaagacgccctaccttctcctgcgacgggccagtcagagttcttacgctacctacgttacgccgtaggtaaccaaacgtaacgtaaaccgtggacccaagggtcctacccgtaggccttaccctactacttctactagtactacgacgtactaacccgaaacgggcctacggtcggactaccacccgtacgccgtacggttacgaacggtcgggtacggtacggggtgggttaccggtacggggcgtaacggtcctttacccgacgttcctaccgaccgtactacgaccggtactacgtaaccgtacggtacgtccggtaagtaacggttacgtttcggtaacgtttaacgttttaagttaccgttacgtaccggtaacgtccgttaacggtacgttaacggtacgttaaacccggtcgggtaccccggttttacgggttacccgtttaacgggttttaccgggtaccgggtaaccgggtacgtaacgtccgggtaaggaacggtaacgtaaccgtaaacggtacgtcgggtaccgcgtaccgttacaaccggttctagttaccgtttctaccggttcccgttacccg

SEQ ID NO: 255586 - DNA, 707 bp, Homo sapiens
  misc_feature: GYAE6OF01E5G5U.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaagngccaccttctcctgcagggccagtcagagtcttacgcaccttacttacgcctaggtaaccaaaccgaagaaaccgtggaccacggcctcccaggccttcctcactctatgtatgacacgtaccaaaagggccacgtcggaccactcccgacgtccgaggttccaggtcggcgaggtcgggtcgttgggggctaggacctttccgaccgtcctacgtacccaagtcacggacacggtcctacggtacgacctaggtaagttagttttacgacgtttacgtttactttaacgtcggtacacgggataacggtccgttaaggacccgtaacggttcgggtcccgtttaccggggttacctttaccgggtttttccgggacccggaacgggggtaccctaacgggtcggtaggaaccgtaacggttaacccgaaaaccggtaacgttcgggtacggtccttacggaccctaccgtacttccgtttagtttcccttctaccgtttccccg

SEQ ID NO: 255587 - DNA, 899 bp, Homo sapiens
  misc_feature: GYAE6OF01BOG5X.12.86.H09.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (319)..(319): a, c, t, g, unknown or other
  misc_feature (319)..(319): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctcagccaccctgtctttgctccgaaggggaancgccacttcncctgcgacgggccagtcagtacgtcttagccacctacgttacgcctacggtaaccaacacggaaacctggaccacggcctccgaggtcctacctcgacttcctaagtnaacgtcgacaacgtaacccggaaaacggggcctacggtaccggactaaccgtaccccgtaggtaccccgtaaggggtttaccaaggggttcgggtacgtaacggggggtttccgggttaccgggtacggggggtacccttaaccgggttaacctttacccggtaaccctttacccggtacccgaaacccttacgtaacccggaacggtaccgtacggtaaacccggttacggaacccggttaccggtaaacgggttaacgtttacgttttacggtaaccggttttaaacgtttttaaccgtttacggttaccggttaacgtaacggtaccgtaaacgggttacccggtaaacgtacccggtttaaacgggtccggtttaccccggtttaccgggtttaccggtttaacccgggttttacgggaacccggggttaaccgggaaccgtaacgggtcggttaacgggaaccgttaacgtaaaccgggtaaaaccgttacggttcggttaacggtccctaacgggtacctaacccggttcgttaccgtttaccgttacccgtttacccgtcccggtttaccccc

SEQ ID NO: 255588 - DNA, 624 bp, Homo sapiens
  misc_feature: GYAE6OF01AN46P.12.86.H09.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (261)..(261): a, c, t, g, unknown or other
  misc_feature (261)..(261): n is a, c, g, or t
  modified_base (399)..(399): a, c, t, g, unknown or other
  misc_feature (399)..(399): n is a, c, g, or t
tcagatacgacgtacacgaccggtgctcgatttagtgctatagacttgggtttgggaggaactgctcagttaggacccagagggaaccatggaagccccagctcagcttctcttcctcctgctactctggctcccaggtgccaccggagaaattctgttgacacagtctccagccaccctgtctttgtctccaggggaaangccaccttcncctgcagggccagtcagagtcttagctacctacttagcctaggtaccaanagaaacctggccaggcctacccaggcctcctacatctaatgtatcgctataccaaaaggccaacgtggacctaatcccaagccaaggttcaggtcgctaggtcgggtcgtggggacagtacctcgtactctaccgacnctaccagtccacgccgtagacgtctaggaattctttagtacgtacgttttaagttactcggtaccagtcacggtctaacgcgtaaaccttcggacccttacggttacctacgtttccggaaccggtacgggaacctaggtaccgtggaacgtagtaaccgaaacgtacgttacgggctcgtcgtacgtacctacgttccgttataccgttccaacgtttaccccg

SEQ ID NO: 255589 - DNA, 896 bp, Homo sapiens
  misc_feature: GYAE6OF01A87OA.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgcccaccggagaaattctggttgacacagtcctccagcccacccttgttctttcgtctccgaagggggaaagacgccctaaccctttccttccgtgccgaggggcctacgtacaggacgttccgttagccaacccttacgttacgcccgtaggtaaccaaacgaacgaaaacccgttcggaccctacgggcccttcccgaacggtcccttcccgtaccaacttccgtaagtcgtaacgtcgacccgtaacgttaacccggaaaaacggggtcccctaaacggtcggtaacctaaccgtacccccgtaacgggtaccccgttaagggtttacccgtaagggtcgggacccggttaaggggttcgggggttaccgggtacggggggacttaacccgggttacctttacccgtaacccgttccttaacccgaaacccgttacttaccggaaccgacccgtaaccgggacccgtaacggtaaccgtacccgttaaggttaaacgttttgtttttaacgtaccgttttaagtttttaaccttaacgtttacgtaccgtaacgtaccgtaacggtaccggttaacgacccgttaacggttccggtacccggtttaccggttttacccgttaaccggttttcccgggaacccggttaaccggggaaccttaacggccggttaaggaacgtacgtaaaccgtaaacggacgttaggcgtccgtaccgaccctacgtactcttagtttcccttcgtcccttcccg

SEQ ID NO: 255590 - DNA, 867 bp, Homo sapiens
  misc_feature: GYAE6OF01CR6FF.12.86.H09.1.454.CMB.1.raw
  modified_base (141)..(141): a, c, t, g, unknown or other
  misc_feature (141)..(141): n is a, c, g, or t
  modified_base (199)..(199): a, c, t, g, unknown or other
  misc_feature (199)..(199): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtnccaccggagaaattctgttgacacagtctccagccacctgtcttgtctccgagggaanacgccaccttctcctgcgaggccagtcagagtcttagccactacttagccgtaggtaccaacgacgaaaccgtcggaccaggcctcccgaggcctccgtcatacctatggactgactactaccgaaaacggtccaacgtcggacaccgtaccccagtacccgtagggttactacggtaccggacgtacggggttcgggtccggtagggggtacacggtaccgtttccgtacgtccgtaccaccctagtccgagaccgtacgtaccgtacgacgtacccgttagggtaaacgttacgttttacgtaaccgtttaggtttttaacgttaacgttcggttaaccgtaacggtaccgtaacgggttacccgttaacggtaacccgtaacggtttaccgggtttaccccgtttaaccgggttttacccgtttaccgggttttttaccgggacccgggttaaaccgggggttaaccccgtaacgggttaccccgggttaagggtaacccggttaaaccgttaaaaccccggtaaaacggggtttaacccccggttagggggtttaaacccgggttccgttaacccggggttaacccccttacggttaaacccggtttacccggtttacccggtttaacccgttaaccccgtttacccggttttaaccccccggg

SEQ ID NO: 255591 - DNA, 970 bp, Homo sapiens
  misc_feature: GYAE6OF01A7JSQ.12.86.H09.1.454.CMB.1.raw
  modified_base (486)..(486): a, c, t, g, unknown or other
  misc_feature (486)..(486): n is a, c, g, or t
tcagatacgacgtacacgaccggtgctcgatttagtgctatagacttgggtttgggggaggaactgctcagttaggacccagaggggaaccatggaagccccagctcagcttctcttcctcctgctactctggctcccaggtgcccaccgggagaaattctgttgacacagtctccacgccaccctgtctttgtctccggaggggaaagtacgccctaccttcctccgtggcgacgggccagtcaggtacgtcctttacgccaaccttacttaccggtcccttacgggtaacccaacaaacggtaaacccgtagggacccgaacggtcccttaccccggacgggtcccttacccttaccgacttacctagttacggattcggacctaacgtaacccggaaaacggggaccccacggttacggacctaaccctcccgaaccggtccgtaggttaccgtaggtcgggacggtagggttccgggtaggngggggtacctacggttaaccttcccgtaccgtaccgtccgtaaccctacttacccggacgtacccggtaacgacccggttaacgggtaccgttacccggttaacgggtaaacggtttacggttttaaccggttaacgtttaaacgtttttacggtttaacgtttacgttaccgggtaacgtacccgggaaagggttccccgtaaacgggttaccccggttaaccggttaccggggttaccccggttttacccgggttttaccgttacccggggttttacccggggaaccccgggttaaccggggggtaaccctaaccggggtaaccgggtttaacgggaaaccggttaaaggttaaacccgggtaaaaccggttccggggtaacgggttccggggtaccgggttaacccacccgggttaaccgttaacccgtttaccggttacccggttttcccggtttaaccgtttccccggtttaacccccg

SEQ ID NO: 255592 - DNA, 776 bp, Homo sapiens
  misc_feature: GYAE6OF01C3FMZ.12.86.H09.1.454.CMB.1.raw
  modified_base (154)..(154): a, c, t, g, unknown or other
  misc_feature (154)..(154): n is a, c, g, or t
  modified_base (444)..(444): a, c, t, g, unknown or other
  misc_feature (444)..(444): n is a, c, g, or t
  modified_base (466)..(466): a, c, t, g, unknown or other
  misc_feature (466)..(466): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggcctcccaggtcgccgaccggtanaaatttctggttcgacacgtacgtcctccacgaccctaccctgttcctttgtccgtaccggaaggggaaacgcgtacccgtacccttttccgaccgtacggccggtacgggacccgtagttccgaagtaacgtttccgttaacgcctaaccttacgttacgtccgtaacggtaaccaaacgaaccgtaaaccgtccggaccacgggtccctacccgtaaggtcccttaccgtactactacgttactaggtactacggaactacgtaaaccggaaacggtccacgcgtacncctaccgacgtacgtagtacgnggtcgcgtaggttggcgtacgggactcgtactccgaactctacccgacacgtcgaacgtcgacggttcacggtactacgtaagttacgttagtttacgtacgttacgtttacgttacgtcgtaacgactcgacgtacgtacgtacgtacgtacggttccgttcggttacgttaccggtttaccggaccggttaacgggtaccgtacggtacggtacgggaataaccgtaacggtaaaccgttggtaccggtacgtacgtaccgtaccgtaccgtactccttacgtttacccttacgttcccgttaacccc

SEQ ID NO: 255593 - DNA, 726 bp, Homo sapiens
  misc_feature: GYAE6OF01BNF1Q.12.86.H09.1.454.CMB.1.raw
  modified_base (318)..(318): a, c, t, g, unknown or other
  misc_feature (318)..(318): n is a, c, g, or t
  modified_base (325)..(325): a, c, t, g, unknown or other
  misc_feature (325)..(325): n is a, c, g, or t
  modified_base (330)..(330): a, c, t, g, unknown or other
  misc_feature (330)..(330): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaattctgttgacacagtctccagccaccctgtctttgcctccgaggggaaagtacgcctaccttctcctggcgagggccagtcagagtcttagccaccttacttacgcctggtacctaacacgaaacctggaccgtacgggcctcccgaggtccctcctcgtatcttntacgtancgtanacgtaacccggaaaacggccaacgtcggaccaccgtacccgacggtaccccgtaaggtccggtaggtcgggccgtaaggggttccggggtacgtcgggggacctacggttaccttcggaaccttccgacctaacctctaccgagtaccacgtacccgtaggaccgtcgtacgaagttctttacggtaacttacgtttaattcgtacgtacgaacgtcgtacggacgtacggaccgtaaccggtcgtaacccggttcggttaccgtacgtttcccggacggttacggggacctaacggtcggtaggtaccggtaacgtaaccgtaaaccggtacggttacggacggtccgtaccgacaaccgttacgtacctagtttccgttacctaccgttacccg

SEQ ID NO: 255594 - DNA, 776 bp, Homo sapiens
  misc_feature: GYAE6OF01DYAH0.12.86.H09.1.454.CMB.1.raw
  modified_base (248)..(248): a, c, t, g, unknown or other
  misc_feature (248)..(248): n is a, c, g, or t
tcagatacgacgtacacgaccggtgctcgatttagtgctatagacttgggtttgggaggaacgtgctcagttaggacccagagggtaaccatggaacgccccagctcagcttcctcttcctcctgcctacctcgtcggcctcccaagggtcgccgaacccgggtagaaaatttccgtggttcgaaccacgtaaggtcttcccaacgcccacccgttgtttactttccgtctacccggtaaggggaaanccgtaccctaccttccgtcccgtgacccgtacgggcccaaggtcgacgtagtcttacgcctaccgttacttacgccttacggaaccaaacgacgtaaaccgtcggtaccgacggacctccgtaacggccttaccgtactagttactaagtgtaacttcgacgaactaaccggaaacgggtcctacgtcggacccactcccgtacgacgtacgtcaggtgtacgtcggtaggtccgtacggggtacctaggttacctactaccgtcaacctccgagttaccgacgtcgtacgtaccgtaacgacggtaccgtaagtacgttagtttactacgttaactttagttaaccgtaggtacctaacggtacgtaggtaaccgtagtacccgtaacgttcgtacccggtttacgttaccgttaggttaccggtaccggtacggaaccgtgtacggagtaaccgtactaacgtaaccgtagttcggtacgtacgtcgaacctacggtacttcgtattaaccctcgtacctacccgg

SEQ ID NO: 255595 - DNA, 732 bp, Homo sapiens
  misc_feature: GYAE6OF01C67Y7.12.86.H09.1.454.CMB.1.raw
  modified_base (148)..(148): a, c, t, g, unknown or other
  misc_feature (148)..(148): n is a, c, g, or t
  modified_base (222)..(222): a, c, t, g, unknown or other
  misc_feature (222)..(222): n is a, c, g, or t
  modified_base (460)..(460): a, c, t, g, unknown or other
  misc_feature (460)..(460): n is a, c, g, or t
  modified_base (544)..(544): a, c, t, g, unknown or other
  misc_feature (544)..(544): n is a, c, g, or t
tcagatacgacgtacacgaccggtgctcgatttagtgctatagacttggggtttgggggaggaactgctcagttaggacccaggagggaaccatggaacgccccagctcagcttctcttcctcctgctactctggcctcccagggtcnccgaccggtagaattctgttgacacagtcctccacgccctacctgttctttcgtacctccggaagggggaaacncgccctaccttcctccgaggcgacgggtccagtcgagtacgttcttagcctaccgttacttacggccgttacggtaaccaacgtaaccggtaactcgggaccaacgggtccctaccggacgtccttaccgtcaacttctaatcggattcggacaacgtaaccggaacggcctacgtcgaccactccgacgcgtcggtcaggtcgacgtgggtcggtgtacgggacacgtactcgtacncttaccgactagtccaagtccgacgtaccgtagtaccgtcggtaagtaagtttcttacggttattacggtttaactcgaacgtnacgtagaccgttagaccgtacgtacgttccggtcctttaggttccttaacggttcgggaaccggtacggaacttcgggtaacgacggtaacgtacgttaaacgaaaccgggttcgttggggccctacgggtacctaacctccgtttacggtaccctttaggtttacccctggttccccctttaccccg

SEQ ID NO: 255596 - DNA, 762 bp, Homo sapiens
  misc_feature: GYAE6OF01C8Y4S.12.86.H09.1.454.CMB.1.raw
  modified_base (230)..(230): a, c, t, g, unknown or other
  misc_feature (230)..(230): n is a, c, g, or t
  modified_base (246)..(246): a, c, t, g, unknown or other
  misc_feature (246)..(246): n is a, c, g, or t
  modified_base (510)..(510): a, c, t, g, unknown or other
  misc_feature (510)..(510): n is a, c, g, or t
  modified_base (596)..(596): a, c, t, g, unknown or other
  misc_feature (596)..(596): n is a, c, g, or t
tcagatacgacgtacacgaccggtgctcgatttagtgctatagactttggggtttggggaggaactgctcagttaggacccagagggaaccatggaagccccagctcagtcttctcttcctcctgctactctggcctcccagggtcgaccgaccggaataaacttcttgttgacacgtacgtcctccacgccctaccttcgtttctttcgccgtaccggaaggggaaacnccgtcctacccttccnccgtgcgacggccagttcgacgtacgttacttacgacctaaccttacgttacgtacccgttaccggtaaacaacgtaaccgaaccgtcggacccgtacgcccgtacccgacggtccttcctactacttactaagtcgtatcgaactaacggtaaccggaaccgtcgtaactcggaccaaccgtcccgacggtaccggagtttcggacggtcggtaggtaccggggttggtacggcgggtaactacgttacgtcctacgctaccntaacgctcggacacgtacgtagactacgtagtacgttagttcgttacttagttacgttacgtacgtacgagcgtacggtagtaccncggtacgttccggttacgtttaccggtccgtttaccgttacggaccggtaacggttaaccgacggtgaacggtactaaacgaacgtaaaccggtacggttaggtacctccgttacgtacccgacccgtttaagttcccgttatttccttaacgttcccgtttaccg

SEQ ID NO: 255597 - DNA, 871 bp, Homo sapiens
  misc_feature: GYAE6OF01B739B.12.86.H09.1.454.CMB.1.raw
tcagatacgacgtacacgaccggtgctcgatttagtgctatagacttgggtttggggaggaactgctcagttaggacccagagggaaccatggaacgccccagctcagcttctcttcctctgctactctggctccaggtcgccaccggagtaattctgttgacacagttctccacgccctaccttgttccgtttgtcctaccggaaggggaaacacgtccctacctttcgtccgtgacggacggccagtcgaagtacgttacttacgacctaaccttaacgtacgtccgttacggaaaccaacgtaacgtaaaccgtcggacccgtacgggacccttacccggaggtccctaccgtacgtacgttactaagtggtaactcgtaactaacgtaaccggaaacggccctagtccggacctacctaccggacgtaccggttacggttacgacggttacggacggtacgggggtttcggtacgggttacggggaacttacggttaccctcgtaaccgttaccgtaaccgacttaaccgtcggaacgtaccgaacggtaccgttaacggccgtaacggtttagtaaaccgtttcgtttttaaacggtaccgtttaaggttttaacgtacggttacgttaacaacggttcgacggttaaccggtacgtaaccgtacgggtttccggttaccgtttaccgggttttaccggttaaccgggttttacccggggaccgttaaccggggtaactacggttaaccgggtacggtaaaaccgtactaaaaccgggtaaccgttacggtacggttaacgtccttacccgaacccgtacgtttaccgtacgtttacccttacttaacccggtccttaacccccgg

SEQ ID NO: 255598 - DNA, 858 bp, Homo sapiens
  misc_feature: GYAE6OF01E40SM.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctgcctccaggtcgccgaccggagtaaattctagttcgacacagtcctccagccctaccttgttcctttgtcctaccggaaggggaaagtccgtcctacccgtttcctccgtcggaccgacgggtacccaggttcaaacggttcttaccgttacacctaaccgtttacgtaccgtccgttaccggaacctaaaaccgacggtaaaccgtcgggaccgtacggtacccgtacccgtacgggtcccttacccgtactaacttaccgtagtagtacgttcgacccgtaaacgttaacccgaaacgggtaccctacggtaccggacctaaccgtccccgacgtaccggtacggtttacgacggtacggtcgtaggggtcgggtccggtacggggtactacggtaccttccgtacctccgtacaccgtactacggacgtacgtaccgcttacgggaactccggttaacgtaacgtttactttacggtaacgtttaacgttacgttactacgtacgtacgtacgtacggtacgtaccggtacgtcgtacccggttcggttaccgtttaccggtaccgggtttaccgaccgggtaacgggaccgacggtacgggtaacggtaaacggtaccgtaaacccggtaaggttacggttaccggtcgggtaccgtttacggaacccgttacccgttacgttaccgttccggttaaccctttaccggacccgttttaccccccg

SEQ ID NO: 255599 - DNA, 752 bp, Homo sapiens
  misc_feature: GYAE6OF01CJA4N.12.86.H09.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctccaggtgccaccggagaaattctgttgacacagtctcagccaccctgtctttgctccgaaggggaancgcctaccttcncctgcgagggccagtcagagtcttagctacctacttagcctggtaaccaacgacgtaaaccgtcggaccgacggcctccgacggtccttcccgtacattctaatcgtatcggactaacgtaacccggaaaacgggccctaacgtcgggacctaacgtccccgaggacccgtagggttccaggtacgggcgtagggttgggtcggtagggggctacggtacctttcgtaccgtcgtaccacctacgtcgacggacgtacgtacccggtaacggacggtaccgttaggtaagtttcgttttacgtacgttaattttacgttacgttacgtcgtacggactaacggtacggttaacgtacgtaaccgggttcggtaccgtttcggtttaccgttacgggttttaccgggaccgggtaacgggtaaccgtacggtacggtacgggtagtaaaccggtaaccgtaaacgggtaccgttagggaccggtcgttcgaacccgttacctacgtttccgtacggtttccttcgttaacccgttccccgg

SEQ ID NO: 255600 - DNA, 728 bp, Homo sapiens
  misc_feature: GYAE6OF01BSPT2.12.86.H09.1.454.CMB.1.raw
  modified_base (138)..(138): a, c, t, g, unknown or other
  misc_feature (138)..(138): n is a, c, g, or t
  modified_base (167)..(167): a, c, t, g, unknown or other
  misc_feature (167)..(167): n is a, c, g, or t
  modified_base (209)..(209): a, c, t, g, unknown or other
  misc_feature (209)..(209): n is a, c, g, or t
  modified_base (222)..(222): a, c, t, g, unknown or other
  misc_feature (222)..(222): n is a, c, g, or t
  modified_base (309)..(309): a, c, t, g, unknown or other
  misc_feature (309)..(309): n is a, c, g, or t
  modified_base (318)..(318): a, c, t, g, unknown or other
  misc_feature (318)..(318): n is a, c, g, or t
  modified_base (348)..(348): a, c, t, g, unknown or other
  misc_feature (348)..(348): n is a, c, g, or t
tcagatacgacgtacacgaccggtgctcgatttagtgctatagacttgggtttggggaggaactgctcagttaggaccagagggaaccatggaagcccagctcagcttctcttcctctgctactctggctccaggtcnccgaccggataaatttctgttagacacgngtctccagccctaccttgttactttcgctaccgaaggggaancgacctaccttcnccgtgcagggccagtcagtgtcttagactacttactcgctacggtaaccaagacgaacgtcgaccgacggcctaccgaggcttccanacttctatnattcactataacgaacggtcagtcggaccnctacacgacgtagtacaggtcgtacgtacgtggacgagggtacagtacctcgactcgtacacctatacgagacgtacgacgtaacgtacgtaccgtagttaacgtttagtttacgtacgtttaacggtttattacgtacgtaactagtacgtaacgacggttacgtacgtaacgttcggtaaccgttaccggttaccttaacgggtttaccggaaccggttaacggggtaacccacgggtttacgaacggtaacggttaaaccgtaaccggtaaaacggttaaccgtacgggttaccgttaaccgggtaccctaccccgttaaaaccgttctttacccggtttacccgttaacgtttccccgttaacgtttaccccccgg

SEQ ID NO: 255601 - DNA, 1008 bp, Homo sapiens
  misc_feature: GYAE6OF01DM2FF.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctccaggtgccaccggagaaattctgttgacacagtctcagccaccctgtctttgtctccgaaggggaaacaggcctaccttctccgtgcagacgccagtcagacgtcttacgctacctacttacgcctacggtaccaacgaacgtaaacctggacctacgggcctaccccgaacggtcctcctactacgtactactcgaacgttcggacctaacgttaacccggaaaaacgggggtcccctaacggttcggggacctaaaccttcccccggaaacgccccgttaacggggtttacccaagggtttccgggaaccgttaggggttcgggggttccggttacgggggggacccttaacgggtacccttttacccggaacccgtttcccgttacccgaaaccctagtttacccgaaacggacccgtaaacgggtaccccgttaacgggaacccggttacccggttaaggaaaacgggttttacgttttttacggaacgttttaacggtttttaacctttaccgttacgggttttaccgaaggtacccgttaacgggttaccccgggttaaacggtaccccgtttaaacggggttccccggggtttacccgttttaacccggggtttttaccccggttttaaacgggttttaccccgggggaaccccggttaaacccggggggggttaacccctaaagggggtaccccggtttaaacgggggtaaaccggttaaaccggttaaaaaccgggtaaaaccccgggttaaacggttccgggggtttaaccgggtacccgttaacggggtaacccccttaacccgggttaaaacgttttccccggtttaaacggttttaacccctttcccggttaaaccccccg

SEQ ID NO: 255602 - DNA, 992 bp, Homo sapiens
  misc_feature: GYAE6OF01CDZ91.12.86.H09.1.454.CMB.1.raw
tcagatacgacgtacacgaccggtgctcgatttagtgctatagacttggggtttggggaggaactgctcagttaggacccagagggaaccagtggaagccccagctcagcttctcttcctctgctactctggctccaggtgccaccggataaattctgttagacaactgtctaccacgcctacccgttgttctttagtccgtaccggaaggggtaaacgacgtaccctacctttcgtccgtgaccggacgggacctacgtacgaggtaacgttcgttacgacctaccgttacgttacgtacctacggtaaccaacgaacgaaccgtcggcccgacggtcctacccgaggtaccttaccctacgtaactcgttatacgtacgtacgacctaaccgtaaccggaaccggtaccgccgtacggtaccaccgtacccgacggtacccgttggttacggacgggtacggtaccggtggggtcggtccgggtacggggtaacctaagttcccgtttaccgtacccgttatacccccgaaccgtagtccgtaccggacccgtaaccggtaacggttaccgtaacgggtacccgttaagtttaacggttaaaacggttttcggtttaccgtttaacggtttttaaacggttttaacccgtttaacggttaacggttacccgggtacgtaaacggtttaccgggggtaaacccgttttaaccggaaccgggtttaccgggttaaccggtttccccgggttttaacccgggttttaacccgggttttaccggggtttaacccggggtaaccccgggggtaaaccccgggggttaagtaaaccggggtttaccggggtaaaccgggttaaaccgttaaaacccggtacgggtaaaacccgggtttaaagggtcccggggttaaacccgtcgggaccccttaacggtttaaaccccgtacttttacccgtttacccggttaaccgtttacccgttaacccccgg

SEQ ID NO: 255603 - DNA, 715 bp, Homo sapiens
  misc_feature: GYAE6OF01EYNEN.12.86.H09.1.454.CMB.1.raw
  modified_base (210)..(210): a, c, t, g, unknown or other
  misc_feature (210)..(210): n is a, c, g, or t
  modified_base (251)..(251): a, c, t, g, unknown or other
  misc_feature (251)..(251): n is a, c, g, or t
  modified_base (452)..(452): a, c, t, g, unknown or other
  misc_feature (452)..(452): n is a, c, g, or t
  modified_base (492)..(492): a, c, t, g, unknown or other
  misc_feature (492)..(492): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtcgccgaccggagaaatttctgttgacacagtctccacgccacccttgtctttagctccgaaggggaaacngccctaccctctcctgcagggccagtcagacgttgtttaanagtaccgtacttacgccgtaggtaaccagcgaagtacttaccgtcggccctacggcccttcccgaaggtccttccctacacttcttaagttcggtgtacctacgttccgtaaccggacggtcctacgttggtaacctccccacggtccgtaggttcgacgggtcggccgtaggttcggtcgtcggacgaggtcgtttaccncgtccgtaccacctatcacgacgacgtctcgtctacgttntaggactttacgtttagacttttagtttacttcgtacgttacgacgtacgtaaagtttaagtaaccgtcgttaccggttcgtcggtacttaccgggttacgggtttaccgggggacggggtaaccgtaagggttacggaacgttacgtaaacggtaacggttacggtggtacggtcgtacaccgtaccttacgttacttccgttacttccgtacgttaccccg

SEQ ID NO: 255604 - DNA, 525 bp, Homo sapiens
  misc_feature: GYAE6OF02IZN6R.12.86.H09.1.454.CMB.1.raw
  modified_base (202)..(202): a, c, t, g, unknown or other
  misc_feature (202)..(202): n is a, c, g, or t
  modified_base (389)..(389): a, c, t, g, unknown or other
  misc_feature (389)..(389): n is a, c, g, or t
  modified_base (473)..(473): a, c, t, g, unknown or other
  misc_feature (473)..(473): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaacagaaacctggccaggctcccaggctcctcatctatgatacattgaagagggccactggcatctcaggcagattcaatggcagtgggtctggggacagacttcactctcaccctcaccagccctagacncctgaagtagttttggaatttattactgtcaacagcgtagcaactggccctccacgtttcggcggtagggaccaagggtgaagntacgaacgaactgtggctgaccacgtatcctgtcttcatccttcccgcatcg

SEQ ID NO: 255605 - DNA, 509 bp, Homo sapiens
  misc_feature: GYAE6OF02GFZGV.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaangccaccttctcctgcagggccagtcagagtcttagcacctacttagcctggtaccaacagaaacctggccaggctcccaggctcctcatctatgatgcatccaaaagggccactggcatcccagccaggttcagtgcagtggtctggggcagacttcactctcaccatcagcagcctagagcctgaagtatttgctagtttattactgtcagcagcgtagcaactggcctcggttctacgttttggccgtaggggaccaagctggagatacgaacgaactgtaggctgcaccatctgtcttcattcc

SEQ ID NO: 255606 - DNA, 504 bp, Homo sapiens
  misc_feature: GYAE6OF02GWNEE.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctccaggctcctcatctatgatgcatccaaaagggccactggcatcccagccaggttcagtgcagtggtctggggcagacttcactctcaccatcagcagcctagacgcctgaagtattttgctagtttattactgtcagcagcgtagacaactggcctcgttctactttggcctaggggaccaagctggagatacaacgactgtgctcgcacatctgtctcatcccg

SEQ ID NO: 255607 - DNA, 500 bp, Homo sapiens
  misc_feature: GYAE6OF02FGVX8.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctactcagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagatttgctagtttatactgtcagcagcgtagcaactggcctcggtctacttttggccagggaccaagctggagatcaaacgactgtggctgcaccatctgtcttctac

SEQ ID NO: 255608 - DNA, 512 bp, Homo sapiens
  misc_feature: GYAE6OF02HRUMU.12.86.H09.1.454.CMB.1.raw
  modified_base (202)..(202): a, c, t, g, unknown or other
  misc_feature (202)..(202): n is a, c, g, or t
  modified_base (509)..(509): a, c, t, g, unknown or other
  misc_feature (509)..(509): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaacagaaacctggccaggctcccaggctcctcatctatgatgcatccaaaagggccactggcatcccagccaggttcagtggcagtggtctggggcagactttcactctcaccatcagcagcctagacgcctgaagtatttgctagttattactgtcagcagtcgtagcaactggcctcggttctacgttttcggccgtacggggaccaagcgtggagatacaacgactgtggcgtgcacatctgtcttcntcc

SEQ ID NO: 255609 - DNA, 563 bp, Homo sapiens
  misc_feature: GYAE6OF02HL8QC.12.86.H09.1.454.CMB.1.raw
  modified_base (395)..(395): a, c, t, g, unknown or other
  misc_feature (395)..(395): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagtnttttgctagtttattactgtcagcagcgtagcaactcggccttcggttcctacgttttcggccgtacgggggtaccaaggccgtagggacgacgtaccgaaaaccggtaactacggtcgggacttcgacctaccgtaacgttccgttagttccttccgtatttccccg

SEQ ID NO: 255610 - DNA, 502 bp, Homo sapiens
  misc_feature: GYAE6OF02F2IRK.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaacagaaacctggccaggctcccaggctcctcatctatgatgcatccaaaagggccactggcatcccagccaggttcagtggcagtggtctggggcagactcactctcaccatcagcagcctagagcctgaagatttgctagtttattactgtcagcagcgtagcaactggcctcggttcacttttggccgagggaccagctggagatcaaacgaactgtggctgcgacactctgtcttcatcc

SEQ ID NO: 255611 - DNA, 520 bp, Homo sapiens
  misc_feature: GYAE6OF02G7PND.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtactcccagccaggttcagtggcaggtgggtctggggacaggagttcactctcaccatcagcagcctgcagtctgaagtatttgctagtttattacgtgtcagcagtataataacttgttctgctctacgttcgggacgggaccagggtggagtagtacgaaacgtactggtgctgacctactagtcttgtccttactacg

SEQ ID NO: 255612 - DNA, 507 bp, Homo sapiens
  misc_feature: GYAE6OF02HVY7U.12.86.H09.1.454.CMB.1.raw
  modified_base (388)..(388): a, c, t, g, unknown or other
  misc_feature (388)..(388): n is a, c, g, or t
  modified_base (484)..(484): a, c, t, g, unknown or other
  misc_feature (484)..(484): n is a, c, g, or t
  modified_base (493)..(493): a, c, t, g, unknown or other
  misc_feature (493)..(493): n is a, c, g, or t
  modified_base (496)..(496): a, c, t, g, unknown or other
  misc_feature (496)..(496): n is a, c, g, or t
tcagatacgacgtacacgaccggtgctcgatttagtgctatagacttgggtttggggaggaactgctcagttaggacccagagggaaccatggaagccccagctcagcttctattcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagcccaggttcagtggcagtggtctgggggcaggactttcactctcaccatcagcagcctagngcctgaagattttgctagttattactgtctagcagcgtagcaactggcctcggttctactttggcctagggaccaagctggagatcaaacgactgnggctgcacntcngtcttcattcc

SEQ ID NO: 255613 - DNA, 533 bp, Homo sapiens
  misc_feature: GYAE6OF02I5J59.12.86.H09.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttcncctgcagggccagtcagagtcttagcacctacttagcctggtaccaacagaaacctggccaggctcccaggctcctcatctatgatgcatccaaaagggccaactggcactcccagccaggttcagtggcaggtggtctggggacagtacttcactctcaccatcagcagcctagacgcctagaagtatttgctagtttattactgtcagctagtataatactgttctgtctctacgttcgggcggggtaccaagggtcggagtactacgaacgtacgtggtggctagcacctatctcgttcttctacttcctcccgtcc

SEQ ID NO: 255614 - DNA, 532 bp, Homo sapiens
  misc_feature: GYAE6OF02HERVA.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagcgcagcttctcttcctcctgctactctggctcccagataccactggagaaatagtgatgaagcagtctccagccaccctgtctgtgtctccaggggaaanagccaccctctcctgcagggccagtcagagtgttaatagcgacttagcctggtaccagcagatacctggccaggctcccaggctcctcatctatggtgcatctaccagggccatggtactcccagccaggttcagtggcaggtgggtctgggacaggtagttcactctcaccatcagcagcctgcagtctgaagtattttgctaactttattactgtacaacagacgtaactacgttacccctccgtacgtttcgggacggtaacgggaccgaagggtggaagactacgaaacgtacgtgtcggctgctacactctcgtcttcattcccg

SEQ ID NO: 255615 - DNA, 519 bp, Homo sapiens
  misc_feature: GYAE6OF02GY96I.12.86.H09.1.454.CMB.1.raw
  modified_base (422)..(422): a, c, t, g, unknown or other
  misc_feature (422)..(422): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctccaggctcctcatctatgatgcatccaaaagggccactgcatcccagccagttcagtgcagtggtctggggcagacttcactctcaccatcagcagcctagagcctgaagtattttgactagtttattactgtcagcagcgtancaactgcctcgttctacgtttggaccagggaccaagccgagactacgaacgacgtgtaggactgaccacgactactgtccttactactcgttccccg

SEQ ID NO: 255616 - DNA, 562 bp, Homo sapiens
  misc_feature: GYAE6OF02JHG1S.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctccaggctcctcatctatgatgcatccaaaagggccactggcatcccagccaggttcagtggcagtggtctggggcagacttcgactctcaccatcagcagcctagagcctgaagtattttgctagtttattactgtcagcagcgtagcaactggccttcggttcctacgttttcggccgtaacggggaccctaaggcgttagggatacgtacgaaacggtaacgttggtacggtctacggaccgaacccgtagttccgttacggttccttaccgtatttccccg

SEQ ID NO: 255617 - DNA, 512 bp, Homo sapiens
  misc_feature: GYAE6OF02FXT1R.12.86.H09.1.454.CMB.1.raw
  modified_base (507)..(507): a, c, t, g, unknown or other
  misc_feature (507)..(507): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtggtctggggcagacttcactctcaccatcagcagcctagagcctgaagtattttgctagtttattactgtcagcagcgtagcaactggcctcggttctacttttggccgtagggaccaagcgtggagatacgaaacgtactggtggctgcacatctgtcttcnttccg

SEQ ID NO: 255618 - DNA, 523 bp, Homo sapiens
  misc_feature: GYAE6OF02GC40W.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtggtctggggcagacttcactctcaccatcagcagcctagagcctgaagtattttgctagtttattactgtcagcagcgtagcaacctggccttcggttctacttttcggccgtaggggaccaagcgtggagatacgaacgtaactgtcggctcgacaccattcctgtcttcacttcccg

SEQ ID NO: 255619 - DNA, 552 bp, Homo sapiens
  misc_feature: GYAE6OF02GOR0O.12.86.H09.1.454.CMB.1.raw
  modified_base (399)..(399): a, c, t, g, unknown or other
  misc_feature (399)..(399): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtggtctggggcagacttcactctcaccatcagcagcctagacgctgaagtatttgntagtttattactgtcagcagctagcaactggcctcggttctacgttttggaccgaggggtacccaaggtctagggagacgtacgaaaccggtaactaggtcggccttaggacctaacccgtattccgttacgttacctttacgtatttccccg

SEQ ID NO: 255620 - DNA, 539 bp, Homo sapiens
  misc_feature: GYAE6OF02GXURU.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagactttcactctcaccatcagcagcctagacgcctgaagtatttgctagtttattactgtcagcagcgtagcacgtcggccttcggtttcaccgttttggaccgtacggggaccaaggcgtaggagagtacgaaacggactaggtacggcgtacgcacctagtccttgttccttacattcccg

SEQ ID NO: 255621 - DNA, 609 bp, Homo sapiens
  misc_feature: GYAE6OF02JH04X.12.86.H09.1.454.CMB.1.raw
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (256)..(256): a, c, t, g, unknown or other
  misc_feature (256)..(256): n is a, c, g, or t
  modified_base (278)..(278): a, c, t, g, unknown or other
  misc_feature (278)..(278): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccacctgtctttgctcaggggaaangccacttncctgcagggccagtcagacgtcttagcacctacttagcctggtaccaangaacctggccagctccagctcncatctatgatcgctactaccaaaagggtccagtcggcactcccgagtacccaggttcaacggtggaccgtaggtcggtcgtagggggcacggtactttcacgttctacacctatcgacgctagcctagacgtcgtagaagttcttagacttagtttactaacgtcggtactacgtctacggtcgtagtacctacgtcggtaccgttcggtttacctacggttttcggaccgtaggggtaccacggttcgtacggaacgtactaccggaaacgtacggttagtcgggtactacggactacgtacttcgtacgttactttacacgtttacccg

SEQ ID NO: 255622 - DNA, 532 bp, Homo sapiens
  misc_feature: GYAE6OF02HJ0UL.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtggtctggggcaggacttcactctcaccatcagcagcctagacgcctagaagtattttgctagtttattactgtcagcagcgtagcaacgtggccgttcggttctacgttttcggccgtacggggaccgaagcgtggagacgtacgaaacgtaacgtggtaggctcgcacactctgtcttctattcccg

SEQ ID NO: 255623 - DNA, 599 bp, Homo sapiens
  misc_feature: GYAE6OF02I2EF0.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcataccaaaagggccacgtggcactcccagcccaggttcagtcggcaggtgggtctgggggcaggacttcactctcaccatcagccagcctagacgcctagaagtattttgacttagtttactttacgtcgttacacggtacaggtccgtaagaccgtaaacgttccggtccgttaccgggtttcctacggtttttcgggacccgtaacgggggtaacaacggtcgttgggaagacttacgaaaacggtacgttaggtcggaccgtcgaccgactctcgttacgtctttacacttcccg

SEQ ID NO: 255624 - DNA, 521 bp, Homo sapiens
  misc_feature: GYAE6OF02FP0IN.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagtattttgctagtttattactgtcagcagcgtagcaactggcctcggttctacgttttggccgtacggggaccaaggcgtaggagatacaacggaacgtagtggctgacaccatctgtcttcattcccg

SEQ ID NO: 255625 - DNA, 666 bp, Homo sapiens
  misc_feature: GYAE6OF02IPK1A.12.86.H09.1.454.CMB.1.raw
  modified_base (172)..(172): a, c, t, g, unknown or other
  misc_feature (172)..(172): n is a, c, g, or t
  modified_base (233)..(233): a, c, t, g, unknown or other
  misc_feature (233)..(233): n is a, c, g, or t
  modified_base (291)..(291): a, c, t, g, unknown or other
  misc_feature (291)..(291): n is a, c, g, or t
tcagatacgacgtacacgaccggtgctcgattttagtgctatagacgttagggtttggggaggaacttgctcagttacggacccaggagggaaccatcggaaggccccagctcagcttcctcgttccgtcctggctacgtctgggcctccaggtcgcaccggaggaaattcngttgacacagtctccaggccacctgtactttgtcctccgaggggaaagcgccaccgtttcnccgtgccacgggccaggtcacgagttcttagcacctacgttggccctaggtaccaacncgtaaacctggaccaacgggcctacccgagggcctccctacgatcgtaactggaagttgcgaacttacccgaaaaaggggccaacgtcggacgaccgtcccgacggcccgaggttccaggtcggcgacggtcggtcgtggggcacgactttcgactctcacgatccacgcgacgtcctagcgacctgaacgtagttttgcgtagtttactaccgtgtacgacgacacgcgtacgactacgtcgtcgtcggttcgtactttcggaccacggggtaccacggtcgtagggacgtacgtacgaaaccggaacgttacggtacggtccgtacggtaccaaccgtacgttacgtacgttaccgtttacctacgttccccg

SEQ ID NO: 255626 - DNA, 526 bp, Homo sapiens
  misc_feature: GYAE6OF02FYPGV.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtggtctggggcagacttcactctcaccatcagcagcctagagcctagaagattttgctagtttattactgtcagcagcgtagcaactcggcctcggttcacgttttcggccgtaaggggaccaagcgtaggagtagtacaaacgtaactagtggctcgacaccatccgtgtcttcctattccc

SEQ ID NO: 255627 - DNA, 552 bp, Homo sapiens
  misc_feature: GYAE6OF02JRZIM.12.86.H09.1.454.CMB.1.raw
  modified_base (202)..(202): a, c, t, g, unknown or other
  misc_feature (202)..(202): n is a, c, g, or t
  modified_base (404)..(404): a, c, t, g, unknown or other
  misc_feature (404)..(404): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaacagaaacctggccaggctcccgaggcctcctcatctatgatgcataccgaaaagggccacgtggcactcccagccagttcagtggcaggtggtcgtggggcaggtacttcacgtctacacatcagcagcctagcgcctgaagtntttgacttagtttatactgtcagacagtcgtagcctaacgtcgccttcggttctacgtttcggaccgtaagggaccagtcgtaggactagtacgaaacggtacgtagtcgcgtacgacgaccgtatccttcgtactcctacgttcccg

SEQ ID NO: 255628 - DNA, 508 bp, Homo sapiens
  misc_feature: GYAE6OF02HPZII.12.86.H09.1.454.CMB.1.raw
  modified_base (263)..(263): a, c, t, g, unknown or other
  misc_feature (263)..(263): n is a, c, g, or t
  modified_base (412)..(412): a, c, t, g, unknown or other
  misc_feature (412)..(412): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtatcagganaaacctggccagactcccagacttctcatctatgctgcatcctccaggtccactgacatcccagacaggttcagtggcagtgggtctgggacagacttcactctcacatcaccagactgcagtctgatgtatttgctactttattactntacagcatataataagttcgcctcggagtactaccgttcggcagggaccaagctaggagagtacaacgaacgtgtagctggccaccatcgtattcc

SEQ ID NO: 255629 - DNA, 530 bp, Homo sapiens
  misc_feature: GYAE6OF02HJ3TU.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaacagaaacctggccaggctcccaggctcctcatctatgatgcatccaaaagggccactgacatcccagccaggttcagtggcagtggtctggggcagacttcactctcaccatcagcacgcctagacgcctagaagtattttgctagtttattactgtcagtcagcgtagcaactggcctcggttctacgttttgggcctacggggaccaaggcgtaggagatacgaacgtaacgtggtacggctgcaccgtatcttgtcttcacttcccg

SEQ ID NO: 255630 - DNA, 561 bp, Homo sapiens
  misc_feature: GYAE6OF02FMKNU.12.86.H09.1.454.CMB.1.raw
  modified_base (202)..(202): a, c, t, g, unknown or other
  misc_feature (202)..(202): n is a, c, g, or t
  modified_base (405)..(405): a, c, t, g, unknown or other
  misc_feature (405)..(405): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaacagaaacctggccaggctcccaggctcctcatctatgatgcataccgaaaagggccactggcatcccagccaggttcaggtggcaggtgggtcgtggggcaggtactcgactctcaccatcacgcagcctagacgcctagaagtnttttgcttagtttattacgtgtcagcagcgtagacaacgtcgcccgttcggttctacgttttggaccgacggggtaccaggtcgtaggagagtacgaaacgtaactggtacggtctcggctaacctacgttccgttagttccttactacttccccg

SEQ ID NO: 255631 - DNA, 530 bp, Homo sapiens
  misc_feature: GYAE6OF02IDZL4.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaacagaaacctggccaggcctcccaggctcctcatctatgatgcatccaaaagggccactggcatcccagccaggttcagtgcagtggtctggggcagacttcactctcaccatcagcagcctagagcctgaagtattttgctagtttattactgtcagcagcgtagcaacgtggccttcggttctacgttttcggccgtacgggaccaggcgtaggagtagtacgaaacgtaacgtggtacggctcgacacctatcgtgtcttcattcccg

SEQ ID NO: 255632 - DNA, 547 bp, Homo sapiens
  misc_feature: GYAE6OF02HI6G3.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcataccaaaagggccactggcatcccagccaggttcagtggcaggtgggtctgggggcaggactttcactctcaccatcagcagcctagagcctgaagtattttgctagtttattactgtcagcagcgtagcaacgtggccttcggttctacgttttggccgtacggggaccaaggcgtggtagacgtaacgtaaacggaacgttggtcggtactcgacaccgtactcgttcgtacttctattcccg

SEQ ID NO: 255633 - DNA, 516 bp, Homo sapiens
  misc_feature: GYAE6OF02GJ2UD.12.86.H09.1.454.CMB.1.raw
  modified_base (202)..(202): a, c, t, g, unknown or other
  misc_feature (202)..(202): n is a, c, g, or t
  modified_base (501)..(501): a, c, t, g, unknown or other
  misc_feature (501)..(501): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaacagaaacctggccaggctcccaggctcctcatctatgatgcatccaaaaagggccactggcatcccagccaggttcagtggcagtgggtctgggggcagacttcactctcaccatcagcagcctagagcctgaagtattttgctagtttattactgtcagcagcgtagcaactggcctcggttctacgttttggccgtaggggaccaaggcgtaggagatacaacgaactgtggctgcacntctgtcttcattccg

SEQ ID NO: 255634 - DNA, 517 bp, Homo sapiens
  misc_feature: GYAE6OF02H799S.12.86.H09.1.454.CMB.1.raw
  modified_base (300)..(300): a, c, t, g, unknown or other
  misc_feature (300)..(300): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctgtgtctccaggggaaagagccaccctctcctgcagggccagtcagagtgttaatagcgacttagcctggtaccagcagatacctggccaggctcccaggctcctcatctatggtncatctaccgagggccacgtggtatcccagccaggttcagtggcaggtgggtctgggacagagttcactctcaccatcagcagcctgcagtctagaagtatttgctagttttattactgtcagcagtaataattaacttgttctgtctctacgtttcgggcggggtaccaggtgagtatacgaaacgaactggtaggctgacacattctgttctctac

SEQ ID NO: 255635 - DNA, 598 bp, Homo sapiens
  misc_feature: GYAE6OF02G6PM9.12.86.H09.1.454.CMB.1.raw
  modified_base (203)..(203): a, c, t, g, unknown or other
  misc_feature (203)..(203): n is a, c, g, or t
  modified_base (366)..(366): a, c, t, g, unknown or other
  misc_feature (366)..(366): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagngccaccttctcctgcagggccagtcagagtcttagccaccttacttagcctggtaccaacacgaaacctggccaggcctcccgaggcctcctcatctatgatgcataccgaaaagggccacgtggccactcccagccctaggttcaggtggcaggtcggtcgnggggcagactttcactcacaccatcagcacgtcctagacgcctagaagttattttagcttaagtttattacttggtctagtcagtacgtagacgtaacgttcggtcccgttcggtttacctaccgtttttcgggacccggtaggggtaaccctaacggtcgtacggaagtactacgaaacggtactaggtcggcgtacgactacctcgtcttacggtcttctaccgttcccg

SEQ ID NO: 255636 - DNA, 561 bp, Homo sapiens
  misc_feature: GYAE6OF02JUSN1.12.86.H09.1.454.CMB.1.raw
  modified_base (438)..(438): a, c, t, g, unknown or other
  misc_feature (438)..(438): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccaggcaccctgtctttatctccaggggaaagagccaccctctcctgcagggccagtgagaatgttaacaacagtatactcgcgtcgtaccgacgcgacgaaacgtacgtcgacgacgtccacgcgtcctcatagtacgttacttccacgacgacggaccgacctggtcgactacccacgacacggtcgtactcggcgagtggtcgtcggacgagacgttctactctcaccatacaccagaactcggagcctgaagtaatttgcagtntattattncgagngcgtatggtgcgcacgtacgtacttttggcgacggttcgaagcgtacggagatacggaaacgtaacgtgtgagtcgcaaccgattcgtgtactttcgacttccttcccgg

SEQ ID NO: 255637 - DNA, 669 bp, Homo sapiens
  misc_feature: GYAE6OF02IGEWP.12.86.H09.1.454.CMB.1.raw
  modified_base (203)..(203): a, c, t, g, unknown or other
  misc_feature (203)..(203): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccgaggggaaanagccaccttctcctgcagggccagtcagagtcttagcacctacttagcctggtaccaacagaaacctggccaggctcccaggctcctcatctatgatgcataccaaaagggccactggacatcccagccaggttcagtggcaggtggtctggggacaggactttcgactctccaccctcacccacgcctagacgcctaggaagtgtttttaggaattttagttactgtactaactagtacgttacgacctaacgtcggtaccctacccgtaccgtttccgggacgggtaacggggacccgtaaggggtacggaacggtacgttaaccggaaacggtccggtaaacgttcgggtacggggtaccttcggaacccgtaacccgtaagttcccgtttaccggtttaccgttttaccgtaaccgttttccccgtttaccccccggtaccttaccgtttaccgttaaccgg

SEQ ID NO: 255638 - DNA, 569 bp, Homo sapiens
  misc_feature: GYAE6OF02J1S9K.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaangccaccttctcctgcagggccagtcagagtcttagcacctacttagcctggtaccaacagaaacctggccaggcctcccaggctcctcatctatgatgcatccaaaagggccacgtggcactccagccaggttcagtgcagtggtctggggcagacttcacgtctcaccatcacgcacgtcctaagcgcctagaacgttatttagacttaggtttacttacgtgtacagtacgtagcgtagcaacgtgtccgttcggttctacgtttcggaccgtacgggacctaacggcgtaggacgtacgaccgtaaacgtacgtcggtaggccgttacggccactactaccgttagtccttacgctttaccccg

SEQ ID NO: 255639 - DNA, 536 bp, Homo sapiens
  misc_feature: GYAE6OF02FYR8I.12.86.H09.1.454.CMB.1.raw
  modified_base (202)..(202): a, c, t, g, unknown or other
  misc_feature (202)..(202): n is a, c, g, or t
  modified_base (371)..(371): a, c, t, g, unknown or other
  misc_feature (371)..(371): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaacagaaacctggccaggctccaggctcctcatctatgatgcatccgaaaagggccacgtggcatcccagccaggttcagtgcaggtggtctggggcagactcactctcaccntcagcacgcctagacgccgtgaagtatttagctagtttattactgtcagtcagtcgtagacacgtcggccttcggttctactttcggccgtaggggaccaggcgtaggagtatacgtaacgtaacgtaggtcggctcgcacctagtcctcgtcttacacttcccg

SEQ ID NO: 255640 - DNA, 699 bp, Homo sapiens
  misc_feature: GYAE6OF02GXFNU.12.86.H09.1.454.CMB.1.raw
  modified_base (143)..(143): a, c, t, g, unknown or other
  misc_feature (143)..(143): n is a, c, g, or t
  modified_base (206)..(206): a, c, t, g, unknown or other
  misc_feature (206)..(206): n is a, c, g, or t
tcagatacgacgtacacgaccggtgctcgatttagtgctatagacttgggtttggggtagggaacgtgctcagttaggacccagagggaaccatggaagcccagctcagcttctcttcctcctgctactctggctcccaggtnccaccggagaaattctgttgacacagtctccagccaccctgtcctttgtcctccaggggaaangccaccttctcctgcagggccagtccagagtcttagcacctacttgcctggtaccaacagaaacctggccaggctccgaggctcctcatctactgatgcataccgaaaagggccaactcggacaacgtcccagaccgtaacggtttcaacgtcgggactagggtcggtcgtcggggggactaacgggtactttccaacgttccgtactacccgaacttccgaaacgtccacgtaccgtaagacgcccgtagtaaacgttagtttacgtacgtaacggtttttaactcgttaacggttcaaacggttccgtaacggtcgttaacgggacctaaaccggttcggtacccgttacggttaccgttacgtttttcggacccggtacgggggtaaccctaaaggtccgtagggtaacgacgtaaccgaaacgtaaaccggtggtaccggacgttcggactaccgacgttaccttaggttccttactaccgtttacccg

SEQ ID NO: 255641 - DNA, 525 bp, Homo sapiens
  misc_feature: GYAE6OF02G8HK0.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaaggccactggcatcccagccaggttcagtggcagtggtctggggcagacttcactctcaccatcagcagcctagacgctgaagtattttgtagtttattactgtcagcagcgtagcactggccttcggttctacgttttcggccgtaggggaccaagcgtggagatacgaaacgtaacgtgtcggcgtgccacgatcgtgtcttcacttcttccccg

SEQ ID NO: 255642 - DNA, 544 bp, Homo sapiens
  misc_feature: GYAE6OF02H258I.12.86.H09.1.454.CMB.1.raw
  modified_base (289)..(289): a, c, t, g, unknown or other
  misc_feature (289)..(289): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctccncatctatgatgcataccaaaagggccacgtggcactcccagccaggttcagtggcaggtggtctgggggcaggactttcactctcaccatcagcacgtcctagacgcctagaagtattttgactagtttattacgttgtacagacagcgttaagcaacgtggccttcggttctacgttttcggccgtacgggaccaaggcgtaggagatacgaacgacgtagtcgcgtgcacctatccgtgtcttctacttcccg

SEQ ID NO: 255643 - DNA, 513 bp, Homo sapiens
  misc_feature: GYAE6OF02IOI4I.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaacagaaacctggccaggctcccaggctcctcatctatgatgcataccaaaagggccacgtggcatcccagccaggttcagtgcagtggtctggggcagacttcactctcaccatcagcagctgcagtctagtaagtatttgctagtttacttactgtcagctagtataatacgtgttctgtctctacgttcgggcggggtacaggtgagtatacgaagtagtgtagctagctacactctcgtctctctctcccg

SEQ ID NO: 255644 - DNA, 615 bp, Homo sapiens
  misc_feature: GYAE6OF02IYRFL.12.86.H09.1.454.CMB.1.raw
  modified_base (201)..(201): a, c, t, g, unknown or other
  misc_feature (201)..(201): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccacctgtctttgtctccaggggaaangccaccttctcctgcagggccagtcagagtcttagcacctacttagccctggtaccaacagaaacctggccaggcctcccaggcctcctcatctatgatgacataccaaaagggccaactggcatcccagccaggttcaggtggcaggtggtcgtggggctaggactttcgactctcacatcagcagtcctagacgcctagtaagtattttgactagtttacttacttggtactagctagacgttagacgtaaccgttcggtaccgttcgggttaccttaccgttttcgggacccgtaaggggtaccctaaaggtcggtaggtaacgtactaccggaaacggttaacgtcgggtacggtaccgtacggacctaaccgtacgttccttacggttcctttacgaccgtttaccccg

SEQ ID NO: 255645 - DNA, 769 bp, Homo sapiens
  misc_feature: GYAE6OF02IDH38.12.86.H09.1.454.CMB.1.raw
  modified_base (183)..(183): a, c, t, g, unknown or other
  misc_feature (183)..(183): n is a, c, g, or t
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
  modified_base (232)..(232): a, c, t, g, unknown or other
  misc_feature (232)..(232): n is a, c, g, or t
  modified_base (313)..(313): a, c, t, g, unknown or other
  misc_feature (313)..(313): n is a, c, g, or t
tcagatacgacgtacacgaccggtgctcgattttagtgctatagacgttaggggtttgggggaggaacttggctcagttacggacccaggagggaaccatcggaaggccccagctcagcttcctcgttccgtcctggctactctgggctcccgagggtcaccaccggagaaattcgtgtgacncagtctccaggccacctgtcttgcctcgagggaangccacgttcnccgngccagggccaggtcagagttctagcacctagttgcctggtaccaagacaacgtcggaccaggcctaccgaggtctccctanactctctagattggcactacccgaaaagggccacgtagcgactcccgtacgccaacggtttcaggttcggccgaggtcgggtctggggctacggtcctttacgacgtcgtccaacctagtaccgacggtccacggacccgttacgacggtccgtaacgtaacggttacgttttcggtacgttaacggtttaacttacgtttacgggacccgtacgtaccggtaagtacccgggtaagtaccgtaacggttccgggttacccgttaaccgggtttaccgttacgtttttaccgggggaaccccgaacgggggttaccctaaacggtaccggtacgggtacgtaaccgttaacggtaaaccggtaacggtaccgggtttacgggacccgttaacggaacccggttaaccgtaacggttaacgttcccgggtttaccttccgtaaccgttttcccccgg

SEQ ID NO: 255646 - DNA, 561 bp, Homo sapiens
  misc_feature: GYAE6OF02H7WP7.12.86.H09.1.454.CMB.1.raw
  modified_base (201)..(201): a, c, t, g, unknown or other
  misc_feature (201)..(201): n is a, c, g, or t
  modified_base (407)..(407): a, c, t, g, unknown or other
  misc_feature (407)..(407): n is a, c, g, or t
  modified_base (508)..(508): a, c, t, g, unknown or other
  misc_feature (508)..(508): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaanagccacctttctcctgcagggccagtcagagtcttagcacctacttagcctggtaccaacagaaacctggccaggctcccgaggctcctcatctatgatgccataccgaaaagggccacgtggcactcccagccaggttcaggtggcaggtggtcgtggggcaggtacttcacgtctaccacatcagcagctagcgcctagaagtntttgacttagtttatacttgtacagtcagcgttagctaacgtggtccttcggttctacgtttggaccgtaggggtaccaggcgttaggatactacgaacgngtcgtcggcgttacgacctacctagttccgttcgttccttactcgttaccccg

SEQ ID NO: 255647 - DNA, 627 bp, Homo sapiens
  misc_feature: GYAE6OF02HD6GX.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaangcccacctttctcctgcagggccagtcagagtcttagcacctacttagcctggtaccaacagaaacctggccaggctcccaggctcctcatctatgatgcataccaaaagggccactggcactcccagccaggttcagtggcaggtggtcgtggggcaggtacttcactctcaccatcacgcagcctagcgctagaatatttgctagtttattacgtgtcgagtcagcgtacgcctaacgtcggtacccgttacgggttcctaccgtttttcgggacccgtaacgggggtaacccgtaacggtccgttagggggaactacgttaaccgtaaaacccggtaaccggttacggttacgggtccgtttacggacccgtaacccgtaacgttccgttaacggtttccctttacgttaccgtttcccccg

SEQ ID NO: 255648 - DNA, 635 bp, Homo sapiens
  misc_feature: GYAE6OF02IMZIP.12.86.H09.1.454.CMB.1.raw
  modified_base (203)..(203): a, c, t, g, unknown or other
  misc_feature (203)..(203): n is a, c, g, or t
  modified_base (310)..(310): a, c, t, g, unknown or other
  misc_feature (310)..(310): n is a, c, g, or t
tcagatacgacgtacacgaccggtgctcgatttagtgctatagacttgggtttggggagggaactgctcagttaggacccagagggaaccatggaagccccagctcagcttctcttcctcctgctactctggctcccaggtgccaccggagaaattctgttgacacagtctccagccaccctgtctttgtctccaggggaaanagtccaccttctcctgcagggccagtcaggagttcttagctacctacttagccctggtaccaacagaaacctggccaaggctcccaggctccgtcatctatgatcgnactcaaaacgggtccactggcatcccaagccaggttccaggtgcaggtggcgtgggcaggacttcactctcacatcagcacgccgtagagccctggtaacgtacttttcgcgttaacggtttattacgttgtaccgtaagtccgtaagtacgtaaggtcaaccgttggtacccttcgggttactaccgtttttacgggaccgttacgggggaacccgtaaaggtcccgttagggacgtaacgttaccgtaaacggtaacgtagggtcgggtaccgtcgtaccgtaacgtacgttccgttaggtttaccttacgtacctttcccgg

SEQ ID NO: 255649 - DNA, 520 bp, Homo sapiens
  misc_feature: GYAE6OF02FKHBQ.12.86.H09.1.454.CMB.1.raw
  modified_base (514)..(514): a, c, t, g, unknown or other
  misc_feature (514)..(514): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagtattttgctagtttattactgtcagcagcgtagcaactggccttcggttctacgttttggccgtaggggaccaagctgggagtatacgaaacgacgtgtcggcgtgcacgatcgtgtcttnacttcc

SEQ ID NO: 255650 - DNA, 670 bp, Homo sapiens
  misc_feature: GYAE6OF02H2LS9.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctctgctactctggctcccaggtgccaccggagaaattctgttgacacagtctccagccaccctgtctttgtctccgaggggaaanagccacctttctccgtgcgagggtccagtcagagtcttagcactacttagcctggtacaacagaaacctggaccaggcctaccaggctcctcatctatgatcgacataccgaaaaaggccaactggacatccccgagcccaaggttccaggtcggcgacggttgggtccgtagggggcacggtactttcaaccgttctaccaacctaagttccaacggcaacggtcctaagaacgccgttagtaaacgttagtttcgacgttaagtttacttactagtacaagtcgagtacgtacgacgtaacgtcggtaccgttacggtttacccgtaagttttccgggaacgtaaccgggtaaccgtaacgtacgttagggaacgtagttaaccgaaacggtaaccgttacggttacgggccttacggacctaaccgtacgttccgttacggtttccttaccgtaccgtttccccg

SEQ ID NO: 255651 - DNA, 594 bp, Homo sapiens
  misc_feature: GYAE6OF02ITML4.12.86.H09.1.454.CMB.1.raw
  modified_base (201)..(201): a, c, t, g, unknown or other
  misc_feature (201)..(201): n is a, c, g, or t
  modified_base (418)..(418): a, c, t, g, unknown or other
  misc_feature (418)..(418): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaanagccaccttctcctgcagggccagtcagagtcttagcacctacttagcctggtacccaacagaacctggccaggcctcccgacggctcctcatctatgatgcataccgaaaagggccacgtggaccactcccagccctaaggttcaggtcggcgaggtggtcgtggggcacggtacttcactctacaccatcagcagccgtagacgcctgaacgttntttcgacttagtttacttacgtcgtcagtacgagcgtaagccaacgtcggtccgttacggttctacgttttcggaccggtacgggaaccgtaggacgtagggacgtagtaccgaaacggtacgtggtaccgggtcttcggactaccgagttacgttacgttcttacgtacttcccg

SEQ ID NO: 255652 - DNA, 558 bp, Homo sapiens
  misc_feature: GYAE6OF02H2I37.12.86.H09.1.454.CMB.1.raw
  modified_base (288)..(288): a, c, t, g, unknown or other
  misc_feature (288)..(288): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccgaggggaagagccacccttctcctgcagggccagtcagagtcttagcactacttagcctggtaccaacagaaacctggccaggctccaggctccncatctatgatgcatccaaaagggccactcggcactcccagccaggttcagtggctaggtgggtcgtggggcagacttcactctcaccatcagcacgcctagacgcctaggtaagtatttcgtacttagtttattacgtagtcagtacagtcgtagacaacgtggtccttcgttctacgtttcggccgtagggaccaggtcgtaggatacgtacgtaacgacgtggtagtctacgacaccgtacttccgtacgttcttactacgttccccg

SEQ ID NO: 255653 - DNA, 628 bp, Homo sapiens
  misc_feature: GYAE6OF02HA8P6.12.86.H09.1.454.CMB.1.raw
  modified_base (364)..(364): a, c, t, g, unknown or other
  misc_feature (364)..(364): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagcccaccctgtctttgtctccaggggaaagagccaccttctcctgcagggccagtcagagtctagcacctacttagcctaggtaccaacagaaacctggaccaggcctcccgaggcctcctcatctatgatgcataccaaaagggccacgtggcactcccagccgaggttcaggtggcgaggtcgggtcgnggggcagacttcactctcacntcganacagcctagacgctaggaagttactttgacttagtttattacgtgttacgagtcaggtcgtagactaacgtcggtcccgttacggtttaccgtaccgttttcgggaccgtacggggaaccgtaacggtacgtacgggaaggttaccgtaaccggtaaacgtaaccggttaggtacgggccgttaccggacccgtacgttacttccgttaccgttacctttaccgtaccgtttcccccg

SEQ ID NO: 255654 - DNA, 579 bp, Homo sapiens
  misc_feature: GYAE6OF02I8BEW.12.86.H09.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (447)..(447): a, c, t, g, unknown or other
  misc_feature (447)..(447): n is a, c, g, or t
  modified_base (472)..(472): a, c, t, g, unknown or other
  misc_feature (472)..(472): n is a, c, g, or t
  modified_base (573)..(573): a, c, t, g, unknown or other
  misc_feature (573)..(573): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagcccaccctgtctttgtctccaggggaaangccaccttctcctgcagggccagtcagagtcttagcacctactagcctggtaaccaanacgaaacctggaccaggctcccaggctcctcatctatgatcgcataccgaaaacgggcctaacgtcggacaactccccgagaccctaggttccaggtacggcgaggtcgggtacgtggggcacgtactcgactcgtacaccatcagcacgccagacgcgtagagtatttgactagtttattacgtntcgaagcacggcgtacgactaacgnggtccgtcggttacctacgttttcggccgtacgggtacgacgtccgtaggagacgtacgaacgtacgtggtacgactcgacaccgatccgtgtacttacgnttaccc

SEQ ID NO: 255655 - DNA, 589 bp, Homo sapiens
  misc_feature: GYAE6OF02HP5VG.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaangccaccttctcctgcagggccagtcagagtcttagcacctacttagcctggtaccaacagaaacctggccaggcctcccaggctcctcatctatgatgcactaccgaaaacgggccacgtggacactcccagccgaggttcaggtggcgaggtgggtcgtggggcaggtacttcactctacaaccatacacgcacgcctagacgtaccctaggaacttgttttgactttaagtttaacttcgttagtcgaacgtcgacgtcgtacgtacgaaccgtcgtaccgttacggttcgtacgtttcggaccgtacgggaccgagtcgtaggagtacgtacgaacgtacgtggtacgctacgactacagttcctgtttactctaccttacccg

SEQ ID NO: 255656 - DNA, 580 bp, Homo sapiens
  misc_feature: GYAE6OF02I0ZAE.12.86.H09.1.454.CMB.1.raw
  modified_base (203)..(203): a, c, t, g, unknown or other
  misc_feature (203)..(203): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccgaggggaaangccaccttctcctgcagggccagtcagagtcttagcacctacttagcctggtaccaacagaaacctggccaggctcccaggcctcctcatctatgatgcataccgaaaagggccacgtggcactcccagccaggttcaggtggcgaggtgggtcgtgggggcagtacttcacttctcaccatcacgcacgccgtagacgtccgtagtaagtattttgacttaagtttattactgtactagcagtcgtacgactaacgtcggaccttcggttctacgttttcggaccgtagggaccaggtcgtaggacgtagtacgtaaacgtacgtggtacggtcctcgacctaccgtgttccgtcgttccgttcctacgttccccg

SEQ ID NO: 255657 - DNA, 601 bp, Homo sapiens
  misc_feature: GYAE6OF02I3M4E.12.86.H09.1.454.CMB.1.raw
  modified_base (201)..(201): a, c, t, g, unknown or other
  misc_feature (201)..(201): n is a, c, g, or t
  modified_base (388)..(388): a, c, t, g, unknown or other
  misc_feature (388)..(388): n is a, c, g, or t
  modified_base (584)..(584): a, c, t, g, unknown or other
  misc_feature (584)..(584): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaanagccacctttctcctgcagggtccagtcagagtcttagcacctacttagcctggtaaccaacagaaacctggccaggcctccaggctcctcatctatgatgcatccaaaagggccacgtggcatcccagtcccaggttcaggtcggctaggtgggtcgtgggggcacgtaccgtcactcgtcaccgntacgagccagccgtacgacgacctagtaatgtttcgattacgtttattaccgtagtacgtagtaccgtagtacgtacgtacgacgttacgggccttcggttccgttacgtttggccgtaaggggaccaaggtcgtacgagtactacgaaacggtaacgtaggtacgggcgttacgaccctactagttcctcggttnttaccgttacttccccg

SEQ ID NO: 255658 - DNA, 577 bp, Homo sapiens
  misc_feature: GYAE6OF02HK9SB.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcataccaaaagggccacgtgcactcccagccaggttcagtggctagtgggtcgtggggcaggacttcactctcaccatcagcacgcctagacgtcctagaagtattttcgactagtttacttacgtgtacgtagctagtcgtagactaacgtcggccgtttcggttacctacgttttcgggaccgtacggggacctaaggccggagtacgtacgaaacgtacgtggtacggcgtcgaccaccgtacttcgtcgttctttacgtcttcccgttacccg

SEQ ID NO: 255659 - DNA, 679 bp, Homo sapiens
  misc_feature: GYAE6OF02HUV12.12.86.H09.1.454.CMB.1.raw
  modified_base (144)..(144): a, c, t, g, unknown or other
  misc_feature (144)..(144): n is a, c, g, or t
  modified_base (206)..(206): a, c, t, g, unknown or other
  misc_feature (206)..(206): n is a, c, g, or t
  modified_base (293)..(293): a, c, t, g, unknown or other
  misc_feature (293)..(293): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccagggggtnccaccggagaaattctgttgacacagtctccagccaccctgtctttgtctccgaggggaaanagccaccttctcctgcagggccagtcagagtcttagcacctacttagcctggtaccaacagaacctggccaggcctccgaggctccncatctatgatgcataccgaaaaagggccaacgtggaccactccccgaagccctaaggtttccgaaggttcgggaccgtagggtgggtaccgtgggggactaggtaccttcgactcgtaccaccatccgagccaggtcctagacgcctaggtaagttagtttgactttagtttaacttacttgtacagtcgtaggtaccggtagacgtaacggttcggtacccgtttcgggttaccgttaccggttttccgggacccggtaacgggggacccgtaaaggtccgtagggtaacgtaacgtaaccggtaaaacggtaacgttcggtacgggtaccgttacgaccgtaccgtacttccggttcgtttaccttaccgtaaccgtttccccg

SEQ ID NO: 255660 - DNA, 788 bp, Homo sapiens
  misc_feature: GYAE6OF02JZ3X4.12.86.H09.1.454.CMB.1.raw
  modified_base (208)..(208): a, c, t, g, unknown or other
  misc_feature (208)..(208): n is a, c, g, or t
  modified_base (268)..(268): a, c, t, g, unknown or other
  misc_feature (268)..(268): n is a, c, g, or t
tcagatacgacgtacacgaccggtgctcgatttagtgctatagacttgggtttggggagggaacgtgctcagttaggacccagagggaaccatggaagccccagctcagcttctcttcctcctgctactctggctcccaggtgccaccggagaaattctgttgacacagtctccagccaccctgtcctttgtctccgaggggaaacgngccaccttctcctgcagggccagtcagagtcttagcaccttacgtagcctggtaaccaanaacgtaaacctcgccaacggcctcccgaggtcctacctccacttacctagtcgtacttcgacacttacccgaaaaagggtcccaacgttcggacctaacgttccccaaggccccgttaagggtttacccgaggttacggacccgtaaggtccggggtacggttacggggccgtaacgtaccgtttacaaccgtccgttaccgaaccgtactaacccggtacgaccgtaccggtaccgtacggtaacgtcccggttagtaaacggtacttttacgggtacttaaggttttaacttacgttacgttaccggtaagtaccgtacgtaccgttaacgactaaccggttcggttacccgttacggtttaccgttaacgtttccgggaccggttaacggggtaacccctaaaggtacccggtacgggtaacgtactaccggtaaacggtccggttagggttacaccggttacggaaccgttacttaccggtacgtttacggtccttttaccgaccgttttaccccg

SEQ ID NO: 255661 - DNA, 519 bp, Homo sapiens
  misc_feature: GYAE6OF02FM1TU.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaaggccactggcatcccagccaggttcagtgcagtggtctggggcaggacttcgactctcaccatcagcagcctagagcctgaagtatttgctagtttattactgtcagcagcgtagcaactggtcctcggttctacgttttggccgtaggggaccaagcgtaggagtatacaacgaactgtaggtctgacactagtctcgtcttcattccc

SEQ ID NO: 255662 - DNA, 583 bp, Homo sapiens
  misc_feature: GYAE6OF02ISSAC.12.86.H09.1.454.CMB.1.raw
  modified_base (203)..(203): a, c, t, g, unknown or other
  misc_feature (203)..(203): n is a, c, g, or t
  modified_base (389)..(389): a, c, t, g, unknown or other
  misc_feature (389)..(389): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccagggtgccaccggagaaattctgttgacacagtctccagccaccctgtctttgtctccaggggaaanagccaccttctcctgcagggccagtcagagtcttagcacctacttagcctggtaccaacagaaacctggccaggctccaggcctcctcatctatgatgcatccaaaagggccactggcatcccagccaggttcagtggcaggtggtctgggggcaggacttcgactctcaccatcagcagcctagngcctagaagtatttgctagtttattacgtgtcagtcagcgtagcaacgtggccttcggttctacgttttcgggaccgtacggggtaacctaaggccgtagggtacgtacgttaacgaaaccgtaacgttcggtagggtccgtacggaccgtacccgtacgttccgttacggttacctttacctactttccccgg

SEQ ID NO: 255663 - DNA, 719 bp, Homo sapiens
  misc_feature: GYAE6OF02JCSQL.12.86.H09.1.454.CMB.1.raw
  modified_base (201)..(201): a, c, t, g, unknown or other
  misc_feature (201)..(201): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgctccaggggaaanacgcctaccttctcgtgcggacggcagtcgagtacttctacgcctaccttactcgtcgttacggaaaccaagaaccgtaaccgtcgaccgaacgtccctaccgacggtcctcctacacttactatgacgtcactacgaaaccggaaacggcccaggtcgacctacctccgacgtacgtcggttacgaggtccggagtggggttcggtggggacgggacacggttcctacacttccgtacacctatacggacaccgacgtaccgtaaggtaccgtacccggtaagtaacgtttacgtttacgtaacgtttaaggttttaacttacggttcgttaacgacgtacgtacggtacgtacgtaccgtacggttccggtccgtttacgttaaccgtttacggtttccgggaccgggttaacggaacgtcgtaccggtaggaacgtacgtaacgtaaaccgtggttacgtgggtaacctcggtacctacggttctacggttacgtacttaccgtactttccccgg

SEQ ID NO: 255664 - DNA, 725 bp, Homo sapiens
  misc_feature: GYAE6OF02IWX4I.12.86.H09.1.454.CMB.1.raw
  modified_base (284)..(284): a, c, t, g, unknown or other
  misc_feature (284)..(284): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagcccaccctgttctttgtctccaggggaaagagccaccttctcctgcagggccagtcagatcttagccacctacttagcctgtaccaacagaacctgccagctccgaggcnctcatctatgatgcataccgaaacgggccacgtggaccactcccgagccgtaggttcacggtcggacgtacggtcgggttcgagggggcctaacggtacctttccgtaaccgttccttaccctacccgaattcccgaacggaccgtaaccgtccggtaacgtacgtaccgtaacggtaaaggtttacttttacgtacgtttaagttttaccgtttaaccgttacggttacgaacggtacgtagtaccggtaacgtacctaacgtccgggtcccgtttaccggtttaccgttaccggttttacgggccgttaaccgggggaacccgaacggtccgtagggaacgtacgtaaaccgtaaaccggtaacgttacgggtacggtccgtacgtaccgtacccgttagttaccgtccggtttacctttaccgttacccgttaccccg

SEQ ID NO: 255665 - DNA, 655 bp, Homo sapiens
  misc_feature: GYAE6OF02FPTVZ.12.86.H09.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccacctgtctttgctccaggggaaangccacttcncctgcagggccagtcagngtcttagcacctattagcctggtaccaacagaaacctggaccaggctcccaggcctccgtcatctatgatgcactaccgaaaggcccactcggcactcccagaccgaggttcaggtcgcgtaggtcggtacgtggggcaggtacctttcgacttcctacgaacctagtaccgagtcctaacgtccgtaacgcgtacccgtagtaacgttacgtttacggtcttaacgtttaacgttacgttcgtacgtaacgtcgtacggtaccgtaacggtcctaacgtcggtcccgttacggtttaccgtaccgttttccgggacggtacggggtaaccgtacggtaccgtaggaacgtactaaccggtaaacggtaacgtacggtacggtacctaccgtacgaccgtacgtaccgtcgttacttacgtcttcccg

SEQ ID NO: 255666 - DNA, 749 bp, Homo sapiens
  misc_feature: GYAE6OF02HLYGQ.12.86.H09.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccagataccactggaagtaaatagtgatgaagcagtctccagccacctgtctgtgtctccgaaggggaanaggccaccctctacctgcgaggccagtcagagtgttaanacgcacgttagcctaggtaccagcagataccgtggaccaggcctcccaggcctcctcaatcgtaagttggtcgacagttacctaaccgaacggggtaccctacgttacgggtactaccccggaagtacccgttaacgggtttaccaaggttcgggacgttaacggggttggggtacccgtaggggtaacctaggggtaactttacccgacgttccttaaaccgaaccctaattaccgaacgtaccgtacggtaccgttacggacctaacgggttacctaaggttaaacgttaacgttttagtaacgttaaacgttttaactttaacgttacgtacgtagtaaccgttaagttaacgttaacttaaaccgttacgtttacctcgtaccgttccgtaaggtttaccgggaccgggggtaacgtaggggtaggtaacgaacgttaaccgaaacggtaacgttacggtacgtacggtcggtaacctacccgtaagttccgttgttaaccg

SEQ ID NO: 255667 - DNA, 636 bp, Homo sapiens
  misc_feature: GYAE6OF02JFJ2H.12.86.H09.1.454.CMB.1.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgctccaggggaangccacttctctgcagggccagtcagngtcttagcacctactagcctggtaccaacagaaacctggcctaaggctcccaggctcctcgatctatgatgcaatccaaaaggccactggcactcccagcctaggtcagtggcaggtcgggtctggggacagaccgtttcacgtctaccaccctataccgagcacgcctaagacgaccgtagaacgtattttacgacttagtttacgttacgtacgttacgtacgtcgtaagtccgtaagtacctaaacggttcggtacccgttacggttacgtaccgttttcggaccgttaacggggtaccgtaaacggtcgtaacgggtacgtacgtaccggaaacggttaacgtacggttacgggtaccttaggaccaccgtacgttaccgtacgtttccttacgtcctttacccgg

SEQ ID NO: 255668 - DNA, 610 bp, Homo sapiens
  misc_feature: GYAE6OF02GCKI1.12.86.H09.1.454.CMB.1.raw
  modified_base (203)..(203): a, c, t, g, unknown or other
  misc_feature (203)..(203): n is a, c, g, or t
  modified_base (385)..(385): a, c, t, g, unknown or other
  misc_feature (385)..(385): n is a, c, g, or t
  modified_base (418)..(418): a, c, t, g, unknown or other
  misc_feature (418)..(418): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagngcccaccttctcctgcagggccagtcagagtcttagcacctctagcctggtaccaacagaaacctggccaggcctcccaggcctcctcatctatgatgcactaccgaaaagggccaacgtcggacactcccagccgaggttcaggtcggcaggtggtcgtggggcagtcgttcactcctacnccatccagcgacgcctagacgccgtagaagttnttttgcttaatttacttactgttacagtacgagtacgtacgacaacgttcgggtacccgttcggtttccttacgttttaccgggccgtaacgggggaccctaaggtcgtaggaacgtgtaaccgtaaaccggaacgttggtacggaccttgaccctactacgttccttacggttccttccgacgtttccccg

SEQ ID NO: 255669 - DNA, 702 bp, Homo sapiens
  misc_feature: GYAE6OF02HAUDH.12.86.H09.1.454.CMB.1.raw
  modified_base (226)..(226): a, c, t, g, unknown or other
  misc_feature (226)..(226): n is a, c, g, or t
tcagatacgacgtacacgaccggtgctcgatttagtgctatagacgttaggggtttggggaggaacttggctcagttacggacccaggagggaaccatcggaaggccccagctcagcttcctcgttccgtcctggctacgtctgggcctccaggtcgcaccggagaaattcgtgttgacacagtctccaggccacctgtcttgcctcgagggaagcgccacgttcnccgtgccgacgggccaggtcacgagttcgttagccacctacgttcggcctagggtaaccaacgaccgtaaaaccgtcgggaccgaagggcctacccgaagggcctacccgtacgaactccgtactaggagttcgcaacgtacccgaaaaaggggccaacgtggacctaccgtcccgacgaccgtacggtacacggtgccgtacggtggtcgtggggcaggtaccttcgactcgtaccaaccgtagtccgacgccgtacgaccgtaggacgtcctacgggtaacttacgttttcggacttaacgtttaacgttacgacggttcgaaccggtccggtaacggtcggtaacaccgtaacgtaccgggtccgttacgggttacctacgggttttacgccggtaacggggacctaggtccgtagggacgacgtacgaacggtcgtggacgctacgctaccactctacgtctctcgttcccg

SEQ ID NO: 255670 - DNA, 728 bp, Homo sapiens
  misc_feature: GYAE6OF02GVVW6.12.86.H09.1.454.CMB.1.raw
  modified_base (203)..(203): a, c, t, g, unknown or other
  misc_feature (203)..(203): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagngccaccttctcctgcagggccagtcagagtcttagcacctattagcctggtaccaacagaaacctgccaggctccgaggctcctcatctatgatgacacgtaccaaaacgggcctacgtcggactactaccccgaacgccgtaacggtttccgaggttcgggacgtaacggggttcgggttccggttacggggggcctaacggtaccggtttaccgtaaccttcgtacccgaacctactacgaacgccctaacgtccgtaacggtacggaccgttaaggtaaagtacttttacggaacgtttacgtttaattaccgttgttaaccgtagtaccgtagtaccggtaagtacctaacgttccgggtcccgtttaccgggtttacggttaaccggttttcggaacccgggttaccgggtaaccgtaaacgggtccgttaacgggaacgttaccgtaacgtaaaccggtaagttcggtacggtacgtacgtacaccgttacttccgttcgtacttacctagttcccccg

SEQ ID NO: 255671 - DNA, 677 bp, Homo sapiens
  misc_feature: GYAE6OF02F577D.12.86.H09.1.454.CMB.1.raw
  modified_base (204)..(204): a, c, t, g, unknown or other
  misc_feature (204)..(204): n is a, c, g, or t
tcagatacgacgtacacgaccggtgctcgatttagtgctatagacttgggtttggggaggaactgctcagttaggacccagagggaaccatgggaagccccagctcagcttctcttcctcctgctactctggctcccaggtgccaccggagaaattctgttgacacagtctccagccaccctgtctttgtctccgaggggaaanagccaccttctcctgcagggccagtcagagtcttagcacctacttagcctggtaccaatagaaacctggccaggctccaggctcctcatctatgatgcataccgaaaagggcctaacgtcggcactcccgacgcctaggtcaggtgcgagttcgggtcgtcgggggctaggtactttcacgttctaccaaccgtacttcaacggtccgaacgccgttaggaacggccgttaaggtaacggttacgttttacgtacgttaagttttaacgttaacttaggtacctacgtcgtacggacgtacgtactaaccggtcgtccgttaccggtttcgtaccgttttacgggaccggtacgggtaacccgtaacggtacggtacggtaagtacgtaacgtaaaccggtaacgtacggttacgggcgttaccgacgtaacccgtcgttaaccgttcgttacctttacgaccgtttaccccg

SEQ ID NO: 255672 - DNA, 815 bp, Homo sapiens
  misc_feature: GYAE6OF02GWQLF.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagcccaccctgttctttgtctccgaggggaaagacgccacctttctcctgcgacgggccagtcagtacgttcttacgcctaaccttacgttacgccttacggtaaccaaacgaacggtaaaccgtcggacccgacggaccctccccgacgggtcccttacccctacgtaacgttacggtttaacccgtttacccgtttacccgaaccggtaccgtaccgggggtacccctaaccggttccgggacctaacccgttacccccgaacggtaacccggttaacgggtttacccgaaccggttaccggggtaccggtaacggggtttccgggggttaccggtacgggggtaaaccgtaacgggtaccctttaccgtacctttccctaccgtaccctaactacccaacccgtaacgaccgtacgggacgtccgtaaggtaacgttagtttacgtacgtagtttgttaatttagttagtacgagtacgttagttaggtaggtaacgtccgacgtaccgtacgttcgttacggaccggtacgggtacgtacggtactagggagtagtaacggaacgtagtggtacggtcgtaccgactaccgttagtaccgttacgttccttacgtacccttcccgttacccgtctaccg

SEQ ID NO: 255673 - DNA, 629 bp, Homo sapiens
  misc_feature: GYAE6OF02FPX8O.12.86.H09.1.454.CMB.1.raw
  modified_base (203)..(203): a, c, t, g, unknown or other
  misc_feature (203)..(203): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccgaggggaaanagcctaccttctcctgcagggccagtcagagtcttagcctacctattacgcctggtaccaacagaaacctggaccaggctacccaggctcctcatctatgatgcactaccaaaacgggccactgcactcccgagcctaggttcaggtgcgaggttcgggtcgtcggggtcacgtaccttcacttcctactaaccattcgagcacgaccgtagacgccgtagaagttatttgacttagtttacttactgtacgacgcgtagtacgtagaccgtaacgtcggtaccgttcggttaccgttacgttttcgggaaccggtagggtaacctacggtggtacggaacgtactaaccggaaacgttaacggtcggtacgggtcctaggtcctaacgtccgttacgttacgtttcccttacgtacttaccccgg

SEQ ID NO: 255674 - DNA, 659 bp, Homo sapiens
  misc_feature: GYAE6OF02IYOWI.12.86.H09.1.454.CMB.1.raw
  modified_base (317)..(317): a, c, t, g, unknown or other
  misc_feature (317)..(317): n is a, c, g, or t
  modified_base (440)..(440): a, c, t, g, unknown or other
  misc_feature (440)..(440): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtcgccaccggagaaatttctgttgacacagtctccagccaccctgtctttgtcctccgaaggggaaagtagcctaccttctcctgcagggccagtcagtacgtctagcacctacgttagcctaggtaccaacgagaaacctcggacacggcctcccaggcctcctcatactatcgatnacctactaccgaaaacgggcctaacgcggaccactacccgagtcctaggtcaggtgctaggtggtcgtgggcacgtactcactctccacgtctacagcaacgcgtagacgtacgtagtaagtntttcgacgttagtttacttacgttctacgacgtactaggtacgtacgtacgtaaccgtcggtccgttccggtttcttaaccggttttcggaccggtaccgggtaacgtaacggtcggttaacgaacgtacgtaaaccgaaccggttaactcgggttacggtaccgtaccggtacctaccgttgttaaccgttcgttaaccttccgttacctttaccccg

SEQ ID NO: 255675 - DNA, 635 bp, Homo sapiens
  misc_feature: GYAE6OF02GY64U.12.86.H09.1.454.CMB.1.raw
  modified_base (201)..(201): a, c, t, g, unknown or other
  misc_feature (201)..(201): n is a, c, g, or t
  modified_base (372)..(372): a, c, t, g, unknown or other
  misc_feature (372)..(372): n is a, c, g, or t
  modified_base (409)..(409): a, c, t, g, unknown or other
  misc_feature (409)..(409): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccacctgtcttgtctccgaggggaaangccaccttctcctgcacgggccagtcagagtcttagcacctacttagcctaggtaccaacacgaaacctggccaggcctaccgaggctcctcatctagtgatcgacataccgaaaagggccacgtggaccactcccgagcccgtaggttcaaggtcggcaggttcggtcgnggggcaggtcttcactctcaacatcagcacgtcagcncctagtaagtactttaggtaaatttattacgtcgtacaacgtagtacgtacacgtaacgtcgtacccttacccgtacgtttaccgggacgggtaacgggtaaccgtaaggggtcggtaacgtaacgtacggaacgtaccggtaacgttcgggtacggacggtacgaccgtaaccgtacgttccgttacggttccttaccgtaccgttcccgttccccgacttaccg

SEQ ID NO: 255676 - DNA, 525 bp, Homo sapiens
  misc_feature: GYAE6OF02FK4FX.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccagataccaccggagaaattgtgttgactcagtctccagccaccctgtctttgtctccaggggaaangcaaccctctcctgcagggccagtcagagtgttaacagatacttagcctggtaccagcagagacctggccaggctcccaggctcctcatctatgatacattgaagagggccactggcatctcaggcagattcaatggcagtgggtctgggacaggacttcgactctccaccctcaccagcctagagcctgaagtattttggaatttagtactgttcaatagcgtagcaactggccctcctacgtttcggcgggacgggaccaagggtcggaagactacgaagcgaacgtgtggctgcacgatcctgttcttcattccgtcccg

SEQ ID NO: 255677 - DNA, 752 bp, Homo sapiens
  misc_feature: GYAE6OF02IJOKH.12.86.H09.1.454.CMB.1.raw
  modified_base (204)..(204): a, c, t, g, unknown or other
  misc_feature (204)..(204): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgttctttgtctccgaggggaaanagccacctttctcctgcagggccagtcagagtcttagccaccttacttagcctggtaccaacacgtaaaccgtcgccgacggcctacccgacggcctcctcatctatgatgcacgtaaccgaaaagggccaacgtcggacactcccgacgtaccgtaggttaccacgtggtacgacgggtcgggtcggtacggggctacgtaccgttctaccgtacctaccaaccctataccgacgacgtacgacccgttagaccgtaccgtaaggtaaacgttacgttttacgttaccgttaacggttttaacttaccgtttacgtacgtacggtaccgtacgggttaccgtacgtaccggttaacggtccgggttccgtttaccgggtttcgtttaacccgggttttcggggaacccgggttaacgggtaccgtaacggtaccgggttaggaacgtaacggttaaccgaaaccggttaacggtcggtaccgggtacgtacgtacccggttaacccgttagttccgttacccgtttaccgtttctacccgttccccg

SEQ ID NO: 255678 - DNA, 760 bp, Homo sapiens
  misc_feature: GYAE6OF02HHWOP.12.86.H09.1.454.CMB.1.raw
tcagatacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccgaggggaaagagccacctttctcctgcgagggccaggtcaggtagtcgttagctacctacttacgcctacggtaaccaacaacgtaaaccgtacggaccgacgggcctaccccgaacgggtccctccttacctaacttccttaagttcgtagttgacctaactaacccggaaaaacggggaccctaacgtacgggacctaaccgtaccccgacggtaccgtaagggtttcgaacggttgggacgtaggtcggggttcgcgggggactaggtacctttacgtaacttccgttacaaccagtaccgacgaccgtacggacctaagacggtacctaacggtaacgttacgttttacggatttaacgtttaatttaccgtaggttaccgtagacgtacggtacgggtacacggtaacgtccggttacgttaccgggtttacctttgtttaccggaccgggttaaccgggaaccgtacggtacggtaggtactaagaccggtaaaaccgttaggtcggtcggacgtccgaacctacgtcgttagttccgttaccttcgactttacccccgg

SEQ ID NO: 255679 - DNA, 615 bp, Homo sapiens
  misc_feature: GYAE6OF02JGTT4.12.86.H09.1.454.CMB.1.raw
  modified_base (205)..(205): a, c, t, g, unknown or other
  misc_feature (205)..(205): n is a, c, g, or t
  modified_base (348)..(348): a, c, t, g, unknown or other
  misc_feature (348)..(348): n is a, c, g, or t
tcagatacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctaccgaggggaaangccaccttctcctgcagggccagtcagtagtcttagcactacttagcctaggtaccaacagaaacctggaccaggcctccgaggtcctacctcaatactactagatgacatacgaaaaggccaacgtgcactccacgcagtanagtgtcgagtggtcgtggggacagtaccgtttcaccgtcgtacaacctatacgacggacacgtccgtagacgactaggaacgtagtttacgagtacgtttaagtacgtacgtacgagtaccaggtactaagtacgaacgtcgtaccgttaccgttacgtacgtttcgacggtacgggaaccgtaacgtacgtaggaacgacttacgaaacgtacgttaggtcggacttcggaaccacgtattaccgtacgtcttacgtaccttaccg

SEQ ID NO: 255680 - DNA, 704 bp, Homo sapiens
  misc_feature: GYAE6OF02GH5ZS.12.86.H09.1.454.CMB.1.raw
  modified_base (203)..(203): a, c, t, g, unknown or other
  misc_feature (203)..(203): n is a, c, g, or t
  modified_base (263)..(263): a, c, t, g, unknown or other
  misc_feature (263)..(263): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagngccaccttctcctgcgagggccagtcagagtcttagcacctacttagcctggtaaccaanacgaaacctggccacggctcccgaggcctcctcatctatgatgctactaccgaaaacgggccacgtcggcactcccacgcctacggttcaggtcggcgtaggtcgggtcggtggggcacggtaccgtttcacgtcctacctaaccactcgaacgccacggcctaggaccgtacgtaggtaaacgtttagttttacgtacgtttaacgtttaacttacgtacggttacgtaacggtcgtaacggtacggttaacgtacctaacggttccggtcccgttcggttaccgttaccgggttttcggacccgggttaacggggtaacctaacgggttaccggtagggtaaccgtagtaaccgtaaaccggtaacggttcggttaaccggcgttacgacccgtaacgtacgttccgttacgttacccgtttccgtaccgtttcccccg

SEQ ID NO: 255681 - DNA, 660 bp, Homo sapiens
  misc_feature: GYAE6OF02F9J7V.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagcctaccctgttctttgtcctccgaaggggaaagcgccaccttctcctggcagggccagtcagacgtcttagctacctacttagcctggtacccaacacgaacctggaccaggcctccgaggctcctctatctatgatgacactaccgaaaacgggccacgtggaccactccccgagtcccgtaaggtttccaggttcggcgtagggttgggtcggtggggactagtacctttcacgtccgtaccaccgtactcgacgacacgaccgtagacgtcctaggtaacgttagtttacgtactttaagtttactttacgttgtactacgtactacgtacgttacgacgtaccgtcggtaccgtggttaccgttacgttttcgggaccggtaggggtaacctacggcgtacggtaacgtactaacgtaaaccgtagtggtacggtccgtacgtaccgtacctagttccgtacgttccttactacgttacccg

SEQ ID NO: 255682 - DNA, 725 bp, Homo sapiens
  misc_feature: GYAE6OF02GEW1O.12.86.H09.1.454.CMB.1.raw
  modified_base (211)..(211): a, c, t, g, unknown or other
  misc_feature (211)..(211): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctccaggtgccaccggagaacttctgttgacacagtctccacgcccacccttgttctttgtccgtccggaaggggaaacncggacctacctttctccgtgacgacgggcctaggtccaaggtcgttcttacgcctaccttacgtttacggccgttacggtaacccaaacgtaacggaaaccgtcggaccgaaccggcctcccgaggtcctacctactatacgtagtcacgttgacctaataccgaaaacgggtccaacgtcggacctactacccggacgccgtaggttaccgaggttaccggcgtacggggttgggtcgtcgggggtactaacgtcctacgactccgtaccacgattaccgagtccgaactacgtacgacgtacgtacgaggtttacttcggtattagttttactacggtcgttacgactcgggttactacggtacgacgtactaccggggttcctttaggttacccctttagggtttcccggaacccgggtagggtaacccgacggttaccgtaggggtaacctacgtaacggtaactcggtacgtacgtccgtactcacttcgtccttgtacttcacgtccc

SEQ ID NO: 255683 - DNA, 632 bp, Homo sapiens
  misc_feature: GYAE6OF02FXE0Y.12.86.H09.1.454.CMB.1.raw
  modified_base (157)..(157): a, c, t, g, unknown or other
  misc_feature (157)..(157): n is a, c, g, or t
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
  modified_base (254)..(254): a, c, t, g, unknown or other
  misc_feature (254)..(254): n is a, c, g, or t
  modified_base (281)..(281): a, c, t, g, unknown or other
  misc_feature (281)..(281): n is a, c, g, or t
  modified_base (378)..(378): a, c, t, g, unknown or other
  misc_feature (378)..(378): n is a, c, g, or t
tcagatacgacgtacacgaccggtgctcgatttagtgctatagacttgggtttggggaggaactgctcagtttaggacccagagggaaccatggaagccccagctcagcttctcttcctcctgctactctggctccaggtgccaccggagaaattcngttgacacagtctccagccacctgtctttgctcagggaangccacttcncctgcagggccagtcagngtcttagcacctacttagcctggtaccaanagtaacctggccaggctccgaggctcnatcatgatgcagtccaaaagggtccagcggacattcccaagccaggttcagtggctacggtggtctggggtcaggaccctttgaccgtctacaaccngttaccaggtcagctagcacgtagatagtttcgacgtagtttactacttcggttacgactacgacgtaccgtacgtcctaacgtcggtaccctccgggtttactaacgtttttccggacccggtacggggtaacccgtacgtaccgggttacgggaacgttacgtaaccgtaaacggtacgttacggttacgggtacgttacccggtacctaacccttacgttacccgtacggttcctttaccgacgttccccc

SEQ ID NO: 255684 - DNA, 590 bp, Homo sapiens
  misc_feature: GYAE6OF02G8I77.12.86.H09.1.454.CMB.1.raw
  modified_base (201)..(201): a, c, t, g, unknown or other
  misc_feature (201)..(201): n is a, c, g, or t
  modified_base (258)..(258): a, c, t, g, unknown or other
  misc_feature (258)..(258): n is a, c, g, or t
  modified_base (340)..(340): a, c, t, g, unknown or other
  misc_feature (340)..(340): n is a, c, g, or t
  modified_base (509)..(509): a, c, t, g, unknown or other
  misc_feature (509)..(509): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccagggtgccaccgggagaaattctgttgacacagtctccagccacctgtctttgctccaggggaangccaccttctcctgcagggccagtcagagtcttagcacctattagcctggtaccaanagaaacctggccaggctcccaggctcctcatctatgatgcataccaaaagggcccagtggcatcccagccaggttcagtggntaggtggtcgtggggctagtacttcgactctcaccatcagcagtcctacgacgtccgtagtaagttagttttagcgttaacgtttattacttgtctagtcctagcgtagctaaccgtggaccgttcggttccgtacgttttcggaccggtacgggtaaccaggtaccgnggtaacgtagtaaccgaaaccgtacggtaggtcggtcgtacgccgaccgtacttcgttaggttcccttacgtacttccccg

SEQ ID NO: 255685 - DNA, 666 bp, Homo sapiens
  misc_feature: GYAE6OF02GLWB6.12.86.H09.1.454.CMB.1.raw
  modified_base (332)..(332): a, c, t, g, unknown or other
  misc_feature (332)..(332): n is a, c, g, or t
tcagatacgacgtacacgaccggtgctcgatttagtgctatagacttgggtttggggaggaactgctcagttaggacccagagggaaccatggaagcccccagctcagcttctcttcctcctgctactctggctcccaggtgccaccggagaaattctgttgacacagtctccagccaccctgtctttgtctccaaggggaaagagcccaccttctcctgcagggccagtcagtagtcttagctaccttacttagcctggtaccaacacgaaacctgccaggcctcccgaggctcctcatctatgatgcataccaaaacggccacgtgacancccgagccgtaggttcaggtcggcgaggtcgggtcgtggggactaggtacttcactctacaccatacacgcacgctacgacgtacgtagaagttagttttagtcgttaagttttacttacgttgtacgtagtccgtaggtacctacgtctaacgttcgggtaccgttaccggtttccttaccggtttttaccgggacccgtaaccgggggtaaacctaacggcggttacgggtaacgtacgttaaccgaaaacggtacggtacggttaccgggtacgtagacccgtaaccgttcgttacccgttaggtttaccttaccgttaccgttacccccg

SEQ ID NO: 255686 - DNA, 731 bp, Homo sapiens
  misc_feature: GYAE6OF02JVGMI.12.86.H09.1.454.CMB.1.raw
  modified_base (141)..(141): a, c, t, g, unknown or other
  misc_feature (141)..(141): n is a, c, g, or t
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (255)..(255): a, c, t, g, unknown or other
  misc_feature (255)..(255): n is a, c, g, or t
tcagatacgacgtacacgaccggtgctcgatttagtgctatagacttgggtttgggaggaactgctcagttaggacccagagggaaccatggaagccccagctcagcttctcttcctcctgctactctggctcccaggtcnccaccggagaattctgttgacacagtctccagccacctgtcttgtctccgagggaangccaccttcnctgcacggccagtcagagtctagcaccttatacgcctggtaaccaanacgaaacctcgaccgagcctaccgaacggtcctaccgtacgaacttctaacgtgtactcggactacgtaccgaaaacgggtccctaacgttcggacctacgtaccctacgtcccggtaacggtcgtaaacggtccggtacgttacggggtaccgggttcggtacggggtacgtaccggttacgtttaccgaccgttaccgtaccgtaaaccgtgtaaccggtccgtaacgaccgtaccgtacggtaccgtacgtaacggttagttactttccggtacgttaagtttacttcggtattcgttacgactacggtacgtacgtccgtaacggtcgtaccggtacgtttaccgtgtttaaccggcgggtaacgtaccgtaaggtcgaacgtacggtactacggtaaccgtaaggttcgacggtccttaaccggtcgtactttaccggtagttaccgtttaccgttacgtacgttaccccg

SEQ ID NO: 255687 - DNA, 877 bp, Homo sapiens
  misc_feature: GYAE6OF02INHJ1.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccgggagtaaattctgttgacacagtctccagacccaccctgttcctttgtctaccgaaggggtaaagacgcctaaccgtttcctcctggcgacggccagtcagtacgtcttacggactacctacttacgccgtacggtaacccaacgaagtaaacccgtcggtaccgaacggtccctaccccgaacgggtccccttacccgttacctaacttaccgttaacgttacgtaacgttaccggtaacctaaccgttaaccccgggaaaaaacgggggtccccaaccgggttacggacgtaacccgttaccccgaaccgggtacccgttaccggggttttaaccgaacggggttcgggtaaccggtacggggttacggggttaccgggttacgggggaaccgttaacggtaccgtttaccgtaccgttaccctaccgtaacccgacgttaccaggacccgtacgtaacccgttacggacgtaccgttaagtaaccggtttagtttacgtacgtttaagtttacgttacgtaccgttagaccgtacggtaaggtaccgtaacgaccgtacgtacgttacccggttttccgggtaccgtttacggttacgggaccggaccggggttaactaacggccggttaagggaacgttacgtaaaccggtaaaccggtacgggttgtacgtaccgtaggaccccttaacgtacgttccttaggttccttaccgaccctttcccgg

SEQ ID NO: 255688 - DNA, 622 bp, Homo sapiens
  misc_feature: GYAE6OF02GWMRN.12.86.H09.1.454.CMB.1.raw
  modified_base (150)..(150): a, c, t, g, unknown or other
  misc_feature (150)..(150): n is a, c, g, or t
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
tcagatacgacgtacacgaccggtgctcgatttagtgctatagacttgggtttgggggagggaactgctcagttaggacccagagggaccatggaagccccagctcagcttctcttcctcctgctactctggctcccaggtgccaccggnaaattctgttgacacagtctccagccaccctgtcctttgtctccaggggaanagccaccttctcctgcagggccagtcagagtcttagccacctacttagccttggtaccaacngaaacctgccaggctccaggcctcctcactctatgacttgcataccgaaaacgggccaacgtcggcactcccgaggccaggttcagtggcaggtggtcgtgggcacggtacttcactctaccacatcagcagcctagacgtcgtgaacgtagtttgctagtttattacgttgtacgagtctagcgtacgcaacgtacggtcccttagggtttacctccggttttcggaccgggtaacggggaccaacgggtcgtagggtacgtaccgttacgaaaccggtaacgttcgggtacggtcttaccgccgtaaccgttaccgttccgttaccggttccgtttaccgtacccgtttaccccgg

SEQ ID NO: 255689 - DNA, 761 bp, Homo sapiens
  misc_feature: GYAE6OF02JGY16.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccgaaggggaaagagcctaccttctcctgcgagggccagtcagagttcttagctacctattacgcctggtaaccaacacgaacctcggaccaggcctcccgaggcctcctcatctatgattcgacacgtaccgaaaagggtccacgtacggactacctcccgacgccgtaggttcgacggtcggacgtagggttcgggtcggtgggggactacggtacctttcgaccttcgtaccaacctacgtaccgacgtccgaacgtccgtaacggtaccgtcccgttaaggtaaacggttcttttacggtaccgtttaacggttttaacgtttaccgtacggttaaccgtacggtacgtacgggtaccgttacgtaccggttaaccgtccgggtttacccgttacgggttttccgttacccggttttccgggaacccggggttaaccgggtaaccgtaaccgggtcggttacggggaacgttaaccggtaaaccgtaaaccggtacggttacggtacggtaccgttacgtaaccgtaccttacggttccgttccgttacctttcgtacccttcccg

SEQ ID NO: 255690 - DNA, 789 bp, Homo sapiens
  misc_feature: GYAE6OF02GZLSJ.12.86.H09.1.454.CMB.1.raw
tcagatacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccacctgtctttgtctccgaggggaagagccaccttctcctgcagggccagtcagagtcttagcacctacttagcctggtaccaacagaacctggaccaggctcccaggcctcctcatctatagactgcacgtaccgaaaacgggccacgtggacacctcccagcctaggttcgaggtcggacgagggtcgggttcggtaggggcacggtaccgttacaccgttacctcctaacctataccgacgtaccgtaacggtccgtaacggacggtcccgtaagggttaacggtttactttttacggtaacggtttaacgtttttaacgtttaccgtttggttaccgtaacggtaccggtaacgggttacggttaaccgtaccgtaaccgggttccgggtacccggttttaccccgggtttaccgtttaacccgggtttttccggggaacccgggttaaacccggggggtaacccttaaagggtccgggttaacgggtaacgtaacccggttaaccggtaaaaccggtacgggttaccggtaccgggtacgttaccggtaccgtaaccccgttacggttacccgttacggtttcctttaccgtacccgtttacccccgg

SEQ ID NO: 255691 - DNA, 771 bp, Homo sapiens
  misc_feature: GYAE6OF02FXDU0.12.86.H09.1.454.CMB.1.raw
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
tcagatacgacgtacacgaccggtgctcgatttagtgctatagacttgggtttggggaggaactgctcagttaggacccagagggaaccatggaagccccagctcagcttctcttcctcctgcttactctggctcccaggtgccaccggagaaattctgttgactcagtctccagccacctgtctttgtctccgagggaaangcaaccctctcngcaggccagtcagagtgttaacagatacttagcctggtaccagcagacgaccgtggaccagggcctaccccgagggcccttacccgtacacgttactacgttacggaacttactaagtttaacgggaaacggacggggtaccctaacggttagggaccttaacgttccgtacggaacgggtactaacggttactttaccgaaaggttcgggacgtaggggtttcggggtaccggttacggggaactaacggttacctttaccgaaccgttccctaacccgtaccccgtacctaaccgacggttacccgtaaaggtaccggtacccgttaggtaaagtttacggttttttaggttaaactttttaacgttacgttacgttaacaaaccggttaggtaccgttaacgtaccgtaaccgttcggtaccccttaccgttaccggtttacgggaccgggtaacggaccgtaaaggtcggaatacgtacgacgaccgtacgtggtacgtactacggacctacgacgttcgttaccgtacgtttacctacgtttcccctaccgg

SEQ ID NO: 255692 - DNA, 669 bp, Homo sapiens
  misc_feature: GYAE6OF02F3WDL.12.86.H09.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (259)..(259): a, c, t, g, unknown or other
  misc_feature (259)..(259): n is a, c, g, or t
  modified_base (284)..(284): a, c, t, g, unknown or other
  misc_feature (284)..(284): n is a, c, g, or t
  modified_base (384)..(384): a, c, t, g, unknown or other
  misc_feature (384)..(384): n is a, c, g, or t
tcagatacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtcttgtctccaggggaaangccaccgttcncctgcagggccagtcagagtctagcacctacttagcctggtaccanagaacctgccaggctccagctcctnatctatgatgcatccgaaaggccacgtggcactccgagccctaggttcaggtcggctacggtggtcgtcggggcacggtactttccgacgtctacgaccncgtacgacgtccacggtaccgtaagacgtaccgtacgtaaacgttacgttttacgacctttagtttaacttacgtacgtaccgtaacgtcctaacggtacgtacgtacgtaccgttaacggttaccgttaccgggttaccttacgttttcgggaccggttaacgggaacccgtaacggttacggacgggtaacgtacggtaacgtaaaccggtacggttacggtacggtaccgtaggtaccctaacgtacgtacttacgtttaccttacgtacgtttacccccgg

SEQ ID NO: 255693 - DNA, 761 bp, Homo sapiens
  misc_feature: GYAE6OF02JJUMF.12.86.H09.1.454.CMB.1.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (262)..(262): a, c, t, g, unknown or other
  misc_feature (262)..(262): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctcagccaccctgtctttgctccgaggggaaanagccaccttcncctgcgagggccagtcagtgtcttagcacctacgtacgcctagtaccaanacgaaacctggccaggctcccaggctcctcactactatgagtcgctactaccgaaaacggcctacgtacggaccactcccgacggtaccgtacggtaccgtagggttcggacgttacgggtgggttaccggtacggggggtactaacgggttaccttaccgttacccgtaccgttaccaacccggttaactccggtaaccggtaccgaacggtacccgttaaggtaccggtaccgttaacggttaaacggttaacgtttttcggaaccggttttaacgtttaacgtttaacccgtcggttaacgacggtacgtacgtacggttaacacgtacggttaccgtccggttacgttaccgttacggtttcggacccggtacgggtaacctacggttacggtaccgtaagaccgttaaaccggaaccgtaacgggttacgtcggtaccgtacgaacccgtaccgtagttcccgttaacggttaccttccgtacgtttacccccg

SEQ ID NO: 255694 - DNA, 697 bp, Homo sapiens
  misc_feature: GYAE6OF02IN24E.12.86.H09.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (438)..(438): a, c, t, g, unknown or other
  misc_feature (438)..(438): n is a, c, g, or t
tcagatacgacgtacacgaccggtgctcgatttagtgctatagacttgggtttggggaggaactgctcagttaggacccagagggaaccatggaagccccagctcagcttctcttcctcctgcttactctggctcccaggtgccaccggagaaattctgttgacacagtctcagccacctgtctttgtctccaggggaaanagccacctttcncctgcagggccagtcagatcttagcacctacttagcctggtaccaacagaacctggccaggctcccgagctcctcatctatgatgacagtaccgaaaggccagtggacactccagccgagtcgagtggcaggtgggtcgtcggggctacggtacttccgacttcgtaccgaacctataccgacggtaccacggtacccgtaggacgtacccgtaggtaaacgttnttttacgaccgttaagttttacttaacgttggtacctacggtacgtaacggtcgtaaccggtaccgtaaccggttcggtacccggtttacgggtttacccgtttaccgtttttccggggacccgggttaaggggtaaccctaaagggtccgttaagggtaacgtaacgtaacgtaaaacccgggtaacgtttcggggacggtacgtcccggtacttaaccgtatttcccgtacgtttaccttacctacgtttccccccg

SEQ ID NO: 255695 - DNA, 744 bp, Homo sapiens
  misc_feature: GYAE6OF02GAQBL.12.86.H09.1.454.CMB.1.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
tcagatacgacgtacacgaccggtgctcgatttagtgctatagacttgggtttggggaggaactgctcagttaggacccagagggaaccatggaagccccagctcagcttctcttcctcctgcttactctggctcccaggtgccaccggagaaatttctgttgaacactagtctccagcccaccctgtctttgctcagggggaaangccaccttcncctgcagggccagtcaggagtcttagccaaccttattagccttaggtaaccaaacgagaaaccctggccaggcctacccaggcctcctcatcgtaactggatgctaacgtaccgaaaaagggccagtcgactacgtcccacgctagtcgtaggcggacgtaggtcggtcgtggggactagtaccgttacactcgtacgtaaccactaccggataccgacgtacctaagtacgaccgtaggtaaacggtttagtttacgaacgtttaacgttttaagttacccttggttaccggtaagtaccgttaacggtaaccgtagtacctaaccggtcggtaaccgttacgggtttccgtttaaccggttttcgggaacccgggtaaggggtaaaccctagggtaaccggttaggtaacggtactaaaccggtaaaacccgggtagtaacggggttacggtacccgttaaggaccctttaacccgtacgtttaacccgtttacggtttacccttttacgtacccgtttaccccgg

SEQ ID NO: 255696 - DNA, 766 bp, Homo sapiens
  misc_feature: GYAE6OF02GO08O.12.86.H09.1.454.CMB.1.raw
  modified_base (167)..(167): a, c, t, g, unknown or other
  misc_feature (167)..(167): n is a, c, g, or t
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
tcagatacgacgtacacgaccggtgctcgatttagtgctatagacttggggtttgggggaggaactgctcagttaggacccagagggaaccatggaagccccagctcagcttctcttcctcctgctactctggctcccaggtgccaccggagaaattctgttgacanagtctcagccacctgtctttgctcgagggaangccaccttcnctgcgagggccagtcagtcgtcttagccaccttactagcctaggtaaccaacaacgaaacctcggaccacggcctcccgaggactccgtacactctatcgatcgacacgtaacgaaaacggccctaagtcggaccacgtacccagaccgtaggttaccaggtcggcgtaggtcgggtcggtcggggactacgtaccttcgacttctacctaaccgacttacggacgtaccacggtacccgtagtaaccggccgttaagggtaaacgttttacgttttacggaactttaacggttttaacttaccggtttcgtaacgtaacgtacgttaacgggtacggttaacgtaccctaacgggtcccgggtttacccgtttaccgggttttaaccgtttaccgggttttaccggggtaaccgggtaaccggggggttaacccaaacgttccggggtaacgggtacgtaacggtaaactaaacgggtaaaccgggttgggtaaccgggtaggtaccgtaccgtaaccgtgtttaccgttcgttaccgtttacctacccgttcccg

SEQ ID NO: 255697 - DNA, 665 bp, Homo sapiens
  misc_feature: GYAE6OF02HLGEN.12.86.H09.1.454.CMB.1.raw
  modified_base (202)..(202): a, c, t, g, unknown or other
  misc_feature (202)..(202): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtcttgtctccgaaggggaanagccaccttctcctgcagggccagtcagagtcttagctacctacttagcctggtaaccaacagaaacctggccaggcctcccgaggctccctcatctatgatgcataccgaaaacggccactggcactccagcctagtcagtgctagtcgggtctcggggacacggtacttacaccttcgtacaaccgtactacgtacggacgtacggaccctaaggacggtaccttaaggaaacgttacttttaggacctttaaagtttacttaccgttgtactacgcgtaagtcgtagacctaaggtcggtccgttcggttacttacgtttcgggacggtaaccgggggtactaaagggtcgtaacggggattaacgttaccgtaaaccgggtaactagggttacggtacgttacgacccgttaccgtaaacgttcccgtaggtttaccctttccgaacttttacccccgg

SEQ ID NO: 255698 - DNA, 865 bp, Homo sapiens
  misc_feature: GYAE6OF02JXJA9.12.86.H09.1.454.CMB.1.raw
  modified_base (283)..(283): a, c, t, g, unknown or other
  misc_feature (283)..(283): n is a, c, g, or t
  modified_base (774)..(774): a, c, t, g, unknown or other
  misc_feature (774)..(774): n is a, c, g, or t
tcagatacgacgtacacgaccggtgctcgatttagtgctatagacttgggtttggggaggaactgctcagttaggacccagagggaccatggaagccccagctcagcttctcttcctcctcgcttacctcgtcggctcccgtaggtcgcccaacccgggaagtaaaatttccgttgtttggaaccacaacggtcctccacgccctacccgtgttcctttcgtccttccggaaggggaaaagcgtcccacctttccgtcctgccgaacgggtccagtccaaggngttccttaacgcctaaccttactacggtcccgttggtaaacccaacgaacgaaaccgttcgggaccgaacggcccttacccgacggtccccttccgtaactactaccgttacgtcggtaacctgaccctaaaccgtaaccggaaaaaccggtcccaacggttaacggcccaaccggtaaccccctagggacccgttaaccgggtttaccgtacggttcggggaccggtaacggggtttccggggtaccggggcggggggtacccgttaaacctaacgggtttttccctaaaccggttcccgtaaaccctaacccggttacgaacccggaaacgtccctaaacgggacccgtaacggtacccgtacggttacggtaaaccgtttagtttacggtacgttttacgtttagttaccgttagtaccgacgtacgtcgtaacgtacgtacgtaccggtcgtcgttcggttacttcgttacggtacggaccgggtancgtcgtaagtactacgtacgacggtacgttcggacgttaccgcgtactacggtaccgttcgtaaccgttttactccttaccggttaccccg

SEQ ID NO: 255699 - DNA, 851 bp, Homo sapiens
  misc_feature: GYAE6OF02FMYVX.12.86.H09.1.454.CMB.1.raw
tcagatacgacgtacacgaccggtgctcgatttagtgctatagacttgggtttggggtaggtaacggtgacgtcgacgttaggacccaagtaggggaacctagtgggaagtcccccaagtccgttcaagcttcgtcttcctctagactacgtcgtggcctcccaggtcgccgttaccgggagtaaaagttcgttggttttcacgactaggtccttaccgtaaaggtccctaccctgttctttggtctccgtaagggtaaagcgacctaccgttcgtcgtggcgtagggcccaggtccggactgtacgtagcctacgttacgttacgccgtaggtaacccaacgtacggaaacctcgggaccgtaacggtacctaacccgaacggtacttaccctacgtagttccgtacgttgaacgtcgtaccgaacggttaaaccggaaaacgggtccgtaaagtcgggtacctaaccggtaccgtaaggaacccgtaaaggttaccgaggttcggaacgtaacggttacgggtacgtcggggaccgtaacggtactttaccgacgtccaccgtaactcgtaccaacggtaccgacgaacgttaacgacgtaccgtaagtaaacgtttaacgttacggtaagttaacgttttaacttacgtagtttaacggtaacgacgtttaacggaccgttaacggaaccgtacgtacgggttacccgtcggtttaactttacgtttcggtaaccggtaacggttaaccgtaggtcgttaaggtacggtaccgtaaccggtaacggtaaccgtaggccgttacgtccgaaccgtctacttcgtacgtttcctaccggtacgttccccg

SEQ ID NO: 255700 - DNA, 923 bp, Homo sapiens
  misc_feature: GYAE6OF02GR7CR.12.86.H09.1.454.CMB.1.raw
  modified_base (206)..(206): a, c, t, g, unknown or other
  misc_feature (206)..(206): n is a, c, g, or t
  modified_base (218)..(218): a, c, t, g, unknown or other
  misc_feature (218)..(218): n is a, c, g, or t
tcagatacgacgtacacgaccggtgctcgatttagtgctatagacttgggtttggggaggaactgctcagttaggacccagagggaaccatggaagccccagctcagtcttctcttcctcctgctactctggcctcccaggtcgccaccggagaaattctgttgacacagtcctcagcccacctgtcctttgctaccgaggggaanacgcccacttcncgtacgcgacgggccagtcagtacgttacttacggacctacctacgttagtccttacggaaccaacgtacgaaccgtacggacctacgggaccctcccgtaacggttccgttaccctaacgtacgtttacctaacgttacgggtaaaccttaccggtataaaccggttaacccccgggtaaaaaaccgggccccgttaacggttaccgggaccgttaaacccgttaccccggaaggttacccccggtaagggtttaacccggaacgggttcggtaacggttaacggggttccgggtacggggttaccggggtacctacgggggttaaccctacggttaacccgtaccggtaacctaacccgtaaacgttaccgaccgtacccggtacgttaaccgttaaccggaccggtaacttacgggaaacgtttacggttttaccggtaaacgtttacggtttaaacgtttacccggtaggttaaccgtaaccgtaaccgtaacggttacggtaccggaccgtttaaaccggtcggtttacccgttaccggtttaccgtttaccgggttttccgggaacccgggttaacgggtaccgtaaacggtacgttaagggaaccgttagtaccgtaaaacggttcgtaaccggttcgaaccggttaccggtacaccgttacgttaccctacggtttactacccttaccggttacccc

SEQ ID NO: 255701 - DNA, 651 bp, Homo sapiens
  misc_feature: GYAE6OF02FWGGL.12.86.H09.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (224)..(224): a, c, t, g, unknown or other
  misc_feature (224)..(224): n is a, c, g, or t
tcagatacgacgtacacgaccggtgctcgatttagtgctatagacttgggtttgggggaggaactgctcagttaggacccaaagggaaccatggaagccccagctcagcttctcttcctcctgctactctggctcccaggtgccaccggagaaattctgttgacacagtctccagccacctgtcttgctcaggggaanagccacttcncctgctaggcagcagngtcttagcactactagcctggtaccaacgagaacctggccaggcctaccaggctacctcatctatgtatgcatacccgaaaagggtccacgtggctaactcccagcctaaggttcacgtggaccaggtcggtcgtggggctaacgcttcgactactcgaactatcaacggtcaacggtcctagtacgtcctaggtaagtaagttttacgtacgtacgttttaacgttacgtaacgtcgtacgtacgtacgcggttaaactacgtaacgtcggtcccgttaccggtttacgttaccggtttttcggaacccgtacgggggtaacccaacggtacgtaaggagtaacgttaccgaaacgaaccggtaggtacggtcgtacggtaccaccgtacgttcttcggttacttacgttacccttcttaccccgg

SEQ ID NO: 255702 - DNA, 149 bp, Homo sapiens
  misc_feature: GYAE6OF02H4Y0U.12.86.H09.1.454.CMB.1.raw
  modified_base (121)..(121): a, c, t, g, unknown or other
  misc_feature (121)..(121): n is a, c, g, or t
  modified_base (123)..(149): a, c, t, g, unknown or other
  misc_feature (123)..(149): n is a, c, g, or t
tcagatacgacgtacacgaccggtgctcgatttagtgctatagacttgggtttggggaggaactgctcagttaggacccagagggaaccatggaagccccagctcagcttctcttcctccngnnnnnnnnnnnnnnnnnnnnnnnnnnn

SEQ ID NO: 255703 - DNA, 739 bp, Homo sapiens
  misc_feature: GYAE6OF02ITZLG.12.86.H09.1.454.CMB.1.raw
  modified_base (207)..(207): a, c, t, g, unknown or other
  misc_feature (207)..(207): n is a, c, g, or t
  modified_base (709)..(709): a, c, t, g, unknown or other
  misc_feature (709)..(709): n is a, c, g, or t
tcagatacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagcccaccctgtctttgtcctccgaaggggaaanagcccacctttctcctgcgacgggccagtcagagtcttagcctaacctacttcgcctaggtacccaagacgtaaacctggccaaggtccctacccgacggtcctcctcactctagtcgatcgtacaactaccgaaaagggtccacgtcggaccacgtcccgaacgtccgtacggtttacgacggttacggaccgtaggggttcggtacggtggggaacctacggtaccgtttactaacccgttctaaccgaaccgtacttccgaacgtaccggaacgtcccggtaacggtacgtacccggttaaggtaaacggtttacgtttacggtaacgtttaagtttaaccgttaacgttgtacgtaacgtacggtacggtcgtaacgtaccgtaacgttcggtacccgttcggttaccgttacgtttacggaccggaacgggtaaccgtaggtccgtaggtaacgtactaacgaacggtacgtaggtcgtccgacgtacgtacccgtntccgttaccgtacttaccgtacttacccgg

SEQ ID NO: 255704 - DNA, 790 bp, Homo sapiens
  misc_feature: GYAE6OF02FX4MR.12.86.H09.1.454.CMB.1.raw
  modified_base (141)..(141): a, c, t, g, unknown or other
  misc_feature (141)..(141): n is a, c, g, or t
  modified_base (157)..(157): a, c, t, g, unknown or other
  misc_feature (157)..(157): n is a, c, g, or t
  modified_base (207)..(207): a, c, t, g, unknown or other
  misc_feature (207)..(207): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtnccaccggagaaattcngttgacacagtcctcgagccctaccctgttctttgtctccgaggggaaanacgccctaccttctctgccgagggaccagtcagagtacttagcctacctacgtacgcctaggtaacccaacgaacgaaacccgtggacccaacgggccttaccccgaggcctacccttactacttacctagtacgacttacgacgtacgtaaaccgaaaaccgggtccctaacgtacggcctactcccgaacggtcccgtaaggtttaccagggttcggacggtaggtgggttcggtagggggactacggtactttacgaccgttctaccgaaaccttaccggaacgtccacgtaccgaacggtactaaccgtaggtaacgtttagtttacggtacgtttaacgtttaacgtttacgttacggttcgtaacggtacggtacggttaaccgtaagggtccctttaaaccgggtccggtttaacccgttaccgggttttaccgttaccggggttttacggaacccgggtacggggtaaaccggtacgttcggaaggtacccgttaacgaacgtaacggtgtacggtacggaccgttccggactaccgttcgttacggttacgtaccttccgtaagtttcccccgg

SEQ ID NO: 255705 - DNA, 731 bp, Homo sapiens
  misc_feature: GYAE6OF02HS3NZ.12.86.H09.1.454.CMB.1.raw
  modified_base (201)..(201): a, c, t, g, unknown or other
  misc_feature (201)..(201): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccagtgccaccggagaaattctgttcgacacagtctccacgccacctgtcttgtctccgaggggaanacgcctaccttctctcgcgacgggccacgtcacgtacgttcttacgctaccttacttacgtcctcggtaaccaacaacggtaaacctcggccacggcctaccaggtcctcctcactacgtatagactcgactacgtacccggaaaagggcctaaacggtcgaacctaccgtacccggaaccgtccgtacggttcgaggttacgggtacgtacggggttcggggtacggtcggggtaactacggttaccttacgacctttccgaacctaaccgtctaaccgtaacgtccgaaccggttacccgtaacgggtaccgtaccgtttaaggtaaacgtttacgttttagtaccgtttaagttttacttacgttacgtactacggtacgacgtcgtacgtaccgtaccgttcgttcccgttacgttacgttcgttcggaccgtacgggactggacgtacggagtactacggtaaacgtcggtaggtccgtctacgacctacgtcgtaccgttcgtttaccttacgttaccggtccc

SEQ ID NO: 255706 - DNA, 720 bp, Homo sapiens
  misc_feature: GYAE6OF02FRQ6K.12.86.H09.1.454.CMB.1.raw
  modified_base (205)..(205): a, c, t, g, unknown or other
  misc_feature (205)..(205): n is a, c, g, or t
tcagatacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccgaggggaaagngccaccttctcctgcgagggccagtcagagtcttagcctacctacttagcctcggtaaccaacagaaacctggaccaggtctccccgaaggtcctccgtcctattacctagtgatggacactaccgaaaagggccacgtcggcactcccaggccgtacggttcaggtcggcgtagtcgggtcgtgggggctaacgtaccgttcgacttcctacgaccctaactccgacgtacgtacgcccgtaaggaccgtaccgtagtaacggtttacgttttcggtacgtttacgttttaactttacgttcgttaaccgtagaccgttagtaccggttacggtaccttaacggtacggttccggttcggtttaccgttacgtttttcgggacccggttaacggggtaacccgaaggtacccggttagggtaacgttacgtaaccgtaaaaccggtacgttacgggtacgttacggcgttaaccgacgtcgttccgttacgtctttaccgttcgttttaccccg

SEQ ID NO: 255707 - DNA, 805 bp, Homo sapiens
  misc_feature: GYAE6OF02GZNVW.12.86.H09.1.454.CMB.1.raw
  modified_base (482)..(482): a, c, t, g, unknown or other
  misc_feature (482)..(482): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtgccaccggagaattctgttgacacagtcctccagcccacccgtgtctttgtcgtccgaaggggaaagcgaccctacctttcctcccgtgccgacgggcctagtccgaaggtacgttacgttacgccaacccgttacgttacgtcccgttacggtaacccaaacgaacgtaaacccgtcggtaccgacggtcctaccccgacggtcctcctcgacttctatgatcgactacgtaaccgaaacgggcccaacgtaggccaccgtaccgacgaccgtaggttcgtaggacggtcgtagggttcggcggtgggactacgtccttacgctacctcaaccgtcgtacncgcgtacgcctaagacgtaccgtaggtaactttcgttacgagttagttacttaatttggttaacgtcgtacggttacgtaaggttcgtagggtaccgtacggtaccccgttaccggttaaccgtttaccggggtttcgggtaacccggttacccggggtaaaccggtacggttaaccgggttacgggaacgggttaacggtaacgggttaaacccgggttaacggttcgggtacggtacccggttaaccggtaacccttaacccggttaacgttacccgttttacggttaccggttttaaccccctcggttttaaccccccgg

SEQ ID NO: 255708 - DNA, 645 bp, Homo sapiens
  misc_feature: GYAE6OF02JNLVB.12.86.H09.1.454.CMB.1.raw
  modified_base (198)..(198): a, c, t, g, unknown or other
  misc_feature (198)..(198): n is a, c, g, or t
  modified_base (451)..(451): a, c, t, g, unknown or other
  misc_feature (451)..(451): n is a, c, g, or t
tcagatacgacgtacacgaccggtgctcgatttagtgctatagacttgggtttggggaggaactgctcagttaggaccagagggaaccatggaagcccagctcagcttctcttcctcctgctactctggctcccaggtcgccaccggagaattctgttgacacagtctcagccacctgtcttgtctccgaggggaagngccgaccttctccgtgcagggccagtcagtcgtcttagcacctactacgctcggtaacaacagaaacctggccacggcctaccgaggcctccgtacactacctatgacgttcgactacgtaccgaaacggccacgtggaccacgtccgagtacctaggttccaggtacggccgtaagggtcggtccggtaggggctaacggtacttcggacttctacgaccatccgacgcgtactcgagacgctagtaacgtnttacgagttacgttatactacgtcgtacgtacgagtacgtagactacgtacgtccgttacggttacgtacgtttcggaccgtaacgggacctaacggtcgacggtaacgtacgtaacgtaacggtacgtacggttacggtaccgtagtacccgtaacgttcgttaaccgttcgtaccgttactaccgttacccg

SEQ ID NO: 255709 - DNA, 1012 bp, Homo sapiens
  misc_feature: GYAE6OF02GWIEP.12.86.H09.1.454.CMB.1.raw
tcagatacgacgtacacgaccggtgctcgatttagtgctatagacttggggtttggggaggaactgctcagttaggacccagagggaaccatggaagccccagctccagcttctcttcctcctgctactctggctcccaggtgccgaccggagaaatttcgtgttcgacacagtcctccgacgcctacccgtgttcctttcgtacctccgaaggggaaacgacgtccctacccgtttcctcctgcgacgggccagtcagtagttcttacgacctaccttacgtacgcccgttacggtaacccaacgaacgtaaaccgtcggaccgaacggtccctaccccgaacgggtcccttacccgtactacgttacgttaacgtacggtacgttaacggacctaaaccgtaaacccgggtaaaaacccggggtacccctaaccgggttccggtaacccgtacccgtaaccccggtaaccggtccccgggtttaacgggttaaccggtacggggtaccgggttaccgggtacgggggtttccgggggttaccgggtacggggggtaacctaacccggtttaaccgttttaacccgtacccggtttaccctacccgtaaaccgtaccgttaccggaccggtaacccgttaaccggtaaccccgtttaacgggaacccggttaacgttaaacgggtttaaacgttttaacggttttaccgtttaaaccgttttttaaacgttttaacccttttaacggtttaaccggtacggttaacccgttaaccgggttaaacccggttaccggtaacccttaacccggggtttaccgggttttacccgtttaccgggtttaacccggttttaccgggtttaccgggggaacccgggttaaccggggtaaacccgtacgggttacgtaaacgggtaagtaacccgtaacgggtaacggtaacgtcggtaaccgtctacggtaccctacgtcctttaggttcccgtacctttactcccgttacccttcccg

SEQ ID NO: 255710 - DNA, 790 bp, Homo sapiens
  misc_feature: GYAE6OF02GOIFN.12.86.H09.1.454.CMB.1.raw
  modified_base (538)..(538): a, c, t, g, unknown or other
  misc_feature (538)..(538): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggctcccaggtcgccaccggagaaatttctgttgacacagtcctccacgccacctgttctttatcctccgaaggggaaagcgccaccctctcctgcgacgggcagtcgaagtaactagttaacaacgtaggttactcgtcggtccgtacggtaccaacgacaacggtaaaccgtcggaccgacggtacctccgacggtccctcctactagtacgttacgttaccttaccgaggtaccgtacggacctacggtcggacctaccgtacccgacggtaccgtacggttccacggtcgggtacgtacggttcgggtacggttacggggaactacgtaccttacctaccgttactacctaacgtaccaaccgtaccgtaggtaccgtacggtacgtaccgtacgtaacggtttntttacggacgttaggttatttaacgtttacgttcgtaacgtacgtacgtttacgtaacggttcgggtaccgaccgtacccgttaaccgttaccgtttcgggtttacgggacccgggttagggtaacctaggttacggtaggtaacggttaacgtaccgggtaaaggtcggttacgggtaccggtacgttaacgtaccgtaacgttaccgttacgttaccgtttacgtaccggtttaccttccccgttacccg

SEQ ID NO: 255711 - DNA, 639 bp, Homo sapiens
  misc_feature: GYAE6OF02GEYBH.12.86.H09.1.454.CMB.1.raw
  modified_base (239)..(239): a, c, t, g, unknown or other
  misc_feature (239)..(239): n is a, c, g, or t
  modified_base (297)..(297): a, c, t, g, unknown or other
  misc_feature (297)..(297): n is a, c, g, or t
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
  modified_base (335)..(335): a, c, t, g, unknown or other
  misc_feature (335)..(335): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
  modified_base (454)..(454): a, c, t, g, unknown or other
  misc_feature (454)..(454): n is a, c, g, or t
  modified_base (575)..(575): a, c, t, g, unknown or other
  misc_feature (575)..(575): n is a, c, g, or t
tcagatacgacgtacacgaccggtgctcgatttagtgctatagacttgggtttggggaggaactgcgtcagttaggacccagagggaaccatggaagccccgagctcagcttctcttcctcctgctactctggactcccaggtcgccaccggagaaaattctgttgacacagtcctcacgccacccttgtcttgtctaccgaagggaaagcgccaccttcacctgcgacggctagcagntcgtagcctactactacgctgtaaccaagagtaacctggccaggcctccgagtctccntactctanggcncagtccacgtacgctacgtggtaccnccgtacgccgtagtctacggtaggcgtgggtacgtcgtacgggacgtagtacgttcaccttcgacctacgatccgagtacccncgacngtactacgtcgtacgtagttacgtttacgtntttacggttacctacgttacgtgaactacgtagtaaacttagttaaccgttgttcgtacctaacggttcgttaacggttcggggaacggttacgacggtacgaagtacaacggtaacgtancggtacggacctgtaaccgacttaaggtctacgttacctacgtccctttacccggtcttaaccg

SEQ ID NO: 255712 - DNA, 979 bp, Homo sapiens
  misc_feature: GYAE6OF02JVTPH.12.86.H09.1.454.CMB.1.raw
tcagatacgacgtacacgaccggtgctcgatttagtgctatagacttgggtttggggaggaactgctcagttaggacccagagggaaccatggaagccccagctcagcttctcttcctcctgctactctggcctcccaggtgccaccgggataaattcgtgttgaacacagtcctaccgagaccctccttgtttcctttaggtcctacccggaaagggggaaacgcgcccgttacccttttccaccgtggcggacgggccagttacgtagacgttacttacgacacccttagttacgccgtacggtaaccaaacgacgaaaccgtcggaccgacggtacctccggtaggtaccctcctacctattactaagtcgtagttcgaccgtaaacggtaacccgaaaaacggtccacgtaccccgggtaaactaccctaccggtaagtccggtaacggttaaccgtaaggggttccggtaacccgggttagggggttacccggttcgggttaccggggtaacctacccggtttacctttaccggaaaccctttccgaaccgtaccaccgttacggaccctaacggtaccgtaccggtaaggtaccggttacctttaacgggtaaacgttagttttaacgacgtttaaacgtttacgttaaccgtaggttaaaccggtaccgtaacgttacggggtaaacccgtttcggaaacccgttttaacgggttacccgtttaccgggtttaacccgggttaaccgtttaacccgggggttaaccgaaccgggggggtttaaccgttaaccggtaaaccgggtttccgggtaaaaccggttaacggttaacccggttaaccggtaaacccccgggttaggggttaaccccgtttaaggggaaaaccctttcccggtaacccggtttaccgttaccggttaaccctttccggggtttaccctttaacccctttacgggtttaaaccccccgg

SEQ ID NO: 255713 - DNA, 806 bp, Homo sapiens
  misc_feature: GYAE6OF02FSKR9.12.86.H09.1.454.CMB.1.raw
  modified_base (375)..(375): a, c, t, g, unknown or other
  misc_feature (375)..(375): n is a, c, g, or t
  modified_base (561)..(561): a, c, t, g, unknown or other
  misc_feature (561)..(561): n is a, c, g, or t
  modified_base (644)..(644): a, c, t, g, unknown or other
  misc_feature (644)..(644): n is a, c, g, or t
  modified_base (769)..(769): a, c, t, g, unknown or other
  misc_feature (769)..(769): n is a, c, g, or t
tcagatacgacgtacacgaccggtgctcgatttagtgctatagacttgggtttggggaggaactgctcagttaggacccagagggaaccatggaagccccagctcagcttctcttcctcctgctacctctggcctcccagggtcgccaccggagaaaatttcctggttcgacacgtagtctccacgccctacccgtgttcctttgtctccgaagggggtaaagcgacccgtaccctttctcccgtagcgacggggccacggtacgagagttcgtttacgcctaacccgttacgtttacgcccggttacggtaaaccaaacgaacgaaaccgtcgggacccaacgggcctaccccggacgggtacccttccgtacncttccggtaatacggtatcgtactaacgtacccggaaaacgggtccccaacgttcgggacctaaccttccccgaaccgtacggtccgttttaccgacggggtttccggaaccgtaggggttcgggttaccggttagggggcctaacggttacctttaccgacctttaccacccgtaacgttaaccncgacgacgtacgtacttacgacggtcctaagttaacgtttagtttacgtacgttttacgtttaacggtacgttacgtacgtanaccgtaggtaccggcttcgacggttaccggttacgttcggttaccgttcggttcggaccggtaaggtacgacggtacgtgggtacggtaactaccggaaacggtcgttacggtacgccggtaccnccgtacggtacttcgtcggttactccgtaccttcccg

SEQ ID NO: 255714 - DNA, 737 bp, Homo sapiens
  misc_feature: GYAE6OF02F9HVO.12.86.H09.1.454.CMB.1.raw
  modified_base (208)..(208): a, c, t, g, unknown or other
  misc_feature (208)..(208): n is a, c, g, or t
  modified_base (221)..(221): a, c, t, g, unknown or other
  misc_feature (221)..(221): n is a, c, g, or t
  modified_base (403)..(403): a, c, t, g, unknown or other
  misc_feature (403)..(403): n is a, c, g, or t
  modified_base (472)..(472): a, c, t, g, unknown or other
  misc_feature (472)..(472): n is a, c, g, or t
  modified_base (483)..(483): a, c, t, g, unknown or other
  misc_feature (483)..(483): n is a, c, g, or t
tcagatacgacgtacacgaccggtgctcgatttagtgctatagacttggggtttggggaggaactgctcagttaggacccagagggaaccatggaagccccagctcagcttctcttcctcctgcctactctggctccccaggtgccaccggagaaatttctgttcgacacagtcctccagcccacctgttctttgctccgaggggaancgccgtccttccnctgcgacggcctagcaagagttcttaacgcctaccttacgttacgccgttggtaactaccaacgaacgtaaaccgtcggacccaccgggcctcccgaacggcccttacacctacgtacttagtcgactcggtaaccaagttaaccccggaaacggccctaagtccggacctaccgtacccgngtcccggtaagttcgcggtacggcgtacgggtcggttacggcggggtacacgttacctaccgacttccnccttaacccgnccgacgaccgaactcggtaacgccgtacgtaggtacgttcgtttagtaacgtttaagtttacttacgtacgttcgacggtcgtagtacgtacctaacggtacgttcggtaccgtttcgttacttaccggtttaccgggaaccggtaccggtacggtaacgtcggtacggttaacgaccgtaacgggtaaacccgtaggttccgggtacgtccgtacgtacccgtcgttaacctgtttacgttcctacgttaccc

SEQ ID NO: 255715 - DNA, 752 bp, Homo sapiens
  misc_feature: GYAE6OF02GIBE3.12.86.H09.1.454.CMB.1.raw
  modified_base (142)..(142): a, c, t, g, unknown or other
  misc_feature (142)..(142): n is a, c, g, or t
  modified_base (201)..(201): a, c, t, g, unknown or other
  misc_feature (201)..(201): n is a, c, g, or t
tcagatacgacgtacacgaccggtgctcgatttagtgctatagacttgggtttggggaggaactgctcagttaggacccagagggaaccatggaagccccagctcagcttctcttcctcctgctactctggcctcccaggtnccaccggagaaattctgttgacacagtctcagccacctgtcttgtctccgagggaaacngcctaccttctcctgcgacgggccagtcagtacgttctagcaccttacttacgccgtaggtaacccaaagacgtaaccgtggccacggtccctaccgagcctccgtacactcttatatatcgactaacgtaccgtaaaacgggcctacgtcggactaacctcccgacgtacccgtaggttccgaggtcgaccgtaggggttcgggtacgttcgggggactacggtaccttaccgtaacgtcctaaccgaaccgtactaccgacggaccgtaacgtaccgtaacggtaccgtaccgttagggtaaacgtttacgttttacggtacgtttaaagtttttaccgttaacgttcggttaaccgtaggtacgtacggtaccgtttaacgaccggttaacggttccggttaccgttaccggtttaccgttacggttttaccgggaccgtaacggggtaacctacggtacgtacggactacgtaacgtaacggtaacgttggtacgtacgtaccgtacgtacgtagttccgttacgtaccttacgtaccgttaccccg

SEQ ID NO: 255716 - DNA, 637 bp, Homo sapiens
  misc_feature: GYAE6OF01C4AAY.3.10.A10.1.454.CMB.1.raw
  modified_base (197)..(197): a, c, t, g, unknown or other
  misc_feature (197)..(197): n is a, c, g, or t
  modified_base (234)..(234): a, c, t, g, unknown or other
  misc_feature (234)..(234): n is a, c, g, or t
tcagagacgcactccacgaccggtgctcgatttagcgtcgatctcagggggaggaactgctcagttaggacccagacggaaccatggaagccccagcgcagcttctcttcctcctgctactctggctcccagatgccactggagaaatagtgatggcgcagtctccagccaccctgtctgtgtctccgaggggaaangcccaccctctcctgcagggccagtcagtctgtttanaacacttagcctggtaaccaacagagacctggccaggcctcccaggctcctcattgtttggtgtcttccaccgacgggccacgtggtactcccacgccaggttttcagtggcgaggtgggtcgtgggacagtagttcactctcaccatcacgcacgcctgcagtcgtagaagttattttgtacttaattttatttctgttctagtactaagttaactaaatttaagtttcggttaccgttttacggtaccggtttaccgggtaccgtaaacggggtaacccgtaagggtaacgggtaaaaaccgttaaaaccggtaaacgttacggttacgggtaccgttacggaccaacccgtacgttaccgttcgtttacctttactactttcccttcccgtcccgtaacg

SEQ ID NO: 255717 - DNA, 508 bp, Homo sapiens
  misc_feature: GYAE6OF01EWF6D.3.10.A10.1.454.CMB.1.raw
  modified_base (197)..(197): a, c, t, g, unknown or other
  misc_feature (197)..(197): n is a, c, g, or t
  modified_base (232)..(232): a, c, t, g, unknown or other
  misc_feature (232)..(232): n is a, c, g, or t
  modified_base (290)..(290): a, c, t, g, unknown or other
  misc_feature (290)..(290): n is a, c, g, or t
  modified_base (489)..(489): a, c, t, g, unknown or other
  misc_feature (489)..(489): n is a, c, g, or t
tcagagacgcactccacgaccggtgctcgatttagcgtcgatctcagggggaggaactgctcagttaggacccagacggaaccatggaagccccagcgcagcttctcttcctcctgctactctggctcccagatgccactggagaaatagtgatggcgcagtctccagccaccctgtctgtgtctccgaggggaaangccaccctctcctgcagggccagtcagtctgttanaacacttagcctggtaccaacagagacctggccaggctccaggctcctcatgtttggngcttccaccagggccactggtatcccagccaggttcagtggcagtgggctgggacaggagttcactctcaccatcagcagcctgcagtctgaagtattttgctaatttatttctgttcagcagtacaattaattgcctttgacgttcggacctaagggaccaagggtacggaaactaaacgactggtggctgcacatcngtcttcattccttccgcta

SEQ ID NO: 255718 - DNA, 736 bp, Homo sapiens
  misc_feature: GYAE6OF01B2XAF.3.10.A10.1.454.CMB.1.raw
  modified_base (158)..(158): a, c, t, g, unknown or other
  misc_feature (158)..(158): n is a, c, g, or t
  modified_base (197)..(197): a, c, t, g, unknown or other
  misc_feature (197)..(197): n is a, c, g, or t
tcagagacgcactccacgaccggtgctcgatttagcgtcgatctcagggggaggaactgctcagttaggacccagacggaaccatggaagccccagcgcagcttctcttcctcctgctactctggctcccagatgccactggagaaatagtgatggcncagtctccagccaccctgtctgtgtctccgaggggaaancgcccaccctctcctgcagggcccagtcagttcttgtttaacaaactaacttagcctaggtaaccaaacgagacgaccgtcggaccaggcctcccgaggcctccctactagttcggttttggtcgtcccttcccgaaccggtacgggccctaccgttaggtacctccccgacggccgtacgggttccaggtcgggacgtaggtcgggggtctagggggactagggttacgttaccaccgttccgtacaaccctataccgacgtacgaccgtcccgtggaccgtacgttacgtaaggtaaacgtttagttttacgaactttaaatttttcgtttacgtggtttaccaggtactaagttaactaaagtttagtttcggttaccgtttaggtacccggttaccgggaaccgtaaacggggtaacctaaacggggttaacgtaaaaccgtaaaacggtacggttggtaccggtcgttacgaccgttaacctacgttacttaccggtttccttaaccgacccgttttccctacccgccttaacg

SEQ ID NO: 255719 - DNA, 845 bp, Homo sapiens
  misc_feature: GYAE6OF01A315A.3.10.A10.1.454.CMB.1.raw
  modified_base (133)..(133): a, c, t, g, unknown or other
  misc_feature (133)..(133): n is a, c, g, or t
  modified_base (203)..(203): a, c, t, g, unknown or other
  misc_feature (203)..(203): n is a, c, g, or t
tcagagacgcactccacgaccggtgctcgatttagcgtcgatctcagggggaggaactgctcagttaggacccagacggaaccatggaagccccagcgcagcttctcttcctcctgctactctggctcccagntgccactggaagaaatagtgatcggacgcagtcctccagccacctgtctgtacgtcctcgaagggaaacncgccctaccctctccgtgacgagggcccaggtccacgttcttagtttaacaaactaacgttacgccttacggtaaccaaacgacgacgaaccgtcggaccgacggcccttccgacggtcctccttactagtttcggtttcggtcgtaccttccgaaccgtacggacctacgttacggtacctacccgacgtccggttaacggttcgaggtccggtacgacgggttacggtaccgggtagggaaccgtaggtacccgttacaaccggttctacccgaacccgacttaccgaacgtcccgtaacggtcccgttacgtaccgtaacggttacgtaacggttaacggtttacgtttaacggttaactttaaaacgtttttacgtttccgttaacggttacctacggtttacctaaacgggtttaacttaaacggtttaacggtttccggtttaacccggttttaaccggttaccgggtttaacccgggtaaccggttaaaaccggggttaaccgttaaacgggtaaccgggttaaaaaaccggttaaaccggttaacggttagggttaccggtaccggttaccgaacttaaccgttgttacccgttgttaccttacgtaacccgtttccctaacccgtctaaaccg

SEQ ID NO: 255720 - DNA, 654 bp, Homo sapiens
  misc_feature: GYAE6OF01BTHEK.3.10.A10.1.454.CMB.1.raw
  modified_base (196)..(196): a, c, t, g, unknown or other
  misc_feature (196)..(196): n is a, c, g, or t
tcagagacgcactccacgaccggtgctcgatttagcgtcgatctcagggggaggaactgctcagttaggacccagacggaaccatggaagccccagcgcagcttctcttcctcctgctactctggctcccagatgccactggagaaatagtgatggcgcagtctccagccacctgtctgtcgtctccgaggggaanacgcccaccctctcctgcgaggccagtcagttctgtttaataactaacttacgcctaggtaaccaacagacgacctggccacggcctcccgaggcctcctactagttggtttggtcgtccttaccgaccgacggtccacgtgggtacctccccgagccgtaggttcaggtcggacgtaggtgggtctaggggacaggtacgttccactcctaccactacgtcacgcacgtcctgactagtcgtagtaacgttattttacgactttaattttactttctgttacagtactaagttaactaattaagttcggttacgtttacggtaccggtttacgggaaccgtaacgggtaaccgtaagggtaacggtaaaacgtaaacgtacgttaggtacggaccgtagacctacgttacgtccgttacgtttacttacctaccgttcccttaccccggcttaaccg

SEQ ID NO: 255721 - DNA, 752 bp, Homo sapiens
  misc_feature: GYAE6OF01AVZMP.3.10.A10.1.454.CMB.1.raw
tcagagacgcactccacgaccggtgctcgatttagcgtcgatctcagggggaggaactgctcagttaggacccagacggaaccatggaagccccagcgcagcttctcttcctcctgctactctggctcccagatgccactggagaaatagtgatggcgcagtctccagccacctgtctgtgtctcgagggaacgcgccaccctctccgtgcgacgggccagtccagttcttgtttaataactaacttacgccgttaggtaaccaacgagacgacctcggccaggtcctaccgtaggcctcccgtgtagtttcggtttggtcgtcccttacccgaccggacgggtaccctacgttacggttaacctccccgacggtaccgtacgggtttcaaggttcggacgtagggtcgggttcgtggggaacctaggtacgtttccacgttcctaccaacctacgtcacgacctacgtccgtgtacgtacgtgttaacggtaagtttagttttacgtactttaacgttttatttccgttacgtacgtaacgtacgttaagttaaacgtaatttaacgtttacggttccttttaacggtaccggtttacccgggtaaaccggttaacggggaaccgttaaagggtaaccgggttaaaaaccaacggttaaacgttacgggtacggtaccgttacgtaccgtacgttaccgttcgttacgttacccttaacttaccctttcccgttaccccggcgtttaaccg

SEQ ID NO: 255722 - DNA, 914 bp, Homo sapiens
  misc_feature: GYAE6OF01BINSC.3.10.A10.1.454.CMB.1.raw
tcagagacgcactccacgaccggtgctcgatttagcgtcgatctcagggggaggaactgctcagttaggacccagacggaaccatggaagccccagcgcagcttctcttcctcctgctactctggctcccagatgccactggagaaatagtgagtggcgcagtctccagccaccctgtctgtgtcctccgaggggaaacgacgcccaccctctcctgcgacgggccagtcagttctagtttaactaactaacttacgccgtaggtaacccaacgagaacggtaccgtcggacccacgggccctacccggacggtccttcccgtacgtacgtttcggttttcgggtccgttccctttacccgaaccccggtacggggtaccctaaccggtttccgggtaacccttaccccgaaccgggtaccccggttaacgggttaccgtaacgggttcgggaccggtacggggttcgggggtacgttacgggggaacgtaaggtacggtttccaacccgtttcctaacccgtaacccgtaacgtaccgaacggtaccgtaaccggtcccggttacggtaccgttaacggttaccgtttaaagggtaaacgttttacgttttacggttaaacttttaacgtttttaacgttttccgttacgtaccgttaaggtacccgttaaagtttaaacccttaaagtttaaccggtttcgggtttaccctttaaccggggttaaccgggtttaacccgggtaaacccggtaaacggggtaaaccccgggttaaacgggttaaaccgggtaaaaaccttaaacccggggttagttacgggtaccggtacgtacggtacccgtaaaccttcggttaccgtttactttacccgttaacccgttacctttacccccggttacccgtcgttaaccg

SEQ ID NO: 255723 - DNA, 1051 bp, Homo sapiens
  misc_feature: GYAE6OF01BOJ2F.3.10.A10.1.454.CMB.1.raw
  modified_base (138)..(138): a, c, t, g, unknown or other
  misc_feature (138)..(138): n is a, c, g, or t
tcagagacgcactccacgaccggtgctcgatttagcgtcgatctcaggggggaggaactgctcagttaggacccagacggaaccatggaacgccccgagcgcagccttctcttcctcctcgctactctggctcccagntcgccagtaggaagtaaagtagtaggtagtcgggccgacgtacgttccctacccacggacccctacccttgttccgttggttcgttacccggtaccgggaaagggggtaaacgaccgaccctaccccgtccttccgcggaccggacggggaccttacggtaccgtacggtttacgtttaacgttttaaactaaaccgttaaccgtttaccgtaccgttaacggtaaccccgaaaggtaacggtaaccggtacccgtaccgggacccgtaaccgggtcccccgtaaccggtaccggttcccttcccgttacgtttacgggttttacgggttttccgggtcccgtttaccccgtttaaccccggaacccggggtaaccggggtaccccttaacggggtttacccggtacccttaccccggaccggtacggtttacgggtttaccgaggggtacccggtaggtacgggttcgggggtacgtacgggaaccgttagtacggttttcctactacccgtaccacctaacccggtacgtacaccgaccggttccgtaacggtaccttacggtacgtttaagggttaaacgttttacgtttttaacgttaactttttaacgtttagtttttcccggtaacttaaccgggttataccgttaaacgtttaactttaaacgtttacgggtttccgtttaccgggttttacggacccggggttaaccggtaaaccgggtaaaccgggttaaaccgggtaacggttaaaaaccgggttaaaaccgttaaaccgggtaacgtttacgggtaaccggttaacggttaacccgaccggtttaaaccggtttacccttaccggtttttaaccgttacccttttaccccgttaacccggtttcccccttaaaccgggtttcccttaacggg

SEQ ID NO: 255724 - DNA, 896 bp, Homo sapiens
  misc_feature: GYAE6OF01BL771.3.10.A10.1.454.CMB.1.raw
  modified_base (159)..(159): a, c, t, g, unknown or other
  misc_feature (159)..(159): n is a, c, g, or t
  modified_base (216)..(216): a, c, t, g, unknown or other
  misc_feature (216)..(216): n is a, c, g, or t
tcagagacgcactccacgaccggtgctcgatttagcgtcgatctcagggggaggaactgctcagttaggacccagacggaaccatggaagccccagcgcagcttctcttcctcctgctactctggcctcccagtatcgccacgtaggaagaaatacggngagtggcgcgacgtcctccacgcccaccctgtctggtcgtctaccggaaggggaacnccgcccaccctctcctagcgacggtccaggtctagttactagtttaactaactacgttacgccgtacgtaaccaaacgaggaccgaccgtacggaccgacggtacccaccggtacgtcccttccgtacgttagtttcgggtttggtccgtacccgttacccgaaccggcgggttacccgaacgttcgggtaccctaccgacggtaccgtacggtttgaggttcggaacggttggtacggggtacgtacggggtaaccagggttaactcccggtactccggtaaccaacgtaccgtcgagacccgtctacccgtggtacgttacggtactaagggtttaaaccgtttactttttaggtaaacctttttaaagtttttccgttaacgttacggttaaccgtaaaccttaacgtttaaaccgttaacgttaaaagtttaaccgtttttccgggttacccggttttaccggaacgggtttacccccgggtaaacggttaaaacggggtaaaccccggttaaaaggggtaaacccgtttaaaaaccggtaaacgggtttccgggtttaaacggacgggttaccgtaaaacgggttaccccaattaccgggttttaaccccggtaaccttttacccgttaccttaaacccccgggtttccccgttaaacccccgttaaggttcccg

SEQ ID NO: 255725 - DNA, 812 bp, Homo sapiens
  misc_feature: GYAE6OF02IZKJ1.3.10.A10.1.454.CMB.1.raw
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
  modified_base (282)..(282): a, c, t, g, unknown or other
  misc_feature (282)..(282): n is a, c, g, or t
tcagagacgcactccacgaccggtgctcgatttagcgtcgatctcagggggaggaaacgtgctcagttagggacccagacggaaccatggaagccccagcgcagcttctcttcctcctgctactctggctcccagatgccactggagaaatagtgatggcgcagtctccagccacctgtctgtgtctccgagggaaangccaccctctccgtgcacgggccagtcagtctgttanaacacttagcctggtaccaacagagacctggccagctccaggctccncattgttgcgcttccacgacgggtcctacgtcggtactcccgagtacccgtacggttcgaacggttcgggtacgtacgggttacggggtacgttacggggggaaccgtagggtaacgggtttcctaaccggttccgttacccgaacccgtacgttacccgaagtcccgtaacggtaccccttacggtacccgtacggttacccgttaggtaaacgttacgtttttacgtacctttaaagtttttacgttttccgttaagtttaccgtaaggttaccttaacgtttaactaaacgttttaacgtttacgggttacccttttagggttacccggtttaaccgggtaacccggtaaacggggttaacccgtaaacggggttaaccgggtaaaaccggttaaaccggtacgtttacgggtaaccgggtaaccggtttaaccggaccgtaaacccgttaacggttacccggttttacggttacccttttaccggaaccgttttacccccgtttaccccgggtaccctttaaccgg

SEQ ID NO: 255726 - DNA, 624 bp, Homo sapiens
  misc_feature: GYAE6OF02F43AW.3.10.A10.1.454.CMB.1.raw
  modified_base (198)..(198): a, c, t, g, unknown or other
  misc_feature (198)..(198): n is a, c, g, or t
  modified_base (236)..(236): a, c, t, g, unknown or other
  misc_feature (236)..(236): n is a, c, g, or t
  modified_base (258)..(258): a, c, t, g, unknown or other
  misc_feature (258)..(258): n is a, c, g, or t
tcagagacgcactccacgaccggtgctcgatttagcgtcgatctcagggggaggaactgctcagttaggacccagacggaaccatggaagccccagcgcagcttctcttcctcctgctactctggctcccagatgccactggagaaatagtgatggcgcagtctccagcccaccctgtctgtgtctccgaggggaaangcccaccctctcctgcagggccagtcagtctagtttanaacacttagcctaggtaccaanagacgacctggccaggcctcccgaggcctcctcattgtttggctcttccaccgacgggccctacgtcggtactccccgagtcctaggttcagtcggcgtaggtgggtcgtgggacagtagttcacgtctacaccatcgagcacgcctgctagtctaggtaattatttacgacttaattttacttcttcgtactacggtactaacgtaactaattaacgttcggttaccgttttagtacccggtttacggtaccggtaaaggggaacccaaagggttacgtaaaaccgtaacggtacgtaggtacggcgtacggacctaacccgtacgttacgttcggttacttcgacttcccgttacccgcttacg

SEQ ID NO: 255727 - DNA, 710 bp, Homo sapiens
  misc_feature: GYAE6OF02G9NSA.3.10.A10.1.454.CMB.1.raw
  modified_base (557)..(557): a, c, t, g, unknown or other
  misc_feature (557)..(557): n is a, c, g, or t
  modified_base (610)..(610): a, c, t, g, unknown or other
  misc_feature (610)..(610): n is a, c, g, or t
  modified_base (649)..(649): a, c, t, g, unknown or other
  misc_feature (649)..(649): n is a, c, g, or t
tcagagacgcactccacgaccggtgctcgatttagcgtcgatctcagggggaggaactgctcagttaggacccagacggaaccatggaagccccagcgcagcttctcttcctcctgctactctggcctcccagatgccacgtaggagaaatgtgagtggcgcagtcctccacgccaccctgtctgtcgtctcgagggaaagcgcccacctctcctgcgacggcctagtcagtcttagtttaaataaccgtaacttaacgcccgttaaggaaccaacgtacggaacgaccgtacggacccgtaacggtccctacccggtaacggtcctcccgtacttaaggttcggttttacgggtctcccggttacccaaccggacgggtccctacgttaccggtacctcccgtaacgtcccgtaaggttccgacggtcggacgtacgggttgggtaccgagggtacgacggtacttccgtaactcctaccgtaacacgtcaacggctaccgacgtccgactacgttcgaacggttaaatttcgttagttacttttaaacggttttnttacgtacgtcctaagactaagtactaacgttagttcgtaacgttcgacgttnaaccgggtagtacggtaaaggtaaacgaacgttaacggngtaggtcgacgttagacctcgttacgtcgttactcgttaacgtcgtaccttcggaccttcg

SEQ ID NO: 255728 - DNA, 730 bp, Homo sapiens
  misc_feature: GYAE6OF02HCB71.3.10.A10.1.454.CMB.1.raw
  modified_base (460)..(460): a, c, t, g, unknown or other
  misc_feature (460)..(460): n is a, c, g, or t
  modified_base (471)..(471): a, c, t, g, unknown or other
  misc_feature (471)..(471): n is a, c, g, or t
tcagagacgcactccacgaccggtgctcgatttagcgtcgatctcagggggaggaactgctcagttaggacccagacggaaccatggaagccccagcgcagcttctcttcctcctgctactctggctcccagataccaccggagaaattgtgttagacacagtcctccacgcccacccttgttctttgtcctccggaaggggtaaagacgcccgaccctcctcctgcgacgggccagtcgagtacgtgttagcagtcttacttagccttggtaactacgaacaacgaaccgtcggaccacggcctccgacggtcctcctacacttctagtcagtcacaacgtaaccgaaacggccctagcggtcaacctcccgacgaccgtaggttacgacggtcggtacgtacggggttcggtcggtacgggacctacgttaccttcctaccgtcctaaccaccgtacncgtacgtaacnccgtacggacgtacgttaggtaagtttcgttcgtacgttacgtttacgttaagtttacgttcgtaacacggtacgtacgttacgtaaccgtacgtcccgggtaccgttccgggtacgggtacccggttaccgggaaccgggtacggggtaacgaaacgggtacgtaaaccgttccgtaaacgggtacgttcggaccgggttcaccggaacccttacgttccgttacgtacgtttcccgtacgttcccttaccccgtccg

SEQ ID NO: 255729 - DNA, 874 bp, Homo sapiens
  misc_feature: GYAE6OF02JDG5W.3.10.A10.1.454.CMB.1.raw
  modified_base (200)..(200): a, c, t, g, unknown or other
  misc_feature (200)..(200): n is a, c, g, or t
tcagagacgcactccacgaccggtgctcgatttagcgtcgatctcaggggggaggaactgctcagttaggacccagacggaaccatggaagccccagcgcagcttctcttcctcctgctactctggctcccagatgccactggagaaatagtgatggcgacagtctccagcccaccctgtctgtgtctccgaaggggaanacgcccaccctcctccgtgccgtacgggcctagtcagtccttagtttaataaccaacttacgtaccttaggtaacccaacaaggtaaccgacccgtcggacccgtaagggtcccctacccgaggtcccttaccgtcgttaagttcgggtttttcggcgtaccctttaccccgaacccggtacggggtccccttaaccgtacgggtttaccccgttaacccccgaggttacccccggttagggttttacccgaacggggtttacgggaccggttaggggtttcgggggttaccggtaacggggttaaccggtaacgttccgggtttacccaccgtttacccgtttaacccgaaaccgttacgttccgaaccgggttccaaccggtccgttaacgccgttacgttacggtacggtaaagttttactttacgttaacctttaagtttttaccgttttcgtcggtacctacgggttacttaaacggtaaacctttagttaacgttttccggttacttttacgggtacccgttttaccgggaacgttaaacgggtacgtaaaccgggtaacgtaaaaccgttaaccggtacgttagggtacgaaccgttacgtaacccgtacgagttttaccgtcggttaccttcgttaaccgtttccccgttacgttaccccgtacgg

SEQ ID NO: 255730 - DNA, 121 bp, Homo sapiens
  misc_feature: GYAE6OF02IWA5Y.52.61.F06.1.454.CMB.1.raw
  modified_base (121)..(121): a, c, t, g, unknown or other
  misc_feature (121)..(121): n is a, c, g, or t
tcagcgcagtacgacacgaccggtgctcgatttagctacgctctaaggaagggctggccctgacgtgtttctgttccgcctcctctatacgatcgctgagcgggctggcaaggcgcatagn

SEQ ID NO: 255731 - DNA, 132 bp, Homo sapiens
  misc_feature: GYAE6OF02HG4OP.52.61.F06.1.454.CMB.1.raw
  modified_base (127)..(132): a, c, t, g, unknown or other
  misc_feature (127)..(132): n is a, c, g, or t
tcagcgcagtacgacacgaccggtgctcgatttagctacgctctaagggaaagggggctggccctgacgtgtttctgttcccaccctcctctatacgatcgctgagcgggctggcaaggcgcatagnnnnnn

SEQ ID NO: 255732 - DNA, 491 bp, Homo sapiens
  misc_feature: GYAE6OF01EDXBM.17.36.D03.1.454.CMB.1.raw
  modified_base (204)..(204): a, c, t, g, unknown or other
  misc_feature (204)..(204): n is a, c, g, or t
  modified_base (310)..(310): a, c, t, g, unknown or other
  misc_feature (310)..(310): n is a, c, g, or t
  modified_base (480)..(480): a, c, t, g, unknown or other
  misc_feature (480)..(480): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagagtgttagcagctacttagcctggtaccaacagaaacctggccagtctccaggctcctcatctatgatgcatccaacngggccactggcatcccagccaggttcagtgcagtgggtctgggacagacttcattctcaccatcagcagcctagagcctagaagtattttgctagtttattactgtcagcagcgtagcaactggctcatcaccttcggccaagggacacgactggagatagaacgactgnggctgcactac

SEQ ID NO: 255733 - DNA, 257 bp, Homo sapiens
  misc_feature: GYAE6OF01EGF30.17.36.D03.1.454.CMB.1.raw
  modified_base (253)..(257): a, c, t, g, unknown or other
  misc_feature (253)..(257): n is a, c, g, or t
tcagcgtagactagcacgaccggtgctcgatttagctgcgtcacgatctctctgggacagacttcattctcaccatcagcagcctagagcctgaagattttgcagtttattactgtcagcagcgtagcaactggctcatcaccttcggccaagggacacgactggagatgaaacgaactgtggctgcaccatctgtcttcatcttcccgccatctgactagtctacgctgagcgggctggcaaggcgcatagnnnnn

SEQ ID NO: 255734 - DNA, 177 bp, Homo sapiens
  misc_feature: GYAE6OF01BS9QP.17.36.D03.1.454.CMB.1.raw
  modified_base (177)..(177): a, c, t, g, unknown or other
  misc_feature (177)..(177): n is a, c, g, or t
tcagcgtagactagcacgaccggtgctcgatttagctgcgtcacgatctctcttgggatagaagttattcagcaggcacacaacagaggcagttccagacttcaactgctcaccatctgtcttcatcttcccgccatctgactagtctacgctgagcgggctggcaaggcgcatagn

SEQ ID NO: 255735 - DNA, 490 bp, Homo sapiens
  misc_feature: GYAE6OF01EE7MT.17.36.D03.1.454.CMB.1.raw
  modified_base (204)..(204): a, c, t, g, unknown or other
  misc_feature (204)..(204): n is a, c, g, or t
  modified_base (309)..(309): a, c, t, g, unknown or other
  misc_feature (309)..(309): n is a, c, g, or t
  modified_base (368)..(368): a, c, t, g, unknown or other
  misc_feature (368)..(368): n is a, c, g, or t
  modified_base (485)..(485): a, c, t, g, unknown or other
  misc_feature (485)..(485): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaancgccaccctctcctgcagggccagtcagagtgtagcagctacttagcctggtaccaacagaaacctggccagtctccaggctcctcatctatgatgcatccaacngggccactggcatcccagccaggttcagtggcaggtgggtctgggacagacttcattcncaccatcagcagcctagagcctagaagtattttgctagtttattactgtcagcagcgtagcactgctcatcaccttcggaccaggacacgactggagatagaacgacgtgagctgcncgtac

SEQ ID NO: 255736 - DNA, 548 bp, Homo sapiens
  misc_feature: GYAE6OF01BSCDT.17.36.D03.1.454.CMB.1.raw
  modified_base (203)..(203): a, c, t, g, unknown or other
  misc_feature (203)..(203): n is a, c, g, or t
  modified_base (381)..(381): a, c, t, g, unknown or other
  misc_feature (381)..(381): n is a, c, g, or t
tcagcgtagactagcacgaccggtgctcgatttagctgcgtcacgatctctcttgggggaggaactgctcagttaggacccagagggaaccatggaagccccacctcagcttctcttcctcctgctactctggctcccagataccaccggagaaattgtgttgacacagtctccagccaccctgtctttgtctccgggggaanagccaccctctcctgcagggccagtcagagtgtagcagctacttagcctggtaccaacagaaacctggccagtcctcccaggcctcctcatctatgatgcatccaagacgggccactcggcactcccagccgtaggttcaggtggcagggtgggtctgggactagtacttcactttcncaccatcagcacgcctagacgtcctagaagttattttgacttagtttattactgtcagcagcgtagaccaacgtggctactactccgaccgttcggacctaacgggaccacggacgtaggagacgtacggaaacgtaacgtggtcggactagcctaccgtgttaccg

SEQ ID NO: 255737 - DNA, 505 bp, Homo sapiens
  misc_feature: GYAE6OF01BQD5S.17.36.D03.1.454.CMB.1.raw
  modified_base (204)..(204): a, c, t, g, unknown or other
  misc_feature (204)..(204): n is a, c, g, or t
  modified_base (478)..(478): a, c, t, g, unknown or other
  misc_feature (478)..(478): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagagtgttagcagctacttagcctggtaccaacagaaacctggccagtctccaggctcctcatctatgatgcatccaacagggccactggcatcccagccaggttcagtggcagtgggtctgggacagacttcattctcaccatcagcagcctagacgcctagaagtattttgacttagtttacttactgtcagcagtcgtagcaactggctcatcaccttcggaccaagggaccacgacgtggaganacgaaacgaactggtagctgcacctac

SEQ ID NO: 255738 - DNA, 539 bp, Homo sapiens
  misc_feature: GYAE6OF01AR4WG.17.36.D03.1.454.CMB.1.raw
  modified_base (204)..(204): a, c, t, g, unknown or other
  misc_feature (204)..(204): n is a, c, g, or t
  modified_base (310)..(310): a, c, t, g, unknown or other
  misc_feature (310)..(310): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaangccaccctctcctgcagggccagtcagagtgttagcagctacttagcctggtaccaacagaaacctggccagtcctccaggctcctcatctatgatgcatccaacngggccacgtggcactcccagccaggttcagtcggcaggtgggtctgggacagtacttcattctcacctatcagcagcctagacgtcctagaacgttatttcgacttagtttactacgtgtcagcagcgtagcaacgtgctcactccaccgttcggaccgaagggaccacggacgtagggaacgtacgtacggaaaacgtacgttggtacggacctcgacctaccgtacg

SEQ ID NO: 255739 - DNA, 255 bp, Homo sapiens
  misc_feature: GYAE6OF01BB369.17.36.D03.1.454.CMB.1.raw
  modified_base (253)..(255): a, c, t, g, unknown or other
  misc_feature (253)..(255): n is a, c, g, or t
tcagcgtagactagcacgaccggtgctcgatttagctgcgtcacgatctctctgggacagacttcattctcaccatcagcagcctagagcctgaagattttgcagtttattactgtcagcagcgtagcaactggctcatcaccttcggccaagggacacgactggagatgaaacgaactgtggctgcaccatctgtcttcatcttcccgccatctgactagtctacgctgagcgggctggcaaggcgcatagnnn

SEQ ID NO: 255740 - DNA, 258 bp, Homo sapiens
  misc_feature: GYAE6OF01EOJDX.17.36.D03.1.454.CMB.1.raw
  modified_base (253)..(258): a, c, t, g, unknown or other
  misc_feature (253)..(258): n is a, c, g, or t
tcagcgtagactagcacgaccggtgctcgatttagctgcgtcacgatctctctgggacagacttcattctcaccatcagcagcctagagcctgaagattttgcagtttattactgtcagcagcgtagcaactggctcatcaccttcggccaagggacacgactggagatgaaacgaactgtggctgcaccatctgtcttcatcttcccgccatctgactagtctacgctgagcgggctggcaaggcgcatagnnnnnn

SEQ ID NO: 255741 - DNA, 515 bp, Homo sapiens
  misc_feature: GYAE6OF01E1I3I.17.36.D03.1.454.CMB.1.raw
  modified_base (204)..(204): a, c, t, g, unknown or other
  misc_feature (204)..(204): n is a, c, g, or t
  modified_base (357)..(357): a, c, t, g, unknown or other
  misc_feature (357)..(357): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagagtgttagcagctacttagcctggtaccaacagaaacctggccagtctccaggctcctcatctatgatgcatccaacagggccactggcatcccagccaggttcagtggcagtgggtctgggacngacttcattctcaccatcagcagcctagagcctagaacgtattttgactagtttattactgtcagcagcgtagcaactggctcatccaccttcggacctaagggaccacgacgtaggagtacgtagaaaccgaacgtcggtaggacttgcctcgtacg

SEQ ID NO: 255742 - DNA, 615 bp, Homo sapiens
  misc_feature: GYAE6OF01C9E2W.17.36.D03.1.454.CMB.1.raw
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
  modified_base (299)..(299): a, c, t, g, unknown or other
  misc_feature (299)..(299): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtaccgggggaaanacgccaccctctcctgcagggccagtcagngtgttagcagctacttagcctggtaaccaacacgaaacctggccagtcctccgaggcctcctnatctatgatgctactacccaagacgggacccagtggccacgtccccagccctaggttccaggtggactagggttcgggtcgtggggaacctaggtacttttacgatttccctaccacccattaccgacgcaacgaccgtaagacggtacctaggtaacgttagttttcgacttaagtttacttacgttgttacagtcgacgtacgtagacctaacgtggactactacgtcctaaccggttcggaccgaacgggacaccggtacgtaggaagtacgtaacgaaaccgtacggtggtacgagtaccgcgtaccgtacg

SEQ ID NO: 255743 - DNA, 825 bp, Homo sapiens
  misc_feature: GYAE6OF01CZ61M.17.36.D03.1.454.CMB.1.raw
  modified_base (205)..(205): a, c, t, g, unknown or other
  misc_feature (205)..(205): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaanagccaccctctcctgcagggccagtcagagtgttagcagctacttagcctggtaaccaacagaaacctggccagtcctccaggcctcctcattctatgatgcactcccaagcgggcccaacgtcgggcctaactcccccgaagtcccgtaacgggtttcgaaggtcgggacctaaggggttcgggggtacgttagggggaacctaacgggtaccttttccgaaacttttcccgtaacccgtaaccctaacgttccgaaacgggtccgaaaccgggtacccccgttaaagggtaacccggttaccccgtttaaagggtaaaaccgggtttttacgtttttttaccgggaacccgtttttaaacgggtttttttaaacctttaacccggttacggtttacccgtaaacgggtcccgtaaagggttcccggttaaacggtacccgttaaaccgttccggggtacccttaccgttaaccgtacccgttaaccccggtttaccggggaaccccgtaaaaccggggggtaaccctaaccggtaaccggtagggggtaaacgtacggtttaaacgggaaaacccgttacgttcgggtacggtaccgtacggaccgtaacccgttacg

SEQ ID NO: 255744 - DNA, 504 bp, Homo sapiens
  misc_feature: GYAE6OF01AVURJ.17.36.D03.1.454.CMB.1.raw
tcagcgtagactagcacgaccggtgctcgatttagctgcgtcacgatctctcttggggctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtggggggaggcttggtaccgccgtggggggtccctgagactctcctgtagagcctctggattcgccttcagtacctacagcatgaactgggtccgccaggttccagggaggtctgggagtgggttgcatacattagtagtagtgatagtccatatactacgcagactctgtagagggccgattcaccatctccagagacagtcgaccaagactcactgtatctgacaatgaacagaccttagagacgacgacacggctgtgtattactgtgcgagacgactccgctgcgtagg

SEQ ID NO: 255745 - DNA, 579 bp, Homo sapiens
  misc_feature: GYAE6OF01EA2T9.17.36.D03.1.454.CMB.1.raw
  modified_base (205)..(205): a, c, t, g, unknown or other
  misc_feature (205)..(205): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaancgcccaccctctcctgcagggccagtcagagtgttagcagctacttagcctggtaccaacacgaaacctggccagtctcccaggcctcctcatctatgatgacactaccaacgcgggaccagtcggcactcccagccaggttcagtggcaggtgggtcgtagggacagtacttcattcctacacctatcacgcacgactagacgtacctagaagttattttgaccttagttttacttactgtacagcacgcgtacgactaacgtgaccttcaacttcctacccgttacgggaccgaaacgggacctaacggtacggtaggaacgtaacgtaacggaaacgtaacgtcggtacggacctaggtaccaccgttacg

SEQ ID NO: 255746 - DNA, 634 bp, Homo sapiens
  misc_feature: GYAE6OF01DJ4RO.17.36.D03.1.454.CMB.1.raw
  modified_base (205)..(205): a, c, t, g, unknown or other
  misc_feature (205)..(205): n is a, c, g, or t
  modified_base (317)..(317): a, c, t, g, unknown or other
  misc_feature (317)..(317): n is a, c, g, or t
  modified_base (355)..(355): a, c, t, g, unknown or other
  misc_feature (355)..(355): n is a, c, g, or t
  modified_base (388)..(388): a, c, t, g, unknown or other
  misc_feature (388)..(388): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaangcccacctctcctgcagggccagtcagagtgttagcagctacttagcctggtaccaacacgaaacctggccagtcctcccgaggcctcctcatctatgatgacatcccgaanacgggccacgtggcactcccagcctaggtcaggtcggngaggtcggtcgtgggactagtcttacgacttcnccgacctatcgacgcacgccgtaagtacgtacctaggtaacgttagtttttacgacgtttaagttttactttaaccgttgttacgagtccgtaacggtccgttacgacccgtaacggttccggaccttacgtaaccttccgtaacccggtttccggaaccccgaaaggggtaaccaaccgggtaacgtagggaacgtaacgtaacggaaaaccgtagtcggttacggcttacgccgtaacttacgg

SEQ ID NO: 255747 - DNA, 542 bp, Homo sapiens
  misc_feature: GYAE6OF01DX5O0.17.36.D03.1.454.CMB.1.raw
  modified_base (204)..(204): a, c, t, g, unknown or other
  misc_feature (204)..(204): n is a, c, g, or t
  modified_base (307)..(307): a, c, t, g, unknown or other
  misc_feature (307)..(307): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctaccggggaaangccacctctcctgcagggccagtcagagtgtagcagctacttagcctggtaccaacagaaacctggccagtctccaggcctcctcatctatgatgcatccaangggccacgtgcatcccagccaggttcagtgcagtgggtctgggacagtacttcattcctcacctatcagtcagcctagacgtcctagaagtatttgcttagtttattactcgtcagcgtagcgtagcaacgttcggaccttcgaacttccaccgttcggaccgaaagggaccacgtaaccgtggaacgtagtacgaaaacgtaacgttcggtacggtacctggcctacccgtacg

SEQ ID NO: 255748 - DNA, 545 bp, Homo sapiens
  misc_feature: GYAE6OF01CVIRT.17.36.D03.1.454.CMB.1.raw
  modified_base (313)..(313): a, c, t, g, unknown or other
  misc_feature (313)..(313): n is a, c, g, or t
  modified_base (445)..(445): a, c, t, g, unknown or other
  misc_feature (445)..(445): n is a, c, g, or t
tcagcgtagactagcacgaccggtgctcgatttagctgcgtcacgatctctcttgggctcagagaggtgccttagacctggattccaaggcatttccacttggtgatcagcactgaacacagaggactcaccatggagttggggctgtgcgttgggttttccttgttgcttattttagaaggtgtccagtgtgaggtgcagcgtggtggagtcgtggggggagtcgttggtaccggccgtggggggtccctgacgactctccgtgtagagcctctggattcgccttcagttaccacagcatgaactgggtccncaggttccagggtaggtctggagtgggttgacatacagttagtagtagtgatagtccatatacgtacgcaagctcgtggtgaagggcgattcaccatctccagagacagtgaccaagaactcgactgtatcngaacaatacgaacagtaccttaaggacgaacgaaccgacgaccggtctggttacgtagttacctggttagaccgaagacggacttccgcgttgctacggg

SEQ ID NO: 255749 - DNA, 697 bp, Homo sapiens
  misc_feature: GYAE6OF01BI063.17.36.D03.1.454.CMB.1.raw
  modified_base (204)..(204): a, c, t, g, unknown or other
  misc_feature (204)..(204): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagagtgttagcagctacttagcctggtaccaacagaaacctggccagtcctccaggtctcctcatctatgatgcactccaacgcgggccacgtggaccatccccgagcctaggttcaggtcgacgtaggttcggggtcgtagggactacggtacttcgtactttccgtaccaacctataccgaacgcctaaggtaccccgtaaaggaccggtacccgttaggtaaaacgtttacgtttttacggaccttttaaaggtttttacttttaaccgttacggttaccgtaaggtacccgtaagggtaccgttaacgggtaccgtaacggttcggtaccctttactaaccgttacccgtaccgtttacccgggaaccggtaaacgggaacccgtaacggtacggttaggaaggtaacgtaaacgggtaaaccgttaaacgtcgggttagaccgtaccggtacctaccgtacg

SEQ ID NO: 255750 - DNA, 591 bp, Homo sapiens
  misc_feature: GYAE6OF01CNZRK.17.36.D03.1.454.CMB.1.raw
  modified_base (206)..(206): a, c, t, g, unknown or other
  misc_feature (206)..(206): n is a, c, g, or t
  modified_base (295)..(295): a, c, t, g, unknown or other
  misc_feature (295)..(295): n is a, c, g, or t
  modified_base (419)..(419): a, c, t, g, unknown or other
  misc_feature (419)..(419): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagcccaccctgtctttgtcgtccgggggaaanacgccacctctcctgcagggccagtcagagtgttagcagctacttagcctaggtaccaacagaacctggaccagtcctccaggctcctnatctatcgatcgcactccaacgcgggccacgtggcactccacgcaggttcaggtcggcaggtgggtcgtgggactagaccttcgacttcacacctagtcagcagtacctagacgcctagaattntttgacgttagttttactagttcgtacacgtcgtaggtcgtaacgtacgtaacgtcggtccttactacgtcccgtaccgttccggaaccggtaaacgggaccaaccggtcggtaaggaaggtaacgtaacggaaacgtacgtaggtacggaccttcgaccgtaccgttaccg

SEQ ID NO: 255751 - DNA, 662 bp, Homo sapiens
  misc_feature: GYAE6OF01B975E.17.36.D03.1.454.CMB.1.raw
  modified_base (205)..(205): a, c, t, g, unknown or other
  misc_feature (205)..(205): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaanacgccaccctctcctgcaggccagtcagagtgtagcagctactagcctggtaccaacagaaacctggccagtcctccagcctcctcatctatgatgcactaccaacgacgggaccctacgtggaccacgtaccccacggtcctaagggtttccaagggtcggaccgtaagggttcggggtacgttaggggaactaggtacctttcgaactttcctccaaccgtatccgacgtccaacgtcccgtaaggacgtccgttaaggtaaacgtttacttttacggactttaagttttacgttacgttgtacgagtccgaggtacgttacgaccgtaacgttggtacctacgtactcccgttaccggttacggaacccgaaagggaccctaacggacgttagggaacgtaagtaaccggtaaaaccgtacggttcggacggtaccgtacgtccgtaacgtacg

SEQ ID NO: 255752 - DNA, 255 bp, Homo sapiens
  misc_feature: GYAE6OF01BYXRG.17.36.D03.1.454.CMB.1.raw
  modified_base (252)..(255): a, c, t, g, unknown or other
  misc_feature (252)..(255): n is a, c, g, or t
tcagcgtagactagcacgaccggtgctcgatttagctgcgtcacgatctctctgggacagacttcattctcaccatcagcagcctagagcctgaagattttgcagtttattactgtcagcagcgtagcaactggctcatcaccttcggccaagggacacgactggagatgaaacgaactgtggctgcaccatctgtcttcatcttcccgcatctgactagtctacgctgagcgggctggcaaggcgcatagnnnn

SEQ ID NO: 255753 - DNA, 537 bp, Homo sapiens
  misc_feature: GYAE6OF01CESN4.17.36.D03.1.454.CMB.1.raw
  modified_base (205)..(205): a, c, t, g, unknown or other
  misc_feature (205)..(205): n is a, c, g, or t
  modified_base (264)..(264): a, c, t, g, unknown or other
  misc_feature (264)..(264): n is a, c, g, or t
  modified_base (311)..(311): a, c, t, g, unknown or other
  misc_feature (311)..(311): n is a, c, g, or t
  modified_base (372)..(372): a, c, t, g, unknown or other
  misc_feature (372)..(372): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaanagccaccctctcctgcagggccagtcagagtgttagcagctacttagcctggtaccaanagaaacctggccagtctccaggctcctcatctatgatgcatccaacngggccacgtggcactcccagccgagttcagtggcaggtgggtctgggacagacttcattcncaccatcagcagcctagagcctagaatagttttgacttagttttactacgtgtacagctagcgtaagcctaacgttggactctactcctacccgttccgaccgaaacggacctacggacgtagggagtataacggaaagtacgtaggtcgacttgctaccgtacg

SEQ ID NO: 255754 - DNA, 525 bp, Homo sapiens
  misc_feature: GYAE6OF01C9DXW.17.36.D03.1.454.CMB.1.raw
  modified_base (204)..(204): a, c, t, g, unknown or other
  misc_feature (204)..(204): n is a, c, g, or t
  modified_base (310)..(310): a, c, t, g, unknown or other
  misc_feature (310)..(310): n is a, c, g, or t
  modified_base (519)..(519): a, c, t, g, unknown or other
  misc_feature (519)..(519): n is a, c, g, or t
tcagcgtagactagcacgaccggtgctcgatttagctgcgtcacgatctctcttgggggaggaactgctcagttaggacccagagggaaccatggaagccccacctcagcttctcttcctcctgctactctggctcccagataccaccggagaaattgtgttgacacagtctccagccaccctgtctttgtctccgggggaaanagccacctctcctgcagggccagtcagagtgttagcagctacttagcctggtaccaacagaaacctggccagtcctcccagctcctcatctatgatgcatccaacngggccacgtggcatcccagccaggttcaggtgcagtgggtctgggacagcttcattctcactatcagcacgcctagacgctgaatatttgctagtttattacgtgtcagtcagtcgtagctaacgtggtactcacttcctaccgttcggaccgaagggacaacggacgtggagagtacgaaaacgtagtacggtggactagacctccgnttaccg

SEQ ID NO: 255755 - DNA, 596 bp, Homo sapiens
  misc_feature: GYAE6OF01BR5QR.17.36.D03.1.454.CMB.1.raw
  modified_base (204)..(204): a, c, t, g, unknown or other
  misc_feature (204)..(204): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtccggggaaanagccaccctctcctgcagggccagtcagagtgtagcagctacttagcctggtaccaacagaaacctggaccagtcctccaggcctcctcatctatgatgcatccaacgcgggccactggaccactccccagccaggttcagtggcagtgggtctgggacaggtacttcattctacactatcagcagcctagacgcctagaagttattttgacttaagtttacttactcgtactacgctaggcgttaagaccgtaacgtcggaccttacagttacccgtacccgtttaccgggaaccgtaaagggggaacccaacggtacggtacgggaacggtaacgtaacggtaaaaccggaccgttagggtacggaccgttacgtcccgaacgttacccg

SEQ ID NO: 255756 - DNA, 523 bp, Homo sapiens
  misc_feature: GYAE6OF01AT493.17.36.D03.1.454.CMB.1.raw
  modified_base (311)..(311): a, c, t, g, unknown or other
  misc_feature (311)..(311): n is a, c, g, or t
  modified_base (434)..(434): a, c, t, g, unknown or other
  misc_feature (434)..(434): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagagtgttagcagctacttagcctggtaccaacagaaacctggccagtctccaggctcctcatctatgatgcatccaaacngggccactggcactcccagcccaggttcaaggtgcaggcgggtctgggacagactttcattctcaccatcagcagcctagagcctagaagtatttgctagtttattacgtgtcagcagcgtancaacgtggtctgactcaccttcggacctaacgggacacgacgtagggataagacgaaaacgacgtaggtacggactcgaccaccgtaac

SEQ ID NO: 255757 - DNA, 580 bp, Homo sapiens
  misc_feature: GYAE6OF01BQ30Y.17.36.D03.1.454.CMB.1.raw
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagagtgttagcagctacttagcctggtaccaacagaaacctggccagtcctccgagctcctcatctatgatgcatccaacgcgggccacgtggaccactccccagccgtaggttcaggtggctaggtgggtacgtgggaacaggtaccttcgatttcctaccacctatccagcacgccgtagacgccgtagaagttattttcgacttagtttattactgtacagtcagcgtagaccgtaacgtcggtactacactaccgtacccgttccggaccgtaacgggaccaccggacgtagggaacgtacgtaacggaaaccgtacgttcggtacggactcgaccgtaccgtacg

SEQ ID NO: 255758 - DNA, 573 bp, Homo sapiens
  misc_feature: GYAE6OF01D1B4A.17.36.D03.1.454.CMB.1.raw
  modified_base (206)..(206): a, c, t, g, unknown or other
  misc_feature (206)..(206): n is a, c, g, or t
  modified_base (315)..(315): a, c, t, g, unknown or other
  misc_feature (315)..(315): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagcccaccctgtctttgtcgtccgggggaaanagccaccctctcctgcagggccagtcagagtgttagcagctacttagcctaggtaccaacagaaacctggccagtcctccaggcctcctcatctatgatgcatccaacncgggccacgtggcactcccagccgtaggttcaggtggcaggtcgggtctaggggacagtaccttcgtacttcctacaccatcgacgcagtcctaaggacgccgtaggaagttatttgacttaagttttactacttggtactaggactaggtctagacctaagtcggctacattacccacggttccgaccgtaagggacctacggacgtaggaacgtagtaacgggaaaacctacgttcggacgacctcggccaacgtc

SEQ ID NO: 255759 - DNA, 802 bp, Homo sapiens
  misc_feature: GYAE6OF01EFWX3.17.36.D03.1.454.CMB.1.raw
  modified_base (206)..(206): a, c, t, g, unknown or other
  misc_feature (206)..(206): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtaccgggggaaancgccaccctctcctgcgagggccagtcagagtgttagcagctacttagcctggtaaccaacagaaacctggccagtcctccgacggctcctcattactatggattcgacactacccgaaacgtacggggaccctaacgttcggacctaacgtacccccgaacggtcccgaacggggtttccgaaggttcggggacctacggggttcgggggtacgttacgggggaactacggttaaccctttcgtaacgtttcctaccgaaccctatcccgtaacggacccgtaacgacccgttaaacgggtaccggtacccgttaagggtaaaacggttttaaccttttttgggaaccttttaacggttttttaaacgtttaccgttacggttaaccggtaacggtaccgacgggttacccggttaagtaaccccggtaacgtttacggggtacccttaacgtaacccgtttacccgtacccccgggtttaacggggacccggtaaaacgggtacccgtaacgggtaaccgttaggggaataacggttaaaccggaaaacggttcgttagggtacccggtacgaaccggtacctacccgttacgg

SEQ ID NO: 255760 - DNA, 646 bp, Homo sapiens
  misc_feature: GYAE6OF01AZXZA.17.36.D03.1.454.CMB.1.raw
  modified_base (205)..(205): a, c, t, g, unknown or other
  misc_feature (205)..(205): n is a, c, g, or t
  modified_base (315)..(315): a, c, t, g, unknown or other
  misc_feature (315)..(315): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaangccaccctctcctgcagggccagtcagagtgttagcagctacttagcctggtaccaacagaaacctggcctagtcctcccaggcctcctcatctatgatgcatccaacgngggccacgtgacactcccagccaggttcaggtcggcgtaggtcgggtcgtagggacagtacttctacttcctacctacctagtccgacgacgacgtaccctaaggacgaccgttaggaaacgttattttacggactttaaggttttacttacgttcgtacgtacgtcgtaacggtaccgtagaccgtaacgttcgggtaccttacgacgttacccgtaacccggttcccggaaccgtaaaccggggaccaaccgggtaccgtagggaacgtaacgtaacggtaaaacccgttacggtacggttacggacgttaccgaccgtaccgttaacg

SEQ ID NO: 255761 - DNA, 677 bp, Homo sapiens
  misc_feature: GYAE6OF01EVZC9.17.36.D03.1.454.CMB.1.raw
  modified_base (205)..(205): a, c, t, g, unknown or other
  misc_feature (205)..(205): n is a, c, g, or t
  modified_base (503)..(503): a, c, t, g, unknown or other
  misc_feature (503)..(503): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaanacgccaccctctcctgcagggccagtcagagtgttagcagctactagcctaggtaccaacaacgaaacctcggaccagtcctcccaggcctacatcatctagttgactcgactactacccgaacgacgggccacgtcggcctactcccgaacggcccgtaggttccgaagggtcggacgtacgggttcggggttaccgtacggggaacgtacggtaccttttaccgaactttccctaaccgtaaccctataccgacgaccgacgtacccgtaggacgtaccgtaaggtaaacggtttnttttacggacgtttaagtttttacttacgttagtaccgagtccgaaggtccggtacgaacctacgttcggcctaccgtactacccgtaccggtccggaacccggaaagggacccgaacggtagtacgggactaaggtaaacgaaacgtacggtgtaggaccctggacccctacg

SEQ ID NO: 255762 - DNA, 652 bp, Homo sapiens
  misc_feature: GYAE6OF01BGMNI.17.36.D03.1.454.CMB.1.raw
  modified_base (207)..(207): a, c, t, g, unknown or other
  misc_feature (207)..(207): n is a, c, g, or t
  modified_base (298)..(298): a, c, t, g, unknown or other
  misc_feature (298)..(298): n is a, c, g, or t
  modified_base (305)..(305): a, c, t, g, unknown or other
  misc_feature (305)..(305): n is a, c, g, or t
tcagcgtagactagcacgaccggtgctcgatttagctgcgtcacgatctctcttgggggaggaactgctcagttaggacccagagggaaccatggaagccccacctcagcttctcttcctcctgctactctggctcccagataccaccggagaaattgtgttgacacagtctccagccaccctgtctttggtcgtccgggggaaagngcccaccctctcctgcgaggccagtcagagtgtagcagtctactagcctaggtaaccaacacgaacctggccagtccacccgaggctcctnactctantatcgctactaccaacgacgggccacgtcgactaccgtcccgacgaccgtaggttacaggtcggtcgtagggttgggtacgtaggggactaggtacctttcgacttccgactacccgtatccgaacgtacgacggtacccgtagggacgtaccgtaaggtaaagttacgttttacgtacgtttaagttttacgttacgtcgtacgagtacgtacggtacgtaacgacgtacgtccgtcgtactacgttccgtacgtacccggaacgaaccgggtacgacggtacggtacggtaagtaacgacggtaaacgtacgtcggtacgtaccgtagaacctcgtacgttaccg

SEQ ID NO: 255763 - DNA, 503 bp, Homo sapiens
  misc_feature: GYAE6OF01B7DGT.17.36.D03.1.454.CMB.1.raw
  modified_base (204)..(204): a, c, t, g, unknown or other
  misc_feature (204)..(204): n is a, c, g, or t
  modified_base (310)..(310): a, c, t, g, unknown or other
  misc_feature (310)..(310): n is a, c, g, or t
  modified_base (432)..(432): a, c, t, g, unknown or other
  misc_feature (432)..(432): n is a, c, g, or t
  modified_base (441)..(441): a, c, t, g, unknown or other
  misc_feature (441)..(441): n is a, c, g, or t
  modified_base (474)..(474): a, c, t, g, unknown or other
  misc_feature (474)..(474): n is a, c, g, or t
  modified_base (492)..(492): a, c, t, g, unknown or other
  misc_feature (492)..(492): n is a, c, g, or t
  modified_base (498)..(498): a, c, t, g, unknown or other
  misc_feature (498)..(498): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaancgccaccctctcctgcagggccagtcagagtgttagcagctacttagcctggtaccaacagaaacctggccagtcctccaggcctctcatctatgatgcatccaancgggccatggcactcccagccaggttcagtgcaggtgggtctgggacagacttcattcacacatcagccagctacgagcctagaacgtattttgacttagtttattactgtcagcagcgtanccagtgctnactcaccgttcggaccaggaccacgactgagtnagaaacgacgtgtacggntgaccnctacg

SEQ ID NO: 255764 - DNA, 663 bp, Homo sapiens
  misc_feature: GYAE6OF01A7ULW.17.36.D03.1.454.CMB.1.raw
  modified_base (208)..(208): a, c, t, g, unknown or other
  misc_feature (208)..(208): n is a, c, g, or t
  modified_base (651)..(651): a, c, t, g, unknown or other
  misc_feature (651)..(651): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagcccaccctgtctttgtccgtaccgggggaaanacgcccaccctctcctgcagggccagtcagagtgttagcagctacttagcctaggtaccaacgagaaacctggccagtcctcccaggcctcctcatctatgactgctactcccgaacgacgggcccacgtcggaccacgtaccccgagcccgtaagggttccaggtcggcgtaggttcgggtcgtcggggaactacggttacctttccgagtttaccctaccgtacctaacttccgaacgtaccacggtacctaaggaccgtccgtaaggtaagttacgttttcggactttaagtttaacgtttactggtacctaagtacgtacggtccgttaagaccgtaacgttcggtactacgtaactccgtaaccgttcgaccggtaaggacctaaccgggtacgtagaacccggtagtaacggaacggtaactgggtacgaccgttcncgtaaccgtacg

SEQ ID NO: 255765 - DNA, 608 bp, Homo sapiens
  misc_feature: GYAE6OF01D2UD1.17.36.D03.1.454.CMB.1.raw
  modified_base (206)..(206): a, c, t, g, unknown or other
  misc_feature (206)..(206): n is a, c, g, or t
tcagcgtagactagcacgaccggtgctcgatttagctgcgtcacgatctctcttggggggaggaactgctcagttaggacccagagggaaccatggaagccccagctcagcttctcttcctcctgctactctggctcccagataccaccggagaaattgtgttgacacagtctccagccaccctgtctttgtcgtaccgggggaancgccaccctctcctgcacgggccagtcagagtgttagcagctacttagcctggtaaccaagacgaaacctggaccagtcctccaggcctcctcattctatgatcgacactacccaagcgggccagtcggactactcccgagcctaggttcaggtggctaggtcgggtcgtagggactagtacttacgatttcctaccaactatcgagacacgtccgtagacgtcctagtaagttattttgactttagtttactagtcgtacagctacggtcgtaacgctaacgtggtacctactaccgtcgtaccgttaccgggaccaaacgggacctaaccggtacgtagggaagttacgaacggtaaaacggtacgttagggtacggaccttcggacccgtaacgtaccg

SEQ ID NO: 255766 - DNA, 743 bp, Homo sapiens
  misc_feature: GYAE6OF01C0ACL.17.36.D03.1.454.CMB.1.raw
  modified_base (211)..(211): a, c, t, g, unknown or other
  misc_feature (211)..(211): n is a, c, g, or t
  modified_base (301)..(301): a, c, t, g, unknown or other
  misc_feature (301)..(301): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtcctccagccctaccctgttctttcgtcgtaccgggggaaancgccacctctcctgcagggccagtcagtgtgtagcagctactgccgtagtaccaacacgaaccgtggccagtcctccgaggtcctccctnacttctagtgtactcgactaccgtaccgaacggacgggcccacgtccgggactaaccgtccccgaacggtcccgtaacgggtttccgagggttacgggtacggtacggggttcgggtacggtacggggaaccgttaacgtacgttttccgtaacgtttcctaacccgtacctaactccgtaacgtaaccgaccgtaccgtaacggaacgtaccgtaagggttaacgtttaacgttttcggtaacgtttaacgttttagttaccgttacgtacgtacggcgtaacgtacgtaacggtaccgtaacgtcggtacctaccgttaactcccgtaaccggttacccgggtaaccggtaaacgggacccgtaacgggacgtaacgggtaacgtaacggtaacggaaaaccgtgtacggttcggaactacccggtactaccggttaccg

SEQ ID NO: 255767 - DNA, 736 bp, Homo sapiens
  misc_feature: GYAE6OF01BG80P.17.36.D03.1.454.CMB.1.raw
  modified_base (215)..(215): a, c, t, g, unknown or other
  misc_feature (215)..(215): n is a, c, g, or t
  modified_base (609)..(609): a, c, t, g, unknown or other
  misc_feature (609)..(609): n is a, c, g, or t
  modified_base (708)..(708): a, c, t, g, unknown or other
  misc_feature (708)..(708): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagactaccacggagtaaattgtgttgacacagtcctccacgcccacccttgttctttcggtccgtaccgggggaaanacgccctaccctctcctgacgacgggcctagtcgagtacgttgtacgcagtcttacgttacgccgtacggaaccaacgaacgtaaaccgtcggaccctacgttcccgtacccgaggtcctacctcactttcctagtcgaacttcggacctaaccgtaccggaaaccgtcggggaccctacggtcggtaccctaaccgtccccgtaaggtacccggtaggggtttaccacggggttcggaccggtagggtcggggtccgtaaggggaacctacggtacctttactacgttccctacgtaacctacgttacgaacggttcgaaccgttacctaacggaccgttaccgttaagtacgtttacgtttacgacttttaggtttaacttcgtcgtaacgngttacgacggtcgtaagccgtaagtcgtacttacgacgtaccgtaaccgtccgggactaagggtacccgagtacggtaaggtactagaacggtaaaccnggttcgacggtactccggactaccgtcg

SEQ ID NO: 255768 - DNA, 262 bp, Homo sapiens
  misc_feature: GYAE6OF01A0CT0.17.36.D03.1.454.CMB.1.raw
  modified_base (256)..(262): a, c, t, g, unknown or other
  misc_feature (256)..(262): n is a, c, g, or t
tcagcgtagactagcacgaccggtgctcgatttagctgcgtcacgatctctctgggacagacttcattctcaccatcagcagcctagagcctgaagattttgcagtttattactgtcagcagcgtagcaactggctcatcaccttcggccaagggacacgactggagatgaaacgaactgtggctgcaccatctgtcttcattccttcccgcctatctgactagtctacgctgagcgggctggcaaggcgcatagnnnnnnn

SEQ ID NO: 255769 - DNA, 506 bp, Homo sapiens
  misc_feature: GYAE6OF01E1ADK.17.36.D03.1.454.CMB.1.raw
  modified_base (204)..(204): a, c, t, g, unknown or other
  misc_feature (204)..(204): n is a, c, g, or t
  modified_base (357)..(357): a, c, t, g, unknown or other
  misc_feature (357)..(357): n is a, c, g, or t
  modified_base (371)..(371): a, c, t, g, unknown or other
  misc_feature (371)..(371): n is a, c, g, or t
  modified_base (445)..(445): a, c, t, g, unknown or other
  misc_feature (445)..(445): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaangccaccctctcctgcagggccagtcagagtgttagcagctacttagcctggtaccaacagaacctggccagtctcccaggctcctcatctatgatgcatccaacagggtccacgtggcatcccagcctaggttcagtgcaggtggctgggacngacttcatctcacntcagcagcctagatcgtagagtatttgctagtttatactgtcacgcgagcgtagacctacgtggtctcactacnccgttacgacgtaacggacacgtactggagtacgtacgaacgacgtgtacgctcgcactcg

SEQ ID NO: 255770 - DNA, 617 bp, Homo sapiens
  misc_feature: GYAE6OF01CFXFZ.17.36.D03.1.454.CMB.1.raw
  modified_base (205)..(205): a, c, t, g, unknown or other
  misc_feature (205)..(205): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaanacgccaccctctcctgcagggccagtcagagtgtagcagctacttagcctggtaccaacagaaacctggccagtcctccaggtctcctacatctatgatcgcactaccaacgagggccaagtcggcacgtcccagcctaaggttcaggtcgcgtaggtcgggtctgggactagtacttcgaactttccaccgacctatccgacgaccaacggtacctaaggacgtccgtaggtaaacgttagttttcgacgtttagttttaacttacgttgtaccgaacgtcgaaggtcgtaacgacctaacgttcggaccttacgtactacccgtacccgttacggacccgaaacgggtaccacggtacgtaggaagtaacgtacgaaaacgacgttggacggactacgaccgtacgtacg

SEQ ID NO: 255771 - DNA, 687 bp, Homo sapiens
  misc_feature: GYAE6OF01EGSV7.17.36.D03.1.454.CMB.1.raw
  modified_base (205)..(205): a, c, t, g, unknown or other
  misc_feature (205)..(205): n is a, c, g, or t
  modified_base (288)..(288): a, c, t, g, unknown or other
  misc_feature (288)..(288): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaangccaccctctcctgcagggccagtcagagtgttagcagctacttagcctggtaccaacagaacctggccagtctccagctccnatctatgatgcatccaacgacgggccacgtcggcactaccccagcctaggttcaggtcggctaggtgggtctaggggacaggtccttacattcctaccaactagtaccagccacgtaccctaggaccgtaccgtaggtaaacgttatttttacgggacctttaaggtttttaacgttaccgttacggttaccgaacggttccgtaacggtaccggttaacgtaccgtaaaccgttcgggtaccttaccgtaaccttacccgtaaccccggtttcccgggaacccggttaaaccgggaacccgtaacgggtaccggtacgggaaacggtaaacgttaacgggtaaaacccggtacgtttacgggtacgggttaccctacggtacccgtaacccgttaccg

SEQ ID NO: 255772 - DNA, 758 bp, Homo sapiens
  misc_feature: GYAE6OF01BSQVB.17.36.D03.1.454.CMB.1.raw
  modified_base (221)..(221): a, c, t, g, unknown or other
  misc_feature (221)..(221): n is a, c, g, or t
tcagcgtagactagcacgaccggtgctcgatttagctgcgtcacgatctctcttgggggaggaactgctcagttaggacccagagggaaccatggaagccccagctcagtcttctcttcctcctgctactctggcctcccagactaccaccggaagaaattggtgttagacacagtcctccacgcccacccttgttctttggtccggtacccgggggaaanacgccccaacccttcctccgtcgacgagggccagtacagtagtgttagcacgcttacttacgccgttacggaacctaacgaacgaaaccgtcggacctacgtcctacccgacggtcctcctactacgttcctaatcggtactcgacctacctacccgaaacggaccgggtacctaccgtcggacctaacgtcccccgaaggtcccgtaaggttaccgagggtcgacgtagggtccgggtacgtacggtacgtacgttacctcgtacttaccgtacctactacgtaccgacgtaccgacgtaccgtacggacgtcgtaaggtaattcgttttacgactttaagttttactacgtcgttacgagttaccgtacgtccgtaagaccgtaacggtggtacccttcgttaaccttacccggtaacccggttaccggggaacccgttaaacggggaaccctaaggggtaaccgaaggggtaacgttaacgaaacgtaaaccggttcgttacggggtacacccgttacggaccttaaccgtacg

SEQ ID NO: 255773 - DNA, 650 bp, Homo sapiens
  misc_feature: GYAE6OF01B5BR2.17.36.D03.1.454.CMB.1.raw
  modified_base (206)..(206): a, c, t, g, unknown or other
  misc_feature (206)..(206): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtaccgggggaaancgccaccctctcctgcagggccagtcagagtgtagcagctactagcctggaaccaacacgaaacctggccagtcctcccgagcctcctcatctagtgatgcactccgaaacgcgggcctagtcgcacgtcccgagccgaggtcaggtcggcgtagggttcgggtcgtcgggactaacgtcttactattcccgtaccacactacgacgtaccgacgtaccctaggacgtccttagtaaaggtttatttacgggtacttaaggttttaactttaccgtggtaacccaggtccgtagtacccggtaagaccgtaacgttggcccttacgtaacgtacccgtaccgttacccgggacaaacggggacctaccgggtacgtagggaacgtaacgttaacggaaaacgggtaacgttcgggtacggtaccctacgaacccgttccgtacg

SEQ ID NO: 255774 - DNA, 271 bp, Homo sapiens
  misc_feature: GYAE6OF01BP22W.17.36.D03.1.454.CMB.1.raw
  modified_base (228)..(228): a, c, t, g, unknown or other
  misc_feature (228)..(228): n is a, c, g, or t
  modified_base (260)..(271): a, c, t, g, unknown or other
  misc_feature (260)..(271): n is a, c, g, or t
tcagcgtagactagcacgaccggtgctcgatttagctgcgtcacgatctctctgggacagacttcattctcaccatcagcagcctagagcctgaagtattttgctagtttattactgtcagcagcgtagcactggctcatcaccttcggccaagggacacgactggagatagaaacgactgtggctgcacatctgtcttcactccttccgcatctgtactgtctacgntggacggcggtctggacgaaggccacaagtgnnnnnnnnnnnn

SEQ ID NO: 255775 - DNA, 894 bp, Homo sapiens
  misc_feature: GYAE6OF01CJK3T.17.36.D03.1.454.CMB.1.raw
tcagcgtagactagcacgaccggtgctcgatttagctgcgtcacgatctctcgttgggggaggaactgctcagttaggacccagagagaaccatggaacgccccagctcagcttctcttcctcctgctactctggcctaccagactaccgaccggaagtaattgtgttagacacagtcctccacgcctacccttgttccgtttcggtaccggtaccgggggaaagaccgccctacccgttcctccgtcggacggacgggcctaggtacgaggtagttaggtacgacacggtacttacggttacggaccgttacggtaaaccaacgtaacgtaacgtcggacctacgtcccaccgacggtccctacctactaacttactagtagtactcgaacctacgacccgaacggtacgggaccctacggtacggtaccctacccgacccgtaccggtaccgttaagggtaccgtaacggggtcgggtaccggtaggggttacggggtcggtaacggggtaacctaccggttaacctttaggttacctttacccgtaaccgtaaccctagtacccgtagaccccgtaacgtaaccggttaaggtaccggttaaccgttaaagggttaaggtttacctttttaaccgggaaacgtttttacgttttaaacttacccggttagtttacccggaacggttaacgggtccgttaaacggggtttacgtaacccgtaaccgggttccggtaaccgttaacctacccggttaacccgtaccgggttaacccgggaaaaccggtaaacgggttaacccggtaccgggtaacggtacgggaaaagtttacccggaaaacggttaccgtaccgggtttaagggccgttaacgcccggtaacccttaacggg

SEQ ID NO: 255776 - DNA, 851 bp, Homo sapiens
  misc_feature: GYAE6OF01DMOQB.17.36.D03.1.454.CMB.1.raw
  modified_base (204)..(204): a, c, t, g, unknown or other
  misc_feature (204)..(204): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtccggggaaanacgccaccctctcctgcagggccagtcagagtgttagcagtctacgttacgcctaggtaccaaacgagaaaccgtggaccctagtcctacccgaggtccttccgtcctacttacctagtcgtatcggactactacccaacggaggacccacgtacgggctaaccgtccccgaggtacccgtaagggtttccgaaggtcgggtacgtacgggttacgggggttactcgggggtaaacctacggttaccccgttttacgtaacttttacccgttacccgaaccgttaacgttacccgaaacggtacccgtaaccgggttacccgttaaaagggaccccgggtttaaccctttaagggttaaaaccggttttacgttttttaccgtaaacggttttaacgttttttaaacgtttacccggtttacgttaaccggtaacggtaaccgttacgggtacccgtttaacggaacccgttaacgggttccgggtaacccttagtaaccgtttacccggaacccggttacggggaaacccgtaaccggggaaccgttaacgggtacggttaacgggtaagtaaaccgggttaaccgtaaaaccggttacgggtacggtaacccgttacgtacccggtaaacctcggtttaaaccgg

SEQ ID NO: 255777 - DNA, 936 bp, Homo sapiens
  misc_feature: GYAE6OF01CT6D3.17.36.D03.1.454.CMB.1.raw
  modified_base (208)..(208): a, c, t, g, unknown or other
  misc_feature (208)..(208): n is a, c, g, or t
tcagcgtagactagcacgaccggtgctcgatttagctgcgtcacgatctctcttgggggaggaactgctcagttaggacccagagggaaccatggaagccccagctcagcttctcttcctctgctactctggctcccagactaccaccggagaattgtgttgacacagtctccagcccaccctgttctttggtcgtaccgggggaaanacgcctaccctctcctgcgacgggccagtcaggagttgtagcagtcctacgttacgccgttaggtaaacccaaacgaacggaaaccccgtgggacccctaaggttcccgtaccccgtaacgggtcccttacccttacctaacgttccgttaagtacggtaacttcggacctaaccgtacccccgaaaccggaccggggaccctaaccggttgggaacccaccgttacccccgacgtacccggtaaccggggtttacgacgggttacgggtaccgtaagggggtttccggggttacggttaaccggggaaccttaaccgggttactttaccggtaacctttttacccgaccctaacccgttacgttaccgaaccggtccgtaaccgggttaccccgaaagggttccccgtaaccgtttagggtaaaacgtttacgtttttacgacgggtttttaaatttttaacgtttacttaacggtttacgaacggtaccgtaacgggttacccgtaagggtaacctaaccgggttcgttaacccgttcttaacccgttacccgtttaaaccccggggttcccgggaacccgggtaaaacccggggtaaccgttaacccggggtaaccggtaaggggaaaccggtttaaaccggggaaaccccggttaaacgggtttaaacccgggcggttttaccggggaacccgtttaacggtacccccgtaaaccgtttaccgg

SEQ ID NO: 255778 - DNA, 844 bp, Homo sapiens
  misc_feature: GYAE6OF01D9EVT.17.36.D03.1.454.CMB.1.raw
  modified_base (109)..(109): a, c, t, g, unknown or other
  misc_feature (109)..(109): n is a, c, g, or t
  modified_base (290)..(290): a, c, t, g, unknown or other
  misc_feature (290)..(290): n is a, c, g, or t
tcagcgtagactagcacgaccggtgctcgatttagctgcgtcacgatctctcgttgggggaggaactgctcagttaggacccagagggaaccatggaagccccagctcngcttctcttcctcctgctactctggctcccagactaccacggagtaattgtgttgacacagtctccacgccacctgttctttggtcggtaccggggaagcgccctaccctctcctgcgacgggcagtcgagtagtgtagcagtccttacgttcgcctacggtaaccaacgaacgtaaaccncggtaccacgtccctcccgaggccctaccctctaacttctagtcgactacgaccacgtacccgaacggtccgggacctacgtcggacctacgtaccccgacgaccgtaggtaccgtggtacggtcgtacggtcggggtcgtacggggtaacctacggtaccgtttctaacctttccgtacctaacccacgttaccgacggtacccgtaaggtaccccgtaagggtaaccgtaccggttaacggttaacgtttaaccggttttaccggttaccggtttttaacggtttttaaccggtttaccgttacggttaccggttaacggtaccgtaacgggtttaacccggttacggaaacccggttaaccggttaccggtacccttttaccccggtaacgtttaccccggttaaccccggtttaacccggggaacccccggtaaaaggggtaaccccgtaaacgggaccggtttaagggaacggttaaacggtaaaccggtaaaccggtaacggttaccggggtacccggttacgtaaccggacccgttacggttaccgg

SEQ ID NO: 255779 - DNA, 687 bp, Homo sapiens
  misc_feature: GYAE6OF01CNU67.17.36.D03.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (262)..(262): a, c, t, g, unknown or other
  misc_feature (262)..(262): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggganaaattgtgttgacacagtctcagccacctgtctttgctccgggggaanacgccaccctntcctgcagggccagtcagagtgtagcagctacttagcctaggtaaccaanacgaaaccgtggaccacgtcctccaggcctcctcatcctatggtatcgacactaccccgaaacgtcgggacccacggtacggacccaacgtccccgaacggaccctaacggggtttcaacgggttcggggactagggttcgggtccggtagggaactacgtctttacacgtttcctacgacctatccaagtcacggtactaacgacgtaccgtaggtaatttacggttttacgacgtttaagttttaacgttacgttacggttacaaggacctagggaccgttaacggacctaacggtcgtaccgttactacttaccgtacccgttaccgggaaccggtaaaccggaccgaacggttccgtagggaaacgtacggtaaacgtaaacggtaacggtcggtcggaccttacgcccgtaaccttacgg

SEQ ID NO: 255780 - DNA, 805 bp, Homo sapiens
  misc_feature: GYAE6OF01A5L5F.17.36.D03.1.454.CMB.1.raw
  modified_base (171)..(171): a, c, t, g, unknown or other
  misc_feature (171)..(171): n is a, c, g, or t
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (227)..(227): a, c, t, g, unknown or other
  misc_feature (227)..(227): n is a, c, g, or t
  modified_base (276)..(276): a, c, t, g, unknown or other
  misc_feature (276)..(276): n is a, c, g, or t
  modified_base (315)..(315): a, c, t, g, unknown or other
  misc_feature (315)..(315): n is a, c, g, or t
  modified_base (629)..(629): a, c, t, g, unknown or other
  misc_feature (629)..(629): n is a, c, g, or t
  modified_base (643)..(643): a, c, t, g, unknown or other
  misc_feature (643)..(643): n is a, c, g, or t
tcagcgtagactagcacgaccggtgctcgatttagctgcgtcacgatctctcttggggctcagagaggtgccttagccctggattccaaggcatttccacttggtgatcagcactgaacacagaggactcaccatggaggttggggctgtgcgttgggttttccttggttncttagttttagaaggtgtcagtgtggaggtgcgngcgtgggtgngtcggtgggggngtcgttcggtaccggtcggtcgggggtcctgacgtctcctcgtgtagcnccgtcgtggtacttccgtccttacgacgttaaccgtacngctacgtacggtaacggttcccggggttacccgaccgttaaccggggttaccggaagggggggttaacgggttccgggtggggtaagggtttggggtccgtaaccgtaattaacgttaaggtttaaggtaggttacgtagttaactttacggttaccctaaatttaacgttacccgtaaccggtctaaacggtaccgttcgttacgggtacgggggtaacgggtacccttacgttacccaacccgttactcccgaaacccggaagtaaccggacgttaggtaaccgaaccgaaacgtaacccgtctaacggttnttacgtccggtaanaaccttaaagtacccgggtaactcggttaacccggtaaggacccggtaaccggacccgaaccggtacggtagtttcccgttaaagggttacctttaaggtcgggtaaacgggaccgtaagggtacccttaaccgtcccgttggggtagttaccggtaagggg

SEQ ID NO: 255781 - DNA, 707 bp, Homo sapiens
  misc_feature: GYAE6OF01B5IJW.17.36.D03.1.454.CMB.1.raw
  modified_base (208)..(208): a, c, t, g, unknown or other
  misc_feature (208)..(208): n is a, c, g, or t
  modified_base (238)..(238): a, c, t, g, unknown or other
  misc_feature (238)..(238): n is a, c, g, or t
  modified_base (294)..(294): a, c, t, g, unknown or other
  misc_feature (294)..(294): n is a, c, g, or t
  modified_base (311)..(311): a, c, t, g, unknown or other
  misc_feature (311)..(311): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagactaccaccggagaaattgtgttgacacagtctccacgcccaccctgtctttgtcgtaccgggggaanacgccaccctctcctgcagggccagtcagngtgtagcagctacttagcctaggtaccaacacgaaaccgtgacctagtcctaccgngtcctcctcattcctangactgctactacgaaccgtcgggacccacgtcggactaacgccccgacgacccgtaggttcacggtggacgtaggttcgggtaccgagggtaacgacgttacttacgtacgttcctaccgtaactacgttcgacgaccgtacgtaccgtacgacgtcgttaagggtaatttacgtttacgtacgtttaacgttttacgttacgttggttacacggtactaacggacgtacgtacgtacgtacggccttacaccgttacccgtaccggttaccgaacccggttacgggaaccgtaaccggttaacggtacggggtaacgtaaacgggttaacgggtaaacccgtaacgggttacgggttacccggaacggtcccgttaaccgtacccggtttaaccg

SEQ ID NO: 255782 - DNA, 955 bp, Homo sapiens
  misc_feature: GYAE6OF01EKMZV.17.36.D03.1.454.CMB.1.raw
  modified_base (232)..(232): a, c, t, g, unknown or other
  misc_feature (232)..(232): n is a, c, g, or t
tcagcgtagactagcacgaccggtgctcgatttagctgcgtcacgatctctcgttgggggaggaactgctcagttaggacccagagggaaccatggaacgcccagctcagcttctcttcctctgctactcgtcggctccagactaccgacggtaagtaattgtagttacgactactacgtcctaccgacgccctaccgttgttcgtttcggtaccggtaccggggggaaacnccggtacccctacccgttcctcccggtacggaccggtacggggaccctaggtaccgaaggttaggttacggttaacgaccgtaacggtacctttaacgttaccggtaccgttaacgggtaaacccaaacgtaaccggtaaaccggtcggtaccctacggttcccgtaccgacggtacccttaccgtactaacttacttagtcggtatacgacctaacgtacccgaaacggccgggtacctaacgtccggacctaccgtacccgacggtaccgtaaggttccgaggtacgggacgttacggggttacgggacggtacgggtaacctacggttaccttaccgtacgttacccgttaccaaccgttacgtaaccggtacgaaccccgttaaccggttaccggtaaaacgggtacccggttaaccggtttaaagggttaaacggtttttacgttttaaccgggttaaacccgtttttaagttttaaacccggtttacccgttacgggttaaacccgggaacccggttagttaaaccccgggtacggtttaacccgtaaacggtacccggttaacgggtacccttaacccgttaacccgttaccccggttaaccgggtaaccggtaaccgggaaaccgggttaccacgggtaaacgggtagggtaaactaacgggttaacggaaaccttgggttaacgtcccgggtaacacgttaacccgtcgttacg

SEQ ID NO: 255783 - DNA, 827 bp, Homo sapiens
  misc_feature: GYAE6OF01CGXSR.17.36.D03.1.454.CMB.1.raw
  modified_base (214)..(214): a, c, t, g, unknown or other
  misc_feature (214)..(214): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagactaccaccggagaaattgtgttgacacagtcctccacgccctaccctgttctttgtccggtaccgggggaaanacgcccaccctctcctgcgacgggccagtcagtaggtgtacgcagtcttacgtagtccgtacggtaaccaaacgaacgtaaacccgtcggaccctacgtccctacccgaggtcccctaccctctacttcgtactagtacttccgactaaccgtaacccgaaccggaccgggtacccctaacgtccggaccctacccgtaccccccgtacggtacccgttaacgggggttccaacggggtcgggtacgggtacgggtttcggggttaccggacggggtaactacggttacctttaaccgtactttcccgtacctaacctacgtccgaacgtccgtaccggtaccgtacgaccggtaccgtagtaaacggtttgttttaccgacttttaagttttacgtacgtcgtacggtacgtccgaacgtaccgtaacggtactaaccggtcgttaaccgtctaaccgttacccggttaacccggttacgggaaacccgggtacggtaacccgtaaccgggttaaacggtagggtaaaccggtaacgttaaaccgggtaaaaaccggtttccgggttaacggccggggttacctaaccccggtccgtaaacccgttttcccg

SEQ ID NO: 255784 - DNA, 573 bp, Homo sapiens
  misc_feature: GYAE6OF01B216Z.17.36.D03.1.454.CMB.1.raw
  modified_base (204)..(204): a, c, t, g, unknown or other
  misc_feature (204)..(204): n is a, c, g, or t
  modified_base (379)..(379): a, c, t, g, unknown or other
  misc_feature (379)..(379): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaancgccacctctcctgcagggccagtcagagtgttagcagctacttagcctggtaccaacagaaacctggaccagtcctcccaggcctcctcatctatgatgcatccaacgagggccacgtggcactccccaagccaggttcaggtggcaggtgggtctgggacagtacttcattcncaccatcagcagcctagacgccgtagaacgtattttgacttagtttattacgtgtacagcaggcgtagcgtaacgtcggtacctactacgtacctacccgttaccgggacccgaaaggggaccctacgggacgttaggggaagtaacggttaacggaaaacgtacgttaggtcggtacgtcggtaccacgtacg

SEQ ID NO: 255785 - DNA, 705 bp, Homo sapiens
  misc_feature: GYAE6OF01BNEL8.17.36.D03.1.454.CMB.1.raw
  modified_base (207)..(207): a, c, t, g, unknown or other
  misc_feature (207)..(207): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagactaccaccggagaaattgtgttgacacagtctccagccaccctgtctttgtcgtaccgggggaaancgccaccctctcctgcgagggccagtcagtagtgttagcagtctacttacgccgtaggtaaccaacacgtaaacctcggaccagtcctaccgaggtcctcctcactctatgatcgacactaccgaacgcggcctagtcgacacgtcccagcctaggttcaggtcggcgtaggtcgggtcgtagggactacgtacttcgtacttcacctacctatcaacgtacacgtacccgtagaccgtaccgtagtaaacgtttcgttttacgacgtttaacgttttacgttacgttcgtacggtaacggtacgtacgggtaccgtaacggtacccgtaaacgttccggtaccttaactaccgttaacccgttaccccgggttaaccggtaacccggaaacgggtaaccctaaccgggtacgttaaggggaaaccttaacgggttaaaaccggaaaccgttacggttacgggtaacgtaccgtacggtaacccctaacgtttacccg

SEQ ID NO: 255786 - DNA, 716 bp, Homo sapiens
  misc_feature: GYAE6OF01A6SV3.17.36.D03.1.454.CMB.1.raw
  modified_base (148)..(148): a, c, t, g, unknown or other
  misc_feature (148)..(148): n is a, c, g, or t
  modified_base (198)..(198): a, c, t, g, unknown or other
  misc_feature (198)..(198): n is a, c, g, or t
  modified_base (313)..(313): a, c, t, g, unknown or other
  misc_feature (313)..(313): n is a, c, g, or t
tcagcgtagactagcacgaccggtgctcgatttagctgcgtcacgatctctcttgggggaggaactgctcagttaggacccagagggaaccatggaagcccagctcagcttctcttcctctgctactctggctccagataccacgganaaattgtgttgacacagtctcagccacctgtctttgcgtaccggggaaancgcctacctcgtcgtgcgcggccgacgtcgagtaggttgttacgctagtacttacgttacgcgtacggtaaccaacacggtaactcggactacggtcctaccgaggtccttaccncgtaactctacgtggactacggctacgtaccgaacggaccgggtaccacgtacggacctaccggtacccgtaaggtccgtaggtttacagggtttacgcggtaacgggttcgggtacgtacgggtactaacgggttcttactacgttccgtaactacctacgtacgacgtaccaggtaccgtaggtacctacgtagttaaagttcgttacgtaacgtttacgttaacgttacgtacgtaagacgtacgggtaacgcggtaataccgtaaccgttggaaccttagtccgttacgtaaccgacgggtaaccgacggtaccgtaggtaccgggtataaacggaccggtttaacgaaacggttcccggtagggtaccgtacccggttctaaacccgtcttacccggg

SEQ ID NO: 255787 - DNA, 710 bp, Homo sapiens
  misc_feature: GYAE6OF01ETIP5.17.36.D03.1.454.CMB.1.raw
  modified_base (344)..(344): a, c, t, g, unknown or other
  misc_feature (344)..(344): n is a, c, g, or t
tcagcgtagactagcacgaccggtgctcgatttagctgcgtcacgatctctcgttgggggaggaactgctcagttaggacccagagggaaccatggaagccccagctcagcttctcttcctcctgctactctggcctcccagactaccaccggaataaattgtgttagacacagtcctccacgccctacccttgttcctttcggtaccgtaccgggggaaacgcgccctacccgtcctccgtgcgacggcctagtcagtagtgtacgcagtactactacgcctacgtaaccgaacgaacgtaaccgtggaccacgtcctaccgacggtcctcctactactctancgactgaccgactacccgaaggaccgacctacgtcggcctaacgtcccgagtccgtaacggttcgcggtaggccggtaggtcgggttacgacggggacctaaggtacctttacgtacgttaccttaccgacctagtacgacgacgtaccgtacgaacgacgtacctaggttaagttacgtttactaacgtttagtttacgttacaggttaccaacgtcggtaacgtcgtaacgtaccggtactacggtacctaccgtaactaccccgttaccgaaccggtaaccgggtaaacgacccggtaacggtacggttaggaacgtacggaaaccgtacggtaacgtcggacgtaccgaccgtcacgttacg

SEQ ID NO: 255788 - DNA, 701 bp, Homo sapiens
  misc_feature: GYAE6OF01EVHRD.17.36.D03.1.454.CMB.1.raw
  modified_base (209)..(209): a, c, t, g, unknown or other
  misc_feature (209)..(209): n is a, c, g, or t
  modified_base (562)..(562): a, c, t, g, unknown or other
  misc_feature (562)..(562): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagtaaattgtgttgacacagtcctccagcccaccctgttctttgcgtaccgggggaaancgccctaccctctccgtgcgacgggccagtcagtagtgtacgcagtcttacttacgcctaggtaacccaaacgtacgaaacccgtcggacctaacgttcctacccgacggtcccttacccgtacaactttacgtagtacggtacgttcggaccctaccttaacccgaaaccggtacggggacccctacggtcggtacctacccgttaccccgacggtaccgtaacggtttaccgaggtcggacgtacgggttcggtcggacgggactacggtaccttctacgttcctacgactactaccgagtaccacgtacttagacgtacgtagagtttattcgatttacgtttatacgtnacgactcgacgtacgacgacgtacgtgtcctacgtacgacccgttaggtaccggacgtaaaccggaccgaagtacgtaagggacgttaaacggacgtaaaaccggtgttacggtacgagttacccggaactccggtacg

SEQ ID NO: 255789 - DNA, 835 bp, Homo sapiens
  misc_feature: GYAE6OF01EAW1A.17.36.D03.1.454.CMB.1.raw
tcagcgtagactagcacgaccggtgctcgatttagctgcgtcacgatctctcttgggctcagagaggtgccttagccctggattccaaggcatttccacttggtgatcagcactgaacacagagactcacagtggtagttgggctgtgtcgttggttttcttgttgtcttagtttagaggttgtcgtagtgtgaggtgcgagtcgtggtggtaggtcggtgggggtacgtcgttcggtacccggtccggtcgggggtccctaggacgtaccgttcctccgtagtacgacgtccgttgtcggtacttccgtccttacgtacgtacctacgacgtactagtacgtacggttccgggtacccgtaccggttacgggttaccgggaagggggttacggttcggtagggtacggttacgggtacgtaacgtaagttacgttaaaggtttacggttaacggttaggttacgtacgtttaacgtacctaagttaacgttaccgtaacggtactaagttaccgttaggttacgggtacggggtaacccggtacctttaaccgtaccgtaaccttaccgttacccgtaaccggtaagggtacgtaaaccggttacgtaacccggaaaccttaaacggttacccttaaccggttaacgtttaagtttacctaacgtaacggtaaacctaaacggttacccgtaaacgttacccggttaacgttaaacgggaaacgtaacccgggtaacaaccgggtcggttacgttaacgggttttattaacgttaccgggttgggaccgtaaccgggtagtccgtaccgtcccgtaaggtcgtcggtaaccggg

SEQ ID NO: 255790 - DNA, 761 bp, Homo sapiens
  misc_feature: GYAE6OF01ESKVQ.17.36.D03.1.454.CMB.1.raw
  modified_base (206)..(206): a, c, t, g, unknown or other
  misc_feature (206)..(206): n is a, c, g, or t
tcagcgtagactagcacgaccggtgctcgatttagctgcgtcacgatctctcgttgggggaggaactgctcagttaggacccagagggaaccatggaagccccagctcagcttctcttcctctgctactctgctccagataccacggagaaattgtgttgacacagtcctccagcccaccctgttcgtttgtcgtaccggggaaancgcccaccctctccgtgccgagggccagtacgagtagttgttacgcgagtcttacgttacgccgttacggtaacccaaacgaaacgtaaacccgttcggacccctacgttcccgtacccggaggtccccttacccgtactaactttccgttaagtacggtattcggaacctaaccgtaacccgaaacgaccgggtacccgaaccgttcgggacctaacccgtaccccgacgtacccggttaacgggtttcgaacgggttcggcgggtaacgggttcggggttacggtacgggtaaccacgtttaccgttcttaacttccgtaacaccgtaatcgacgtaccgacgtacccgtaggacgtccgttaaggttaacgtttacgttttcgtaccgtttttaagtttttaccgttaacgttcggttacgtacgtacgaacgttacgtagtaccgtaacgttcgtaaccttctaccgttaccgtacgttaccgaccgtaacggaccgtacgaggtacgtagaagtaaccggaagtacgttcggtcgagtcgcgtacgttcg

SEQ ID NO: 255791 - DNA, 780 bp, Homo sapiens
  misc_feature: GYAE6OF01AE01Y.17.36.D03.1.454.CMB.1.raw
  modified_base (721)..(721): a, c, t, g, unknown or other
  misc_feature (721)..(721): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagactacccgaccggagtaaattgtgttacgacacagtcctccacgcccacccgttgttctttcggtccggtaccgggggaaagtccgccctacccgttcctccgtcgacggacgggacctacggtacagtaggttacgttacgccgtacgtacttacgttacgcccgttacggtaacccaaacgaaccggtaaaccgtcggacctacgtccctacccgacggtccttcctacgacttcgtaagtcgactcacctacgtccgaaacggcggaccctagtccggacctaccgtaccccgacggtaccgtacggttcggaaggtcggttacggacgggttacgggtcggtaacggacgttaaccgtactttaccgtagttacccgttacccaacttacggtacgtacgaccgttacgggtaaccctaggtacccggtacgttaacgggtaagtttaccttttacgtttaaccgttaaggtttttactacggtaccgttcgaaccgtcggtaacggtcgtaagcccgtagtacgtacctacgtacgtaccggtacccggttaaccgacgtaaaccggctaaaccgnggtaacgacgtaaggtaaccgtaggtacgtccgggctaaccggctaccgttaccgtacg

SEQ ID NO: 255792 - DNA, 841 bp, Homo sapiens
  misc_feature: GYAE6OF01AP49C.17.36.D03.1.454.CMB.1.raw
tcagcgtagactagcacgaccggtgctcgatttagctgcgtcacgatctctcgttgggggaggaactgctcagttaggacccagagggaaccatggaagccccagctcagcttctcttcctcctgctactctggctccagataccacggagaattggtgttgacactagtcctccgacgtcccacccgttgttcgtttggtccggtaccggggggaaagtaccgcccctacccgttcctaccgtcggcgaccggggtaccacggttccgaaggtaggttcggttacggacctacggtaccgttaaccgttacggaccgttaacgggtaaccctaaaccgaaaccggtaaacccttccggggacccctaacggttccctaccccgtacggggtcccctaccccgttacgtaactttacgtaacggtacggttaacttacggaccctaaaccgttacccccgggaaaaccgggacccggggtacccaaccgggttcggacccctaacccgtacccggaaccgttacccgggttacggttacgtacggggtcggtaccggttagggttcggggttaccgtaacggggaccttaacggtacctttcttaaccgtcccgtaacctaaccgtacttcggaccgacgttaccgacggttacggactacggttacggtaagtttctttacgacgtttagtttaactcgtacgtcgtagccgttagccggtaatcggatccgtactacgtactaccgaccgtaccggacgaacggtcgaacgttagggacggtaacggtaaagtacccggtaaagtcggttaccgacggaccgtccaccggtagtttacc

SEQ ID NO: 255793 - DNA, 805 bp, Homo sapiens
  misc_feature: GYAE6OF01ANPD4.17.36.D03.1.454.CMB.1.raw
  modified_base (204)..(204): a, c, t, g, unknown or other
  misc_feature (204)..(204): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagatacccacggagaaattgtgttgacacagtctccacgccacctgtcttgtcgtaccgggggaancgccaccctctccgtcgcgacggggcctagtcaggtagtgttacgctagtactacgttacggcctacggtaaccaaaccaggaaacccgtcggaccctacggtccctacccgacggtccttcctactacttacgtagtcggtatcgacctaaccttacccgaaacggcgggtaccctacggaccggtaccaccgtccccgaacggcccgttaacgggtacgcgggtacggacggtacgggttaggggtaccggtacggggtaacctaccggtttactttcccgtaacgtttcccgtaccctaaccgactccgaacggacctacggtaccgtaagtaccgtaccggtaagtaaccgttttagtttacggtacctttaaggttttacttaccgtagtaaccgttacggagttacggaccgttaacgaccgtaacggttacggcccttacgtacccgttacccgtaacccgggttacccggaaccggttaaacggggaccctaacgggaaccggttgggaaacgttaaacggtaaacccggtaaaacccgggttacgggttacgggtccccgttaaagggtcccctaaacccggttgtaccccg

SEQ ID NO: 255794 - DNA, 764 bp, Homo sapiens
  misc_feature: GYAE6OF01CPXU3.17.36.D03.1.454.CMB.1.raw
  modified_base (156)..(156): a, c, t, g, unknown or other
  misc_feature (156)..(156): n is a, c, g, or t
  modified_base (222)..(222): a, c, t, g, unknown or other
  misc_feature (222)..(222): n is a, c, g, or t
tcagcgtagactagcacgaccggtgctcgatttagctgcgtcacgatctctcgttgggggaggaactgctcagttaggacccagagggaaccatggaacgccccagctcagcttctcttcctcctgctactctcggcctcccagactaccacgganaaattgtgttagacacagtcctccgacgccctaccgttgttctttcggtccggtaccgggggaaanacgcccctaccctccgtcctgcgacgggaccagtacagtagtgtagcagtctacgttacgccgtacggtaaccaacgaacgtaaccgtcggaccctacgtccctacccgacggtcccttacctctatacctataggtactcggacctaccgtacccgaaccggacgggcctacgtccgactaccgtacccgacgtaccgtacggtacgtcggtacggtcggtagggtcgggtccggtagggaactacgtacctttacgtactttacctccgaacctacgtacgtaacgacgaaccggtaccgtaggtacgtaccggttaagtaacgtttacgtttacgtaccgtttaaggttttaacttaccgttcgtacgtaccgtacgggtacgtaccgtaacgtaaccgtaacgttcgtaccttactaccgttacccgtacccggtaccggaaccggtaaacgggacccgtaacggtacgggtaacggtaacgttaaggaaaccgtaaaccggtagtacgggtacgtaccgtaacgcgtaaccgttacg

SEQ ID NO: 255795 - DNA, 844 bp, Homo sapiens
  misc_feature: GYAE6OF01A4U71.17.36.D03.1.454.CMB.1.raw
  modified_base (177)..(177): a, c, t, g, unknown or other
  misc_feature (177)..(177): n is a, c, g, or t
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
  modified_base (331)..(331): a, c, t, g, unknown or other
  misc_feature (331)..(331): n is a, c, g, or t
  modified_base (397)..(397): a, c, t, g, unknown or other
  misc_feature (397)..(397): n is a, c, g, or t
  modified_base (569)..(569): a, c, t, g, unknown or other
  misc_feature (569)..(569): n is a, c, g, or t
tcagcgtagactagcacgaccggtgctcgatttagctgcgtcacgatctctcgttggggaggaactgctcagttaggacccagaggaaccatggaacgccccagctcagcttcctcttcctcctgctactctgctccagataccgaccgagaaacttgtagttgacacagtctccanccacctgtctttgcgtccggggaaanacnccaccctctcctgcacgggaccagtacagtagtgttacgactagtactacttacgccttaggtaacccaacgaggtaaaacccctggtacccgtaacgttctaccccgaggtccctacccgttanacttactaacgttcggacttacggacctagtacccgaaacgtacggaccaacgttcgggaaccctnttacccccggagtaccgaacggtttccgaaggtcggtactaacggttggggttccgacgggtaaactacggttacttaccccgaatttacccaacccgtaaccgtaacttacccgaagaccggtaaccgttaccgtaacgggtaaccaacccggtttaagaaaaccggtttntttttacgggaaaccgttttaaggttttaacccctttaacgggtactttaacccggagttaaccgaacggtttccggaaaccgtaccgtaaaccgttcggttaaccctacgttaaacctacccgtaacccgggtttaacgggaacccggtttaaaccgggaaaccttaaacccggggtagttaaacgggaaccgttaaacggtttaaacccggaaaacttaacgggttacgggttaacccgtaacccgttaccggacccttaaaccgttacccgg

SEQ ID NO: 255796 - DNA, 729 bp, Homo sapiens
  misc_feature: GYAE6OF01A2MRM.17.36.D03.1.454.CMB.1.raw
  modified_base (198)..(198): a, c, t, g, unknown or other
  misc_feature (198)..(198): n is a, c, g, or t
  modified_base (200)..(200): a, c, t, g, unknown or other
  misc_feature (200)..(200): n is a, c, g, or t
  modified_base (715)..(715): a, c, t, g, unknown or other
  misc_feature (715)..(715): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctccagataccaccgagaaattgtgtgacacagtctccagccacctgtctttgcgtcggggaaancnccacctctctgcacggccagtcagtagtgttacgctagccttacgtttcgccgttcggaaccctaaacgaacgtaaacccgtgggacctaacggttcccacccgaggtcccttcctaccgaacttcctaagtcgattcgacctactacccgaaacggcgggacctacgtcggactactaccccgaagcccgtggtacgaggtcggacgtaagggttcgggtacccgtagggtaaccgtaagtacccgtttaacgtcgttacctaccgtaaccctaagtcccgaaggtcccacgtaccgttaacggacgtaccgttaacgtaaacggtttaacgttttacgtaacgtttaaggttttacgttaccgtttagtacgtactaccgtaggtccgtacacgtaacgtccgtactacctacttaccgaccgttaccggacgtaaacggggtacctaaccgggtaccgtaaggacggttaactaacgggtaaacgtaaccgtttacggccgtacggttaacnccgtacccttacgg

SEQ ID NO: 255797 - DNA, 179 bp, Homo sapiens
  misc_feature: GYAE6OF02GNJOQ.17.36.D03.1.454.CMB.1.raw
  modified_base (177)..(179): a, c, t, g, unknown or other
  misc_feature (177)..(179): n is a, c, g, or t
tcagcgtagactagcacgaccggtgctcgatttagctgcgtcacgatctctcttgggatagaagttattcagcaggcacacaacagaggcagttccagacttcaactgctcaccatctgtcttcatcttcccgccatctgactagtctacgctgagcgggctggcaaggcgcatagnnn

SEQ ID NO: 255798 - DNA, 501 bp, Homo sapiens
  misc_feature: GYAE6OF02IDLQT.17.36.D03.1.454.CMB.1.raw
  modified_base (204)..(204): a, c, t, g, unknown or other
  misc_feature (204)..(204): n is a, c, g, or t
  modified_base (368)..(368): a, c, t, g, unknown or other
  misc_feature (368)..(368): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagagtgttagcagctacttagcctggtaccaacagaaacctggccagtctcccaggctcctcatctatgatgcatccaacagggccactggcatcccagccaggttcagtgcaggtggtctgggacagacttcattcncaccatcagcagcctagagcctagaagtattttgctagttttattactgtcagcagcgtagcaactggctcactcaccttcggccagggaccacggactaggagatagaacgacgtggtggctgccacctacg

SEQ ID NO: 255799 - DNA, 179 bp, Homo sapiens; identical to SEQ ID NO: 255797
  misc_feature: GYAE6OF02HTYBU.17.36.D03.1.454.CMB.1.raw
  modified_base (177)..(179): a, c, t, g, unknown or other
  misc_feature (177)..(179): n is a, c, g, or t

SEQ ID NO: 255800 - DNA, 494 bp, Homo sapiens
  misc_feature: GYAE6OF02GVPKK.17.36.D03.1.454.CMB.1.raw
  modified_base (204)..(204): a, c, t, g, unknown or other
  misc_feature (204)..(204): n is a, c, g, or t
  modified_base (368)..(368): a, c, t, g, unknown or other
  misc_feature (368)..(368): n is a, c, g, or t
  modified_base (468)..(468): a, c, t, g, unknown or other
  misc_feature (468)..(468): n is a, c, g, or t
tcagcgtagactagcacgaccggtgctcgatttagctgcgtcacgatctctcttgggggaggaactgctcagttaggacccagagggaaccatggaagccccacctcagcttctcttcctcctgctactctggctcccagataccaccggagaaattgtgttgacacagtctccagccaccctgtctttgtctccgggggaaangccaccctctcctgcagggccagtcagagtgttagcagctacttagcctggtaccaacagaaacctggccagtctcccaggctcctcatctatgatgcatccaacagggccactggcatcccagccaggttcagtggcaggtggtctgggacagacttcattcncaccatcagcagcctagagcctagaagtattttgctagtttattactgtcagcagcgtagcaactgctcatccaccttcggccaaggacacgacgtgganatagaacgacgtgtggctgcaccatc

SEQ ID NO: 255801 - DNA, 490 bp, Homo sapiens
  misc_feature: GYAE6OF02JD860.17.36.D03.1.454.CMB.1.raw
  modified_base (204)..(204): a, c, t, g, unknown or other
  misc_feature (204)..(204): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaangccaccctctcctgcagggccagtcagagtgttagcagctacttagcctggtaccaacagaaacctggccagtctcccaggctcctcatctatgatgcatccaacagggccactggcatcccagccaggttcagtggcagtgggtctgggacagacttcattctcaccatcagcagcctagagcctgaagtattttgctagtttattactgtcagcagcgtagcaactggctcatcacttcgccagggacacgactaggagatagaacgactgtggctcgcactac

SEQ ID NO: 255802 - DNA, 497 bp, Homo sapiens
  misc_feature: GYAE6OF02G5K7S.17.36.D03.1.454.CMB.1.raw
  modified_base (371)..(371): a, c, t, g, unknown or other
  misc_feature (371)..(371): n is a, c, g, or t
tcagcgtagactagcacgaccggtgctcgatttagctgcgtcacgatctctcttgggggaggaactgctcagttaggacccagagggaaccatggaagccccacctcagcttctcttcctcctgctactctggctcccagataccaccggagaaattgtgttgacacagtctccagccaccctgtctttgtctccgggggaaagagccaccctctcctgcagggccagtcagagtgttagcagctacttagcctggtaccaacagaaacctggccagtctcccaggctcctcatctatgatgcatccaacagggccactggcatccccagccaggttcagtggcagtgggtctgggacaggacttcattcncaccatcagcagcctagagcctgaagtattttgctagtttattactgtcagcagcgtagcaacgtgctcatcaccttcggccaagggacacgacgtggagatagaacgacgtgtggctgcaccatc

SEQ ID NO: 255803 - DNA, 509 bp, Homo sapiens
  misc_feature: GYAE6OF02IFCPZ.17.36.D03.1.454.CMB.1.raw
  modified_base (204)..(204): a, c, t, g, unknown or other
  misc_feature (204)..(204): n is a, c, g, or t
  modified_base (310)..(310): a, c, t, g, unknown or other
  misc_feature (310)..(310): n is a, c, g, or t
  modified_base (367)..(367): a, c, t, g, unknown or other
  misc_feature (367)..(367): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagagtgttagcagctattagcctggtaccaacagaaacctggccagtctcccaggctcctcatctatgatgcatccaacngggccactggcactcccagccaggttcagtgcagtggtctgggacagacttcattcncaccatcagcagcctagacgcctagaagtattttgcttagttttattactagtcagcagcgtagacacgtggctcatctaccgttcgacacgggacacggactacggagagtagaacgtacgtggtacggctacgcactacg

SEQ ID NO: 255804 - DNA, 768 bp, Homo sapiens
  misc_feature: GYAE6OF02GOC2G.17.36.D03.1.454.CMB.1.raw
  modified_base (207)..(207): a, c, t, g, unknown or other
  misc_feature (207)..(207): n is a, c, g, or t
tcagcgtagactagcacgaccggtgctcgatttagctgcgtcacgatctcgggtcttggggaggaacgtgctcagttaggacccgagaggaaccatggaagccccagctcagcttctcttcctcctgctactctggctcccagataccaccggagaaacttgtgttgacacagtctccagccaccctgtctttgtctccggggaaanagccacctctcctgccacgggccagtccagacgtcgttagcagctacgttagccttaggtaccaacgacgtaaaccgttggacccaaggttccctccccgaagggaccttaccctaccaattccttaaagttcgtaagttcgggacctaacttacccgaaaaccggaccgggggtccccctaaacggtttcggggtacctaaaccgtttccccccgaaggttcccctaagggggttttccaacgggttcgggaccgtacgggttcgggggtacctacgggggaacctaacggtaccctttcgaacttttccgtaccacccgtagtccacgacctacggtacccgtaaggaccgtccgttaggtaaacgttactttttagacgttagttttacttacgttcgttactagtacacgtacgtaagtaccgtaaacgttggtaccttacgtacgttccgtaaccggttaccggaccgtaacgggtaccgtaacggtaacgtaggaacgtaacgtaacggtaaaccgtaccgttcggtaccggtacctacggacctacccgtaccg

SEQ ID NO: 255805 - DNA, 503 bp, Homo sapiens
  misc_feature: GYAE6OF02IP1QM.17.36.D03.1.454.CMB.1.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (355)..(355): a, c, t, g, unknown or other
  misc_feature (355)..(355): n is a, c, g, or t
tcagcgtagactagcacgaccggtgctcgatttagctgcgtcacgatctctcttggggaggaactgctcagttaggacccagagggaaccatggaagccccagctcagcttctcttcctcctgctactctggctcccagataccaccggagaaattgtgttgacacagtctccagccaccctgtctttgtctccgggggaaangccaccctctcctgcagggccagtcagagtgttagcagctacttagcctggtaccaacagaaacctggccagtctcccaggatcctnatctatgatgcatccaaacagggccactggcatcccagccaggtcagtgcagtgggtctgggacngactttcattcctcaccatcagcagcctagagcctagaacgattttgcaagtttattaactgtcagcagcgtagcaactggctacatcaacccgttgaccaagggacacgactggacgatagaaacgactcgtggctacgtcacctag

SEQ ID NO: 255806 - DNA, 505 bp, Homo sapiens
  misc_feature: GYAE6OF02F8MFD.17.36.D03.1.454.CMB.1.raw
  modified_base (204)..(204): a, c, t, g, unknown or other
  misc_feature (204)..(204): n is a, c, g, or t
  modified_base (370)..(370): a, c, t, g, unknown or other
  misc_feature (370)..(370): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagagtgttagcagctacttagcctggtaccaacagaaacctggccagtctcccaggctcctcatctatgatgcatccaacagggcccactggcatcccagccaggttcagtggcagtgggtctgggacagacttcattcncaccatcagcagcctagagcctagaagtattttgctagttttattacttgtcagcagcgtagcaactggctcatccaccttcggaccaggacacggactaggagagtagaaacgacgtggtaggctacgcactac

SEQ ID NO: 255807 - DNA, 503 bp, Homo sapiens
  misc_feature: GYAE6OF02IC3EC.17.36.D03.1.454.CMB.1.raw
  modified_base (204)..(204): a, c, t, g, unknown or other
  misc_feature (204)..(204): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagagtgttagcagctacttagcctggtaccaacagaaacctggccagtctccaggctctcatctatgatgcatccaacagggccactggcactcccagccaggttcagtggcaggtgggtctgggacagacttcattctcacccatcagccagcctagagcctagaagtattttgacttagttttattactgtcagcagcgtagcaacgtgctcatcaccttcgccaagggaccacgctggagagtagaacgaactggtaggctagccactac

SEQ ID NO: 255808 - DNA, 494 bp, Homo sapiens
  misc_feature: GYAE6OF02IFUAB.17.36.D03.1.454.CMB.1.raw
  modified_base (204)..(204): a, c, t, g, unknown or other
  misc_feature (204)..(204): n is a, c, g, or t
  modified_base (309)..(309): a, c, t, g, unknown or other
  misc_feature (309)..(309): n is a, c, g, or t
  modified_base (348)..(348): a, c, t, g, unknown or other
  misc_feature (348)..(348): n is a, c, g, or t
  modified_base (365)..(365): a, c, t, g, unknown or other
  misc_feature (365)..(365): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagagtgttagcagctacttagcctggtaccaacagaaacctggccagtctccaggctctcatctatgatgcatccaacngggccatggcatcccagccaggttcagtgcaggtggtcngggacagacttcattcncaccatcagcagcctagagcctgaacgtatttttacgctagttttattactgtacagcagcgtagcaactggctcatctaccgtcgccaggacacgactggagatagaacgacgtgtggctgcactacg

SEQ ID NO: 255809 - DNA, 508 bp, Homo sapiens
  misc_feature: GYAE6OF02IYS25.17.36.D03.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (310)..(310): a, c, t, g, unknown or other
  misc_feature (310)..(310): n is a, c, g, or t
  modified_base (366)..(366): a, c, t, g, unknown or other
  misc_feature (366)..(366): n is a, c, g, or t
  modified_base (395)..(395): a, c, t, g, unknown or other
  misc_feature (395)..(395): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaangccaccctntcctgcagggccagtcagagtgttagcagctacttagcctggtaccaacagaaacctggccagtctcccaggctcctcatctatgatgcatccaacngggccatggcatcccagccaggttcagtgcagtgggtctgggacagacttcattcncacatcagcagcctagacgcctagaagtntttgctagtttattactgtcagcagcgtagacaacgtggctacactcaccgttcggaccaagggaccacgtacgtggaacgagtacgaaacgactggtacgctcgcacctacg

SEQ ID NO: 255810 - DNA, 654 bp, Homo sapiens
  misc_feature: GYAE6OF02GHR8Y.17.36.D03.1.454.CMB.1.raw
  modified_base (204)..(204): a, c, t, g, unknown or other
  misc_feature (204)..(204): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagagtgttagcagctacttagcctggtaccaacagaaacctggccagtctcccaggctcctcatctatgatgcatccaacagggccactggcactcccgagccgtagttcgaggtcgactagggtcgggtcggtggaacgtagtaccttactactttccacctaacctatacgacgtcgaacgtccgtaaggaccgtaccgtaaggtaagtttacgttttacgacgtttaacgtttttaactttacgttcgtacgtacgtacgtacggtacgtaacgtaccgtaacggtcggtaccttaccgtaccttacccgtaaccgttacccgggaaccggtaacgggacctaaccggtaacggtagggaacgtaacgttaaacggaaaccgtacgttacgggtacggaccgtacggacccaacgttaccg

SEQ ID NO: 255811 - DNA, 719 bp, Homo sapiens
  misc_feature: GYAE6OF02JFQ0B.17.36.D03.1.454.CMB.1.raw
tcagcgtagactagcacgaccggtgctcgatttagctgcgtcacgatctctcttgggggaggaactgctcagttaggacccagagggaacataggaacgcccagctcagcttctcttcctcctgctactcgtggcctcccagactaccgaccggaagtaaattgtgttgacacagtctccacgcccaccctgttctttgtccggtaccgggggaaagacgcccaccctctcctgcgacgggccagtcagagtgttacgcgagcttacgttacgccgtacggtaaccaacgaacgaaaccgtcgggacctagttccctaccccgaggtccttccctacattacctagtgtaacttcgactactacccaaacggacggggccctacgtgggacctactccccgaagtccgtaggttccaggtcggacctagggtcgggtcgtacggggacacgtacctttcgactttcctaccgacctataccacgcacgtacccgtaaggaccgtccgtaggtaaagttcgttttcggacttaagttttaacctttacgttcggtactacggctaacggtccggttaacgaccgtaacgttcgggaccttcgtactaccctaccggttccgggaaccgaacggggccctaaccggtacggttagggaacgtaacgtaacggaaaacccggtacgtttgggccggttactaccggtaccaacccgttacgg

SEQ ID NO: 255812 - DNA, 534 bp, Homo sapiens
  misc_feature: GYAE6OF02IXAAX.17.36.D03.1.454.CMB.1.raw
  modified_base (204)..(204): a, c, t, g, unknown or other
  misc_feature (204)..(204): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagagtgttagcagctacttagcctggtaccaacagaaacctggccagtctcccaggctcctcatctatgatgcatccaacgacgggcccacgtggccactccccagccaggttcaggtcggcaggtcgggtctgggacagtacttcattcctacacctatcagcagcctagacgcctagaagtattttgacttagtttattacgtgtacagcagtcgtagactaacgtcggctcactccaccgttcggaccaggaccacgacgtaggaagtagtacgaaacgacgtggtcgcgtcgaccactac

SEQ ID NO: 255813 - DNA, 529 bp, Homo sapiens
  misc_feature: GYAE6OF02GTEHV.17.36.D03.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (261)..(261): a, c, t, g, unknown or other
  misc_feature (261)..(261): n is a, c, g, or t
  modified_base (350)..(350): a, c, t, g, unknown or other
  misc_feature (350)..(350): n is a, c, g, or t
  modified_base (368)..(368): a, c, t, g, unknown or other
  misc_feature (368)..(368): n is a, c, g, or t
  modified_base (387)..(387): a, c, t, g, unknown or other
  misc_feature (387)..(387): n is a, c, g, or t
  modified_base (419)..(419): a, c, t, g, unknown or other
  misc_feature (419)..(419): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccggggaaangccaccctntcctgcagggccagtcagagtgttagcagctacttagcctggtaccaanagaaacctggcagtctcccaggctctcatctatgatgcactccaacgaggccacgtggcactcccagccaggttcagtggcagtggtcngggacagtacttcattcncacatcagcagcctagacnccgtagaacgtatttgctagtttatacgtgtnagtcagcgtagctaacgtggctacactcaaccgttccggacacgggactacgacggtaggacgtaagtacgaaacgtacgttcggtacggccttacggactaaccgtacg

SEQ ID NO: 255814 - DNA, 498 bp, Homo sapiens
  misc_feature: GYAE6OF02FIJGL.17.36.D03.1.454.CMB.1.raw
  modified_base (204)..(204): a, c, t, g, unknown or other
  misc_feature (204)..(204): n is a, c, g, or t
  modified_base (370)..(370): a, c, t, g, unknown or other
  misc_feature (370)..(370): n is a, c, g, or t
  modified_base (484)..(484): a, c, t, g, unknown or other
  misc_feature (484)..(484): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagagtgttagcagctacttagcctggtaccaacagaaacctggccagtctcccaggctcctcatctatgatgcatccaacagggccactggcatcccagccaggttcagtggcaggtgggtctgggacagacttcattcncaccatcagcagcctagagcctagaagtattttgcttagtttattactgtcagcagtcgtagcaactggctcatcaccttcgcaggacacggactggagatacgaacgacgtgnggctcgcacctacg

SEQ ID NO: 255815 - DNA, 528 bp, Homo sapiens
  misc_feature: GYAE6OF02IZWGU.17.36.D03.1.454.CMB.1.raw
  modified_base (204)..(204): a, c, t, g, unknown or other
  misc_feature (204)..(204): n is a, c, g, or t
  modified_base (372)..(372): a, c, t, g, unknown or other
  misc_feature (372)..(372): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagagtgttagcagctacttagcctggtaccaacagaaacctggccagtctcccaggcctcctcatctatgatgcatccaacagggccactggcatcccagcctaggtcagtggcaggtgggtctgggacagtacttcattcncaccatcagcacgcctagacgcctagaagtattttcgacttagtttattacttgtcagacagtcgtagcaacgtggctctatccaccgttcgaccgagggaccacggacgtggacgtaagtacgaaacgacgtcggtaggtcgtacgccacgtacg

SEQ ID NO: 255816 - DNA, 300 bp, Homo sapiens
  misc_feature: GYAE6OF02IE9C2.17.36.D03.1.454.CMB.1.raw
  modified_base (205)..(205): a, c, t, g, unknown or other
  misc_feature (205)..(205): n is a, c, g, or t
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (263)..(300): a, c, t, g, unknown or other
  misc_feature (263)..(300): n is a, c, g, or t
tcagcgtagactagcacgaccggtgctcgatttagctgcgtcacgagtctcgtctgggacagacttcattctcaccatcagcagcctagagcctgaagtattttgcagtttatactgtcagcagcgtagcaactggctcatcaccttcggccaaagggtcacgactgggagatggaaacgaactgtggctgcacgatctgtcttnattccttccgcatcctgacttgtntacgctgagcgggntggcaaggtcgctagtacgnnnnnnnnnnnnnnnnnnnnnnnnnnnnnnnnnnnnnn

SEQ ID NO: 255817 - DNA, 601 bp, Homo sapiens
  misc_feature: GYAE6OF02JYQEA.17.36.D03.1.454.CMB.1.raw
  modified_base (204)..(204): a, c, t, g, unknown or other
  misc_feature (204)..(204): n is a, c, g, or t
  modified_base (410)..(410): a, c, t, g, unknown or other
  misc_feature (410)..(410): n is a, c, g, or t
  modified_base (439)..(439): a, c, t, g, unknown or other
  misc_feature (439)..(439): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagagtgttagcagctacttagcctggtaccaacagaaacctggccagtcctccgaggctcctcatcctatgatgcatccaagcgggccactggcactcccagccgaggttcagtcggctaggtcgggtctagggacagtacttcacttcctacaccatcagcacgcctagcgctagaatntttgacttagttttacttacgtgtctaancagtaccgtaacgtcgtaaacgttcggaacctttacgacgttacccgtaccgtttacccgggaaccgtaaccgggtacgtacccggaacggttcgggaaacgtagttaaccggaaaaccgttacgttaccgggcgttaaccgtaccggacccgtaacctacg

SEQ ID NO: 255818 - DNA, 549 bp, Homo sapiens
  misc_feature: GYAE6OF02GAT6H.17.36.D03.1.454.CMB.1.raw
  modified_base (263)..(263): a, c, t, g, unknown or other
  misc_feature (263)..(263): n is a, c, g, or t
  modified_base (383)..(383): a, c, t, g, unknown or other
  misc_feature (383)..(383): n is a, c, g, or t
  modified_base (414)..(414): a, c, t, g, unknown or other
  misc_feature (414)..(414): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagagtgttagcagctacttagcctggtaccaanagaaacctggccagtctccccaggctcctcatctatgatgcatccaacagggcccacgtggaccactccccaagccgtaggttcaggtgcaggtgggtcgtgggacagcttcgatttccncaccatcagcagcctagacgcctagaacgtntttcgacttagtttacttacgttgtctagtccagtcgtagcgaacgtggcctcgactcctaccgttcggaccgaggtaccacggtacgtagggacgtaagtacgaaacgtacgtggtacgcgtacgccacctacg

SEQ ID NO: 255819 - DNA, 693 bp, Homo sapiens
  misc_feature: GYAE6OF02H09N5.17.36.D03.1.454.CMB.1.raw
  modified_base (204)..(204): a, c, t, g, unknown or other
  misc_feature (204)..(204): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanacgccaccctctcctgcagggccagtcagagtgttagcagctacttagcctggtaccaacagaaaacctggccagtcctcccaggcctcctcatctatgatgctatccaacgacggccacgtcggccactccccagacccgtaggtttccgaggtcggaccgtaggttcggggtcgtaggggaacctaggtaaccctttactaactttccgtacctaacccgtatcccgagtaccctaacggtaccccgtaaggacgtcccttaaggaaacgtttagtttttacggaccttttaagtttttaactttaccgttagttaccaggaccgtaggtaaccgttacgacgtaaacgttcggaccttactaacgttacccgttaaccccggttcgggaaccccgtaaacggggacccgtaaaccgggtaccgttaagggaacgtaagtaacggaaaacgtacggtacgggttacgacctacgaccctacgtaccg

SEQ ID NO: 255820 - DNA, 683 bp, Homo sapiens
  misc_feature: GYAE6OF02JTQDQ.17.36.D03.1.454.CMB.1.raw
  modified_base (205)..(205): a, c, t, g, unknown or other
  misc_feature (205)..(205): n is a, c, g, or t
  modified_base (297)..(297): a, c, t, g, unknown or other
  misc_feature (297)..(297): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagcccaccctgtctttgtctccgggggaaanagccaccctctcctgcagggccagtcagagtgttagcagctacttagcctggtaaccaacagaaacctggccagtcctcccgaggcctcctnacttcctatgatgctaactccgaacgcggtaccacgtggaccactaccccgagccgtaaggtccgaggtcggcgtacgggtcgggtacctggggacctaggtaccttacgtacttccgtacctaaccgacgttaccgacgtaccaacgacccgtaggacgtaccgtaaggttaagttacgtttacgaacgtttaacgttttaacgttacgttacgtccgtagtaccgtacgtacggttacgaccgttaaccgtcggtaccttaccgaacgtttcccgaacccgttccggtaacccggacggtaacccaccggttaaccggaggtaacggtaacgaaccggtaaaacggccgtttaggaccggtctaccggtaccaccgtttaaccg

SEQ ID NO: 255821 - DNA, 593 bp, Homo sapiens
  misc_feature: GYAE6OF02HZHLT.17.36.D03.1.454.CMB.1.raw
  modified_base (204)..(204): a, c, t, g, unknown or other
  misc_feature (204)..(204): n is a, c, g, or t
  modified_base (292)..(292): a, c, t, g, unknown or other
  misc_feature (292)..(292): n is a, c, g, or t
  modified_base (366)..(366): a, c, t, g, unknown or other
  misc_feature (366)..(366): n is a, c, g, or t
  modified_base (389)..(389): a, c, t, g, unknown or other
  misc_feature (389)..(389): n is a, c, g, or t
  modified_base (411)..(411): a, c, t, g, unknown or other
  misc_feature (411)..(411): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanacgccaccctctcctgcagggccagtcagagtgttagcagctacttagcctggtaccaacagaaacctggccagtctccaggctcctnatctatgatgacatccaagacgggccacgtggacactccccagaccagggttccaggtggcgtaggtcgggtcnggggaacaggtaacttcattccncaccatcagcaagcctaggacnccgttagaacgttattttgcttaagtttattactgttacagtcgagtacgtagaccgaaacgttggaccttactactaccgtaccgttaccgggacccgtaaggggtaccaccggtaacgttacgggacggtaaacgtacggaaaacgtacgtggtacgggacctacggacccaccgttacg

SEQ ID NO: 255822 - DNA, 610 bp, Homo sapiens
  misc_feature: GYAE6OF02IQMT5.17.36.D03.1.454.CMB.1.raw
  modified_base (200)..(200): a, c, t, g, unknown or other
  misc_feature (200)..(200): n is a, c, g, or t
tcagcgtagactagcacgaccggtgctcgatttagctgcgtcacgatctctcttgggggaggaactgctcagttaggacccagagggaaccatggaagcccagctcagcttctcttcctcctgctatctggctcccagataccaccggagaaattgtgttgacacagtctccagccaccctgtctttgtctcggggaaanagccaccctctcctgcagggccagtcagagtgttagcagctacttagcctggtaccaacacgaacctggccagtcctcccaggctcctcatctatgatgcatacccaacgacgggcctaacgtcgggaccacgttcccgaacgcctaaggtttcgaacggtgggctacgggttggggtacgtggggaacaggtacttcgaactttccgtccaacctatcacgcacgaccgtagacgtaccgtagtaacgtattttagacttagtttactttactgttactagacgagtacgtagacgtaacgttcggctcgtactccgttaccgttcggaccgaacgggacctaacggtactacgggaagtacgtaacggaaaacgtacgttcggtaggtacctcggtacctaccgtacg

SEQ ID NO: 255823 - DNA, 267 bp, Homo sapiens
  misc_feature: GYAE6OF02HQYHB.17.36.D03.1.454.CMB.1.raw
  modified_base (238)..(238): a, c, t, g, unknown or other
  misc_feature (238)..(238): n is a, c, g, or t
  modified_base (254)..(267): a, c, t, g, unknown or other
  misc_feature (254)..(267): n is a, c, g, or t
tcagcgtagactagcacgaccggtgctcgatttagctgcgtcacgagtctctctgggacagacttcattctcaccatcagcagcctagagcctgaagattttgcagtttattactgtcagcagcgtagcaactggctcatcaccttcggccaagggacacgactggagatgaaacgaactgtggctgcaccatctgtcttcatccttccgccatctgactagtctacgctgagcgggntggcaaggcgcatagnnnnnnnnnnnnnn

SEQ ID NO: 255824 - DNA, 683 bp, Homo sapiens
  misc_feature: GYAE6OF02HMTJ3.17.36.D03.1.454.CMB.1.raw
  modified_base (315)..(315): a, c, t, g, unknown or other
  misc_feature (315)..(315): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaagcgcccaccctctcctgcagggccagtcagagtgttagcagtctattagcctggtaccaacagaaacctggccagtcctcccaggctcctcatctatgatgcatccaacgnggccacgtggaccactcccgagcctaggttccaggtcggacgtaggtcgggtactaggggaacaggtacctttcgaacttttccctacaaccctattaccgacgtaccaacgtcctaaggacggtcccttagaaacggttattttcgacttaaggtttttactacgttcgtacgacgtcgacggtaccggtaagtacccgtaaacgttcggaccttacgaacctttacccgtaaccccgtttaccgggaaccccggaacgggtaacccgtaaccgggtaaacgtaggggaacgtaaacggttacggaaaaacccgggttcggttacgggttaaccggtccgtttaccggacccctaaccgttacccgg

SEQ ID NO: 255825 - DNA, 514 bp, Homo sapiens
  misc_feature: GYAE6OF02H84VA.17.36.D03.1.454.CMB.1.raw
  modified_base (201)..(201): a, c, t, g, unknown or other
  misc_feature (201)..(201): n is a, c, g, or t
  modified_base (305)..(305): a, c, t, g, unknown or other
  misc_feature (305)..(305): n is a, c, g, or t
  modified_base (351)..(351): a, c, t, g, unknown or other
  misc_feature (351)..(351): n is a, c, g, or t
  modified_base (384)..(384): a, c, t, g, unknown or other
  misc_feature (384)..(384): n is a, c, g, or t
  modified_base (396)..(396): a, c, t, g, unknown or other
  misc_feature (396)..(396): n is a, c, g, or t
tcagcgtagactagcacgaccggtgctcgatttagctgcgtcacgatctctcttgggggaggaactgctcagttaggaccagagggaaccatggaagccccagctcagcttctcttcctcctgctactctggctcccagataccaccggagaaattgtgttgacacagtctccagccaccctgtctttgctcgggggaaangccacctctcctgcagggccagtcagagtgtagcagctattagcctggtaccaacagaaaccctggccagtctcccaggctcctcatctatgatgcatccaacngggccatggctatcccagccaggttcagtgcaggtgggctgggacngtacttcatttccacgaccatcagcagcctagngtcctagaagtnttttgacttagttttatactgtcagcagcgtagcaacgtggctacactcaccttcgaccaacgggaccacggctaggacgagtaacgaaacgtacgtggtacggtactgaccactacg

SEQ ID NO: 255826 - DNA, 621 bp, Homo sapiens
  misc_feature: GYAE6OF02HPAAQ.17.36.D03.1.454.CMB.1.raw
  modified_base (206)..(206): a, c, t, g, unknown or other
  misc_feature (206)..(206): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtaccgggggaaancgccaccctctcctgcagggccagtcagagtgttagcagctactagcctggtaaccaacagaaacctggacctacgtcctcccaggcctcctcatctatgatgcactaccaacgcggccacgtggctactcccaggtcctaggtttacgaggttcggactagggtcgggtcgtaggggaactaggtacctttcattccacacctagtacacgaccgaacgtaccgtagacgtaccgtagaacgttattttagacttaagttttactacttgctacgcgtagtacgtacacgtacgtcgtactctacgtaccgtaccgttaccgggaccgtaacggaccgtaacggtaacggtacggtaacgtaacgtaacgtaaacggacgttacggacggtaccgtacgacccgtaccgttacg

SEQ ID NO: 255827 - DNA, 263 bp, Homo sapiens
  misc_feature: GYAE6OF02ISDXT.17.36.D03.1.454.CMB.1.raw
  modified_base (255)..(263): a, c, t, g, unknown or other
  misc_feature (255)..(263): n is a, c, g, or t
tcagcgtagactagcacgaccggtgctcgatttagctgcgtcacgatctctctgggacagacttcattctcaccatcagcagcctagagcctgaagattttgcagtttattactgtcagcagcgtagcaactggctcatcaccttcggcccaagggacacgactggagatgaaacgaactgtggctgcaccatctgtcttcatcttcccgtcatctgactagtctacgctgagcgggctggcaaggccgcatagnnnnnnnnn

SEQ ID NO: 255828 - DNA, 644 bp, Homo sapiens
  misc_feature: GYAE6OF02JPW66.17.36.D03.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (240)..(240): a, c, t, g, unknown or other
  misc_feature (240)..(240): n is a, c, g, or t
  modified_base (264)..(264): a, c, t, g, unknown or other
  misc_feature (264)..(264): n is a, c, g, or t
  modified_base (320)..(320): a, c, t, g, unknown or other
  misc_feature (320)..(320): n is a, c, g, or t
tcagcgtagactagcacgaccggtgctcgatttagctgcgtcacgatctctcttggggaggaactgctcagttaggacccagagggaaccatggaagccccagctcagcttctcttcctcctgctactctggctcccagataccaccggagaaattgtgttgacacagtctccagccaccctgtctttgctccgggggaaanacgccaccctntcctgcagggccagtccagagtgttancagcttacttagcctggtaccaanagaacctggccagtcctcccgaggctcctcacttctagtgatcgcattcccgaaancgggcccactggaccactccccagccgtaggttccaaggtcggcctagggttcgggtcctaggggactaggactttcgatttccgcaaccgtgtacacgtaccagtaccccgtagaccgtccgtaggaaacgtttcgttttacgcgttaaagtttttaacttaaccgttgttccgaaacggtcaacgggttctaaccggacttaacgtcggaccgttctaacgtcctaccgttccggacccgtaaggccctacggtaactaggtaacgtacgtaacgtaaaccggtacgtcggtacgggtacctacggtaccctaaccgttacg

SEQ ID NO: 255829 - DNA, 254 bp, Homo sapiens
  misc_feature: GYAE6OF02H9PJ1.17.36.D03.1.454.CMB.1.raw
  modified_base (246)..(246): a, c, t, g, unknown or other
  misc_feature (246)..(246): n is a, c, g, or t
  modified_base (252)..(254): a, c, t, g, unknown or other
  misc_feature (252)..(254): n is a, c, g, or t
tcagcgtagactagcacgaccggtgctcgatttagctgcgtcacgatctctctgggacagacttcattctcaccatcagcagcctagagcctgaagattttgcagtttattactgtcagcagcgtagcaactggctcatcaccttcggccaagggacacgactggagatgaaacgaactgtggctgcaccatctgtcttcatcttcccgcatctgactagtctacgctgagcgggctggcaaggcncatagnnn

SEQ ID NO: 255830 - DNA, 729 bp, Homo sapiens
  misc_feature: GYAE6OF02GYGAJ.17.36.D03.1.454.CMB.1.raw
  modified_base (210)..(210): a, c, t, g, unknown or other
  misc_feature (210)..(210): n is a, c, g, or t
  modified_base (272)..(272): a, c, t, g, unknown or other
  misc_feature (272)..(272): n is a, c, g, or t
  modified_base (311)..(311): a, c, t, g, unknown or other
  misc_feature (311)..(311): n is a, c, g, or t
tcagcgtagactagcacgaccggtgctcgatttagctgcgtcacgagtctctcttgggggaggaactgctcagttaggacccagagggaaccatggaagccccagctcagcttctccttcctcctgctactctcggctcccagataccaccggagaaattgtgttgacgacagtctccagccaccctgtctttgtcgtaccgggggaaanacgcccaccctctcctgcgagggccagtcagagtgttagcagctactagcctggtaaccaanagaaacctggaccagtcctccaggcctcctacagtctangatgcactccgaaacgacgggtccaacgtcggactaccgtaccccgagtaccccgtaaggtttccgaagggttcgggaccgtaaggggttcggggttacgttacgggggaacctaaggtaccctttacaacgtttccctaccaacctagtaccaggacctacggtaccctaagggacccgtaccgttaaggtaaacgtttacgtttttacgggaaccttttaaggtttttttaaacttaacgttcggttaacgtacggtacgacgggtaaccggttacggacctaaccggtacgggtccttaccgttaacttacccgtaacccggttacggaacccgtaacggggacctaacggaacggttaacggagtaaccgttaaggaaaccgtaacgtggtacgaccgtacgacccaacgttcg

SEQ ID NO: 255831 - DNA, 659 bp, Homo sapiens
  misc_feature: GYAE6OF02JVX4S.17.36.D03.1.454.CMB.1.raw
  modified_base (167)..(167): a, c, t, g, unknown or other
  misc_feature (167)..(167): n is a, c, g, or t
  modified_base (207)..(207): a, c, t, g, unknown or other
  misc_feature (207)..(207): n is a, c, g, or t
  modified_base (244)..(244): a, c, t, g, unknown or other
  misc_feature (244)..(244): n is a, c, g, or t
  modified_base (388)..(388): a, c, t, g, unknown or other
  misc_feature (388)..(388): n is a, c, g, or t
  modified_base (599)..(599): a, c, t, g, unknown or other
  misc_feature (599)..(599): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacanagtcctccagccaccctgtctttagcgtaccgggggaaanacgccaccctctcctgcagggccagtcagagtgttancagctaactcgcctcggtacaacgagaaacctggccagtcctaccgagcctcctcattctatggatcgactacgtacccaagtacggcccagtggaccactcccgagccaggtttccagtcggctaggttcggggctagggacngtactttacacgttcacacctatccgagccaagtccctagaccgtctaaggtaacgttagttttacgccgttaacgttttaacgttacttaacggtccgtagtaccggtacggtacgttacgaccgttaaacgtccggtacgttaaccgtaccgttacccgtacgttaccgggaccgttaacgaccgtaaccggtaacggtcgggttaaanaaccggttaacggaaaccgttaacgttcggaaccgtcgtaaccggtacgtaccgttacgg

SEQ ID NO: 255832 - DNA, 710 bp, Homo sapiens
  misc_feature: GYAE6OF02HJYYU.17.36.D03.1.454.CMB.1.raw
  modified_base (204)..(204): a, c, t, g, unknown or other
  misc_feature (204)..(204): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtccggggaaancgccaccctctcctgcagggccagtcagagtgttagcagtctactagcctaggtaccaacagaaacctggaccagtcctcccgaggctcctcactctatgatcgacactccaacgacggccactcggccactccccgagccgtaggttcaggtcgacgaggttcggtcgtacgggacagtacttcgacttcgactaccgactcgacgcgacgaccgtagacgtaccgtaggtaacgtacgtttttacgacgtttaagttttaacttacgtttacgtacgtaacggtccgtaacgggtaccgttaacggtacctaaccggtccggaccgtttaaccgtaaccgttacccggtaaaccccggtttacccggggaaccccggtaaaccggggaacccgttaaccgggtaaccggttaacggggtaacgtaaaccggtaaaccggtaaacccggttaacgttaaccggggtccgtacccggttaccggaacccgttaacccgttaaccgg

SEQ ID NO: 255833 - DNA, 814 bp, Homo sapiens
  misc_feature: GYAE6OF02I2W3K.17.36.D03.1.454.CMB.1.raw
  modified_base (204)..(204): a, c, t, g, unknown or other
  misc_feature (204)..(204): n is a, c, g, or t
  modified_base (245)..(245): a, c, t, g, unknown or other
  misc_feature (245)..(245): n is a, c, g, or t
tcagcgtagactagcacgaccggtgctcgatttagctgcgtcacgatctctcttgggggaggaactgctcagttaggacccagagggaaccatggaacgccccagctcagcttctcttcctcctgctactctggctcccagactaccaccggagaaattgtgttgacacagtctccagccacctgtcttgtcgtcgggggaaancgccaccctctcctgcacgggccagtcaggtagtggttacncgagtcttacgttacgccgtacggtaaccaacaaacggtaaaccctgggaccctacggttcctccccgacgggtccttccctactacttctagttgacttcgaccaacttaccgaaacgacgggccctacgtcggacctacgtccccgaacggtccggttacggttacgtaacgggtcgggtacggtacgggttcggggttacgtacggggtaaccgtaacggttacttaccgttaaccgtttccctaccgtaacccgtacgtaccgaacggtacccgtaaccgtccgtaacggtacccggtaaccgttaagggttaaacggtttacttttaacgggttaacgtttaacggtttttaactttaaccggttggtaaaccgacgggtaccgtacggttaaccggttaacggtaccgtaaccgtcggttacctaccgttaaccgttacccgtccgttaacccggggaacccgtaaacggggtaccctaacggggtaaccggtacggtaaagtaacggttaaaccggaaaccgttacggtaccggtcggtacttaccgacgtacccgttaacg

SEQ ID NO: 255834 - DNA, 594 bp, Homo sapiens
  misc_feature: GYAE6OF02FWYV7.17.36.D03.1.454.CMB.1.raw
  modified_base (205)..(205): a, c, t, g, unknown or other
  misc_feature (205)..(205): n is a, c, g, or t
  modified_base (398)..(398): a, c, t, g, unknown or other
  misc_feature (398)..(398): n is a, c, g, or t
  modified_base (434)..(434): a, c, t, g, unknown or other
  misc_feature (434)..(434): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaanagccaccctctcctgcagggccagtcagagtgttagcagctactagcctggtaccaacacgaaacctggaccagtcctcccaggcctcctcatctatgatgcatccaacgacggcccacgtggacctactccccagccgtaggttcaaggtggcgtagggttcgggtcgtaggggacacggtacttcattccncacctatcacgcacgcctagacgccgtagtaacgtntttcgacttagtttattcgttagtactacgtcgtagtcgtaacgtactaacgtcggtacctacgtactaccgtaccgtccgaccggaaggaccgaacgtacggtaggaacggtaacgtacggaaaaccgtacgtacggtacggacgtacgacctactacg

SEQ ID NO: 255835 - DNA, 573 bp, Homo sapiens
  misc_feature: GYAE6OF02FVB4Z.17.36.D03.1.454.CMB.1.raw
  modified_base (205)..(205): a, c, t, g, unknown or other
  misc_feature (205)..(205): n is a, c, g, or t
  modified_base (325)..(325): a, c, t, g, unknown or other
  misc_feature (325)..(325): n is a, c, g, or t
  modified_base (399)..(399): a, c, t, g, unknown or other
  misc_feature (399)..(399): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagngccaccctctcctgcagggccagtcagagtgttagcagctactagcctggtaccaacagaaacctggaccagtcctcccaggtcctcctcatctatgatgcactccaacgacggccacgnggcactccccgagccgaggttcgaggtcggcgtaggtcgggtcgtgggacaggtactttcacttcctacactancctaagcacgccgtagacgtccgtagtaagtacgtttcgacttaggttttacttacgttgtacagtcaggtacgagtacacgtcgactcattccacgttcggaccgaggaccacggtacggtaggaacgtacgaacgtaaaccgtacgtggtaccgtactcggacctacgtacg

SEQ ID NO: 255836 - DNA, 650 bp, Homo sapiens
  misc_feature: GYAE6OF02JF158.17.36.D03.1.454.CMB.1.raw
  modified_base (307)..(307): a, c, t, g, unknown or other
  misc_feature (307)..(307): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagacgccaccctctcctgcagggccagtcagagtcgttagcagcttactagcctggaccaacacgaaacctgaccagtcctcccgaggtctcctcacgtctatgntcgcaatccaaacgacgggccacgtcggcaccgtccccacgcctaggttcgagtcggcgaggttcgggtcgtggggaaccagtaccttctaacgtttcctacgaacccgtactacgacgtaccacgtaccctaagggtacgtaccctaggtaaacgttagttttacgaccgttaagtttttaacttacgttcgtactaaccggacaaggtcgtaacgtactaccgtacggtcctacgtactaccgtacccgttacggtaccgaaccgggtaacgccgtaaccggtaggaaccgtacgaaacggtaaaccgtacgtacggtagtacgaccggtaccaccgtacg

SEQ ID NO: 255837 - DNA, 637 bp, Homo sapiens
  misc_feature: GYAE6OF02IDJWW.17.36.D03.1.454.CMB.1.raw
  modified_base (203)..(203): a, c, t, g, unknown or other
  misc_feature (203)..(203): n is a, c, g, or t
  modified_base (464)..(464): a, c, t, g, unknown or other
  misc_feature (464)..(464): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctcgggggaaanacgccaccctctcctgcagggccagtcagagtgttagcagctacttagcctggtaccaacagaaacctggccagtcctcccgaggcctcctacactctatgatgacactaccaacgacgggcccacgtcggacactccccgagccgtaggttcaggtggacagggtcgggtcgtaggggaactacggtaccttcgactttcctaccgaaccctagtaccgaagacccgacgtacctaaggcgtaccgtaggtaaacgtttnttttacgactttaagttttacttacgtgtacgagtaccaggtacgtagactaacgtcggtacttacgtactccgtaacccttacggaacccgtacgggacctacggtaacgtagggtaacgaacgtaacggaaaccgtacggttagtaccgggtactacgacccgacttaccg

SEQ ID NO: 255838 - DNA, 830 bp, Homo sapiens
  misc_feature: GYAE6OF02HL3XW.17.36.D03.1.454.CMB.1.raw
  modified_base (204)..(204): a, c, t, g, unknown or other
  misc_feature (204)..(204): n is a, c, g, or t
tcagcgtagactagcacgaccggtgctcgatttagctgcgtcacgatctctcgttgggggaggaactgctcagttaggacccagagggaaccatggaagccccagctcagcttctcttcctcctgctactctggctcccagactaccaccggagaaattgtgttgacactagtctccagccacctgtcttgtcgtacggggaanacgccaccctctcctgccgagggccagtccgagtaggtgttacgcgagtaccttaacttacggcccgttagggtaacccaaacgtaacggaaaccgtcggacccgtacggttccctacccggaggtcccttcccgtacgacttacctaagtcgacgtcgacctaaccgtaccgaaacgcgggtaccctacgtacggacctaccgtacccgacggacccgtacggttaccgacggttagggacctagggggtttacgggtacccgtacggggtaacctacggttacccgtttaccgtaacgtttcccgtaccgtaaccgtaacgtacggttaacgaacccgttaaccgggtaccggttaaaccggtaccggttaccgtaggtttaaaccgttacgttttacggaccgttttaaagttttactttaccgttacgggtacgtacggtaaccgtaacgggttaccgttaacgacgtaaccggtcggtcctaacgttccgttacccggtaacgttacccggtaaccggaccgggtaaccgtaccggtacggttaacggacggttaaccgtaaccgggtaaacttaaccgggtcggtaccggtaccggttacgtaccccggtattaacccgg

SEQ ID NO: 255839 - DNA, 655 bp, Homo sapiens
  misc_feature: GYAE6OF02FR4YU.17.36.D03.1.454.CMB.1.raw
  modified_base (204)..(204): a, c, t, g, unknown or other
  misc_feature (204)..(204): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaanagccaccctctctgcgagggccagtcagtagtgttagcagctacttagcctggtaccaacacgaaacctggccagtcctccgaggcctcctcatctatgtatgcactccaacgacggccacgtcggcactcccagccgtaggttcaggtggcgtaggtgggtcgtgggacagtctcgtattccgaccactactccgagccgtaagcccgtaagcgtacccgtagtaacgtttagtttacgtacgtttaagttttagtttaccgttgtacgaggtacgtacggtaccggtaacgtaaccgtacgttaccgggtccttaccgtacgttaccccgttaacccgtccgggtaaccggtaacgggaccgtaaccggtaacgggtacggaaacggaggttaaaccggtaaacgggttaacgttcgggtaccggtactacggtacccacccgttacgg

SEQ ID NO: 255840 - DNA, 768 bp, Homo sapiens
  misc_feature: GYAE6OF02GFRZI.17.36.D03.1.454.CMB.1.raw
tcagcgtagactagcacgaccggtgctcgatttagctgcgtcacgatctctcttgggggaggaactgctcagttaggacccagagggaaccatggaagccccagctcagcttctcttcctcctgctactctggccccacgataccaccggacggaaattagtgttgtacacagtacgtccacgaccgaccctacgttcgtttcgttcgtccgggggtaaacgggaagcccgacccctaccgttccttcgcgacgggaccgtacgtacgacgaggtggttacgtacgacgacgtacttacggtcctacggttaccgaaaccagtaaacccgtcggccgacgtcttaccccaacggcctcctccactcttactgacgtgccatacctaaccgaacgggtccgaccgtaggcctacttcccccgaacgcccgtaagggttaccgaacggttcgggactaacgggtcggggtttaccggtacggggaacgaagtaccttttaccgtacttacccgttacaaccctattccgtacgaccgacgtaccgtacgtaacgcctacggtaaagttacttttcgtacgtaacgttttaagttacgttacgtctaacgtcgtacggtacggttacggaccgtaacgtacggtctacctaacgttaccctacccggttacgtacccggaaagggaccgtaaccggaccgtaacgggaagtaacgttacggaaaccgtaacggttggttaccggtacgtacgccgttaaccgacgtttacg

SEQ ID NO: 255841 - DNA, 801 bp, Homo sapiens
  misc_feature: GYAE6OF02HX63F.17.36.D03.1.454.CMB.1.raw
  modified_base (130)..(130): a, c, t, g, unknown or other
  misc_feature (130)..(130): n is a, c, g, or t
  modified_base (206)..(206): a, c, t, g, unknown or other
  misc_feature (206)..(206): n is a, c, g, or t
  modified_base (232)..(232): a, c, t, g, unknown or other
  misc_feature (232)..(232): n is a, c, g, or t
  modified_base (410)..(410): a, c, t, g, unknown or other
  misc_feature (410)..(410): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactntggctcccagataccaccggagaaattgtgttgacacagtctccagccaccctgtctttgtcgtaccgggggaaancgccacctctcctgcaggcagtcagngtgttagcagctacttagcctaggtaaccaacagaaaccgtgacctagtcctcccaggtcctcctacatcgtatgactgctactaccaacgacggccacgtcggacacgtaccccagacccgtaggttaccaggtcggtcaggttcgggtaccgtacggggacctagtaacccgtttnaacgtttccctaaccacccgtagttacccgaacggtccgttaaacgggaaccccgttaacggtacggtacccgtttaaagggaaccgggttttaacgtttttacggtaacgtttaaaccggtttttaacgtttaaccggtttaacgttaccgtaaggtaacccgtacggtaaccgggttaacgtaacccgtaaaccggtttcgggaaaccccttcgttaaacccgtttacccgtaaacccggggttttacccgggaaccggttaaaccgggggtacccgtaaacccggggtaaccggtaacgggggtaacgtaacggttaaaacccgggttaaacggtaaccggttacgggtaacccggtacggtaacccggtaccctaccggttaaccgg

SEQ ID NO: 255842 - DNA, 648 bp, Homo sapiens
  misc_feature: GYAE6OF02HT9XX.17.36.D03.1.454.CMB.1.raw
tcagcgtagactagcacgaccggtgctcgatttagctgcgtcacgatctctcttgggggaggaactgctcagttaggacccagagggaaccatggaagccccagctcagcttctcttcctcctgctactctggcctcccagatacccaccggagaaattgtgttgacacagtctccagccaccctgtcttgtccgtaccgggggaaagacgcccaccctctcctgcagggccagtcagagtgttagcagctacttacgctggtaaccaacagaaacctggccagtcctccaggcctcctcatcctatgactgcactccaacgcgggccacgtgcactcccagcctaggttccaggtggctaggtcgggtcgtagggacaggttaccttcgtaagtttcccacaaccgtatacgacgacgtaacgtcccgtaagacgaccgtacgaaacggttagttttacgaccttaaggttttaacttacgttagtacgacgtacgacgtacgttaacgaccgtaaccgtcggaccttacgaccgtaccgtacccgttaccgggaccgtaaacgggtacctaaccggtacgtacgggaacgtaacgttaaaccggaacgtaacgtcggtacggtaccgtacggtacccacgttaccg

SEQ ID NO: 255843 - DNA, 686 bp, Homo sapiens
  misc_feature: GYAE6OF02IJOVV.17.36.D03.1.454.CMB.1.raw
  modified_base (203)..(203): a, c, t, g, unknown or other
  misc_feature (203)..(203): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgctccgggggaaancgcccaccctctcctgcagggccagtcagagtgttagcagcttactagcctggtaccaacaagtaaaccctggcccaggtcctcccgaggtcctcctcattctatgatcgcactaccgaacgcgggcctacgtcggctaacctccccgagtccgtacggttacaggtcggtacgtagggttcgggtcgtaggggacctaggtaccttacgtactttccgtaccaacccgtagttaccgacgtaccgacgtacccgtaaggaccggtaccgtaagggttaaacgttaacgttttttcgacgttttaacgttttaacgtttacgttacggtcgtaacgacgtaggtaccgtaggtacctaacgtcggtacttaccgtacctccggttaacccttcgggaaccgtacggaccgtaacggtaacggtacggaagtacgtaaccggaaacgtacgtgggtaccggtacgtacgtaccgtacgtaccgg

SEQ ID NO: 255844 - DNA, 649 bp, Homo sapiens
  misc_feature: GYAE6OF02GZO7U.17.36.D03.1.454.CMB.1.raw
  modified_base (208)..(208): a, c, t, g, unknown or other
  misc_feature (208)..(208): n is a, c, g, or t
tcagcgtagactagcacgaccggtgctcgatttagctgcgtcacgatctcgtcttgggggaggaactgctcagttaggacccagagggaaccatggaagccccagctcagcttctcttcctcctgcctactctggctcccagataccaccggagaaattgtgttgacacagtctccacgccaccctgttctttgtcgtccggggaaancgccacctctcctcgcacgggccagtcagagtgttacgcagctacttacgccgtggtaccaacacgaaaccctggacctacgtcctacccgacggcctccctcaactcctatgtactcgaccactaccaacgcgggtaccacgtcggactaccgtaccacgtccgtacggttacgaggtcggtacacggggttcgggtacgtacgggaaccgtacgtaactttcacgtttcctacaccctagtcacgtacacggtctaacggacgtcgtagaacgttacgtttcgactttaagttttactacttcgtaacgtcacgttacgacgtaacgctaacgtcggtaccttacgacttacccgtaacgttccggaaccgtacgggaccacgtacggtaaggagtaactaacggaacgtacggtcggtccgacgtcgacctcttaacg

SEQ ID NO: 255845 - DNA, 681 bp, Homo sapiens
  misc_feature: GYAE6OF02IPYU9.17.36.D03.1.454.CMB.1.raw
  modified_base (381)..(381): a, c, t, g, unknown or other
  misc_feature (381)..(381): n is a, c, g, or t
tcagcgtagactagcacgaccggtgctcgatttagctgcgtcacgatctctcttggggctcagagaggtgccttagccctggattccaaggcatttccacttggtgatcagcactgaacacagaggactcaccatggagttggggctgtgcgttgggttttccttgttgcttattttaggaaggtgtccagtgtgaggtgcagcgtggtggagtcggtgggggagtcgttgggtacccgtccggtcggggggtccctggacgactcctccgtgtagtcgtcctcgtggtacttccgccttcacgttacctacgagctacgtcgaacgttcgggtcccgaccgtacggttccgaggggtacggtcgtcgggtaggtgggttnacgtatacgtagttagtagtagtgtagttacgtcctaataacgtaccgtacgactaacgtacgtgtacggtacgggaaccgggtcccttaacgtacctaaccgtacttcccgtaccgtaaggacgtaactacgtacggaaccctaaacggaccttaccgacgttgttaacctgtacgaactaacgtaacgaacgtaccgttacgtaaggaccgaacggaaccgtacgtaccggtacgttagtacgttaactacggtagtacgtacgtacggtacgtacgtcccggtctaggtcgtaacgg

SEQ ID NO: 255846 - DNA, 783 bp, Homo sapiens
  misc_feature: GYAE6OF02HGQF6.17.36.D03.1.454.CMB.1.raw
  modified_base (205)..(205): a, c, t, g, unknown or other
  misc_feature (205)..(205): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtcttgtccgtaccgggggaanacgccaccctctcctgcgagggccagtcgagagtgttagctagctacgttagcctggtaccaacacgaaacctcggaccacgtcctccccgaggtcctccctacgtacttcctaatcgacgtcgactaacgtacccgaaacggcgggacccctacgtcggacctacctccccgaacgccgtacgggttaccgaagggttccggacggtacggggttacggggttccgtacgggggtaaccgacggttaacccgtttacctaacgttttccccggacctacccgtacgtaccgtacggtaccgaacgttaccccggtaaggttaacccggccgtttaaaggtaacgttagtttttaccggacgtttaacgtttttacgttacgttaggtcgtaacgacgtacggttcgtaacgtaccgtaacggttaccggtcttaaccgtacttaccccggtaaccgttaccggggaccgtaaccggggtaccgtaccgggtaaccgtaacgggtaacggtaaacgtaacgggtaaaccggttaccggtacggttccggttaccgtaccggtacccgtccgttaaccg

SEQ ID NO: 255847 - DNA, 639 bp, Homo sapiens
  misc_feature: GYAE6OF02HSG09.17.36.D03.1.454.CMB.1.raw
  modified_base (206)..(206): a, c, t, g, unknown or other
  misc_feature (206)..(206): n is a, c, g, or t
  modified_base (243)..(243): a, c, t, g, unknown or other
  misc_feature (243)..(243): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagcccaccctgtctttgtctaccgggggaaanagccaccctctcctgcagggccagtcagagtgttagnagctacttagcctggtaaccaacagaaacctggacctagtcctcccaggcctcctacatctatgatgcactccaagacgggccacgtggcatccccagcctaggttcaggtggcaggtgggtactgggactacgtacttcagttcctacacctatcgagaccacgtcctagacgcctaggaagttacttttacggacttagttttaattacgtagtacagtccgtaagtaccggttacaaccgtaacgttcggaccttaccgaacgttacccgtaacccgtttaccgggaaccgtaacggggaaccgtaaccggtaacggttacgggaaacgtaacgtaaacggtaaaaccggtaacgttacggggtacggtaccctacggtaccctaaccgtacg

SEQ ID NO: 255848 - DNA, 627 bp, Homo sapiens
  misc_feature: GYAE6OF02H0UY6.17.36.D03.1.454.CMB.1.raw
  modified_base (272)..(272): a, c, t, g, unknown or other
  misc_feature (272)..(272): n is a, c, g, or t
tcagcgtagactagcacgaccggtgctcgatttagctgcgtcacgatctctcttgggggaggaactgctcagttaggaccagagggaaccatggaagccccagctcagcttctcttcctcctgctactctggctcccagactaccaccggagaaattgtgtgacacagtctccagccaccctgtctttgtccgtcggggaaagcgacccacctctcctgccgagggtccagtcagagtgtagcagctatgctgacaacagaactgacatccnccgagctcctacacgtctatgatcactactaccaacgaggaccctactcggacctacctcccgacgacgtacggttacgaggtacgggctaagggtcgggtttccggaacgggtaacgacggttaccttaccgtatttcccgacgtaaccctagtacgaacgtccgaacggtacctaacggacgtactaggaaccttgtttacgacttagtttacttacgtcacgtaggtcaggtaccgtacgtacacggtgccttacgtctaaccgtaccgttccgaaccgtacgggtaaccacggtaaccgtaggacgaagttaacgaaccgtacgtaggtccgacgtacaccgtcctaacgg

SEQ ID NO: 255849 - DNA, 598 bp, Homo sapiens
  misc_feature: GYAE6OF02FQY17.17.36.D03.1.454.CMB.1.raw
  modified_base (205)..(205): a, c, t, g, unknown or other
  misc_feature (205)..(205): n is a, c, g, or t
  modified_base (291)..(291): a, c, t, g, unknown or other
  misc_feature (291)..(291): n is a, c, g, or t
  modified_base (532)..(532): a, c, t, g, unknown or other
  misc_feature (532)..(532): n is a, c, g, or t
tcagcgtagactagcacgaccggtgctcgatttagctgcgtcacgatctctcttgggggaggaactgctcagttaggacccagagggaaccatggaagccccacctcagcttctcttcctcctgctactctggctcccagataccaccggagaaattgtgttgacacagtctccagccaccctgtctttgtcgtccgggggaaancgccacctctcctgcagggccagtcagtagtgttagcagctacttagcctgtaccaacagaaacctggccagcctccaggctcctnactctatgatgactactaccaacgacgggccacgtcggccactcccagcctaggttcagtcggcaggtcggtcgagggtacagtacttcatttccacacctgtcagcaacgtcctaggactccgtaggtaagttcgttttcgactttaagttttacttacgtcgtacgagtacgtagacgttagaccgtacggtcggaccttacgtaacgttccctaccggttcggaacccgtagggaccncggtaacggtggaacgtacgtaacggaaacgtagtcggtacggcgtaccgacgtacctgtttaccg

SEQ ID NO: 255850 - DNA, 703 bp, Homo sapiens
  misc_feature: GYAE6OF02IRAM1.17.36.D03.1.454.CMB.1.raw
  modified_base (203)..(203): a, c, t, g, unknown or other
  misc_feature (203)..(203): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgctccgggggaaancgccaccctctcctgcagggccagtcagagtgttagcagctatagcctggtaccaacagaacctggccagtcctcccgaggtcctcccgtcactctatgatgcactccaacgcgggccacgtggcctacctccccgagaccgtaggttccgaggtcgggcgtacggttggggtaccgtagggggacctaggtaccgttactacttccgtaccgacctacgtacgacggaccgacggtacccgttaaggaccggtacccgttaaggtaaacgtttacgttttaggtaccgtttaagtttttacgtttactacgttacacggtaccgtagtaccggtaacggtacctacggttccgtacttaccgttaccgttaccctaacccgggtttaccggaaccggtaacgggtacctaccgggtaaccggttaggaacggtaacggtaacgtaaaccgggttaacgtcgggttacggcccgttaacggtaccctaaccggttacccg

SEQ ID NO: 255851 - DNA, 827 bp, Homo sapiens
  misc_feature: GYAE6OF02J2J56.17.36.D03.1.454.CMB.1.raw
  modified_base (211)..(211): a, c, t, g, unknown or other
  misc_feature (211)..(211): n is a, c, g, or t
  modified_base (244)..(244): a, c, t, g, unknown or other
  misc_feature (244)..(244): n is a, c, g, or t
  modified_base (273)..(273): a, c, t, g, unknown or other
  misc_feature (273)..(273): n is a, c, g, or t
  modified_base (612)..(612): a, c, t, g, unknown or other
  misc_feature (612)..(612): n is a, c, g, or t
tcagcgtagactagcacgaccggtgctcgatttagctgcgtcacgatctctcttggggaggaactgctcagttaggacccagagggaaccatggaagccccagctcagcttctcttcctcctgctactctggcctcccagactaccgaccggagtaaattgtgttcgacacagtcctccagccaccctgtctttgtccgtacgggggaaancgcccacccgtccttcgcgacgaccggtcacgnagtagtagtacgcgacgtactaacgttcncgttacggaactaacgacaaccgcgacctacgtcctaccgcgtccctctactactccgtaagcgtacgttacgacctaccgtaaccgaaccgggccgtaccgtaccggtacggaccctacccgtaccccggaacgacccggttttacggtaccgttacggggtccggacgggttacgggggtttccggtaacgggttacccggaaacggtccgtttaaccgttctttacccgttacccgaacgtacccgttaacacgtaccggaccgtaccggttaaccgtcggaccttacggttaaacgtacgttttacgtttacgaaacgttttacgttttaaaccncggtccgtaacgaacggtaccggagtaccccgggtaactaacgggtacgttcgtaccccggtaaattacccggttaccccttaacggggacccggttaaaccgggagtaaacccgtaaccggggtccggtaaaacggcggttaaaacccggaaccggttaacgggaccgtttagggggacccttaccccgaagggtacccccttaaggttacccg

SEQ ID NO: 255852 - DNA, 728 bp, Homo sapiens
  misc_feature: GYAE6OF02GXIXC.17.36.D03.1.454.CMB.1.raw
  modified_base (207)..(207): a, c, t, g, unknown or other
  misc_feature (207)..(207): n is a, c, g, or t
  modified_base (239)..(239): a, c, t, g, unknown or other
  misc_feature (239)..(239): n is a, c, g, or t
tcagcgtagactagcacgaccggtgctcgatttagctgcgtcacgatctctcgttgggggaggaactgctcagttaggacccagagggaaccatggaagccccagctcagcttctcttcctcctgctactctggctcccagataccaccggagaaattgtgttgacacagtctccagccaccctgtcttgtcgtaccgggggaaaancgccaccctcgtcctgcgacgggccagtcagngtgtagcagctacttagcctaggtaaccaacacgaaacctggaccaagtcctacccgaggcctacctcattactagtgatcgcaacttaccaaacgacgggccctacgtggactaaccgcccaacgtccgtacggttaccaggtcgggacgtaggtcggggttacgtacgggggaacctaacgttaccttacgtactttacccgtaacccgaccgttactacgtaacgaccgtaaccggtacccgtaaaggtaccggtaccgttaaacgttaacggtttacgttttacggttaccgtttaagtttttacgtttaacgttacgttaccgaacggcgtacggtacggttaccgaccgtaacgttaccgctacgtacttacccgtaccggttaccggaccgtaacgggaccgtaaccgtacggttaacggacggtaacgttaacggtaaaccgacggttcggtaccggaccttacggtaccgaccgttaccg

SEQ ID NO: 255853 - DNA, 707 bp, Homo sapiens
  misc_feature: GYAE6OF02GS8YH.17.36.D03.1.454.CMB.1.raw
  modified_base (211)..(211): a, c, t, g, unknown or other
  misc_feature (211)..(211): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggcctcccagataccaccggagaaattgtgttgacacgagtcctccacgcccaccctgtctttgtcgtaccgggggaaanacgccctaccctctcctgcgacgggccagtcaggtagtgttacgcacgctactagccgtggtaccaagacgaaccgtggaccagtcctccagtcctcctcactctatgatcgcctatacccaacggcggaccacgtgcctacgtcccaggtcctacggttcaggtcggacgtcggtcgggtacgcgggaactaggtacctttcgtactttccgcctaacccgtgcccgtaagccgtaaccggtcctaaacgggtaccgtaccggtaaggtaacggttttacgttttacggtaaccgttttaacgttttactttaccgtagttaccgacggtactacggtccggtaactaccgttaacgtcgtaccttacgaccgttacccttaccgggtaccgtaaccggtacggggacctaccgggtacggtacgggttaaactaaccggttaagggtaaaaccctgggttcggtaccgtacgggtaaccctaccgtacggttcc

SEQ ID NO: 255854 - DNA, 636 bp, Homo sapiens
  misc_feature: GYAE6OF02H63SC.17.36.D03.1.454.CMB.1.raw
  modified_base (204)..(204): a, c, t, g, unknown or other
  misc_feature (204)..(204): n is a, c, g, or t
  modified_base (258)..(258): a, c, t, g, unknown or other
  misc_feature (258)..(258): n is a, c, g, or t
  modified_base (287)..(287): a, c, t, g, unknown or other
  misc_feature (287)..(287): n is a, c, g, or t
  modified_base (293)..(293): a, c, t, g, unknown or other
  misc_feature (293)..(293): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaangccacctctcctgcagggccagtcagagtgtagcagctatagctaggtaccaanagaaacctggacagtcctccaggctcctnatctangatgcataccaacgacgggaccaagtcggacctaactccccgagtacccgtaggttaccagggttcggactacggggttgggttaccgtaggggtaaccacggtaacctttcaacgtttcctacaaaccctatacgagccgaacgtcctaaggacgtccgtaacggtaaacgttacgttttcgacttaagtttttactacgtgttacgagtacagtacgtaagcgtaacgtgacctatctacgtaacccgtttacggaccgaacgggtacgaacgacgttagggacgtaaacgttacggaaaacgtacgttcggaccggttactaccgtacccgtactaccgg

SEQ ID NO: 255855 - DNA, 667 bp, Homo sapiens
  misc_feature: GYAE6OF02FYPRT.17.36.D03.1.454.CMB.1.raw
  modified_base (205)..(205): a, c, t, g, unknown or other
  misc_feature (205)..(205): n is a, c, g, or t
  modified_base (267)..(267): a, c, t, g, unknown or other
  misc_feature (267)..(267): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagcccaccctgtctttgtctccgggggaaanacgccaccctctcctgcgacgggccagtcagagtgttagcagctactagccgtagtaccaanacgaaacctggaccagtcctccaaggcctccgtacactctatgatcgacactacccaagacgggccagtacggaccacgtaccccagccgtacggtaccagggtggcgtaggttcgggtcgtagggacgtacgtaccgttctacgttactaccgaacctctccgaacgtactaaccggaccgttaacggaccgtaccgttaaggtaaaacgtttacgttttcggaaaccgttttagtttttaaccgttaaccgtcggttaaccaggtaccgtaaacgggttacggttaaccgaccgtaacggttcggccgttaactaccgtacgtaccgttacggaacgacggtccgaacggttcggaggaactaagtacgtaacgtggtagtacggctacgcctatacg

SEQ ID NO: 255856 - DNA, 758 bp, Homo sapiens
  misc_feature: GYAE6OF02FJV56.17.36.D03.1.454.CMB.1.raw
  modified_base (224)..(224): a, c, t, g, unknown or other
  misc_feature (224)..(224): n is a, c, g, or t
  modified_base (732)..(732): a, c, t, g, unknown or other
  misc_feature (732)..(732): n is a, c, g, or t
tcagcgtagactagcacgaccggtgctcgatttagctgcgtcacgatctctcttgggggaggaactgctcagttaggacccagagggaaccatggaacgccccagctcagcttctcttcctcctgctactctggctcccagactaccaccggagtaaattgtgttgacacgagtcctaccacgccctacccgtgttacctttcggtccggtaccgggggaaaanaccgtcccaccccgttcctccgtacgccgtacgggcctaggtccaggtagttgttacgaccgagtccttacgttacgccgtacgtaaccaaacgacgaaaccgtcgacctacgttcccgtacccacggtcctcccgtactacttacgtactagatccgactacctaccgaaccggaccgggtaccctcgtacgggccctaaccgtccccgaacggtcccgtacgggttacgacgggttccgggacgttacggtacggggttaccgtaggggtaaccctaaacgttcctttctacggttcccaacctaccgtactaccggaacgtcctaacggtacccttaacgggactccttaaggaacgttttcgttacgtacgtttactttacgttagtaccggtacaggtaccagttaccgacgtaacctcggtacttccgtactaaccgtccctaccgggtaccgtaagacggacgtacggaacgttggaactaacgttaacggaacgttacgnggtactaccgtacgacgtaactccgg

SEQ ID NO: 255857 - DNA, 733 bp, Homo sapiens
  misc_feature: GYAE6OF02FU6HG.17.36.D03.1.454.CMB.1.raw
  modified_base (219)..(219): a, c, t, g, unknown or other
  misc_feature (219)..(219): n is a, c, g, or t
tcagcgtagactagcacgaccggtgctcgatttagctgcgtcacgatctctcttgggggaggaactgctcagttaggacccaggagggaaccatggaacgccccagctcagcttctcttcctcctgctactctggctccagactaccaccggagtaaattggtgttagacacagttctccagccctaccgttgttctttggtccggtaccgggggaaancgcccacctctccgtgcgacgggccagtcagtagtgtacgcagtcttacttacgtcctacggtaaccaacaacggtaaccgtcggaccctaacggttcccgtaccccgacggtcctacccgttcgtaacttcgttaagtgacgtacggacctactaacccgtaacggacggtaccctacggttacggacccgtaccgtaccccgacgaccgttacggggttaccgacggggttcggacgggttaacggggttccggggtaagggttccggggtaaacgtacgtttaaccgttccgttaactttacccgacctacccgtagtacccgtacgaccgtactaccggtagaccgtcgtaggttactttacgtttgtaatttacggtttatttacgttcgtactacggacgtacgtacgtacggctacgtccgtcgttactaccgtccgaccgttaccgacgtacgacgtcgtacgtagaacgtataacgtaagtcgtaggaccacgtacgacacgttc

SEQ ID NO: 255858 - DNA, 841 bp, Homo sapiens
  misc_feature: GYAE6OF02G38GU.17.36.D03.1.454.CMB.1.raw
  modified_base (211)..(211): a, c, t, g, unknown or other
  misc_feature (211)..(211): n is a, c, g, or t
  modified_base (473)..(473): a, c, t, g, unknown or other
  misc_feature (473)..(473): n is a, c, g, or t
tcagcgtagactagcacgaccggtgctcgatttagctgcgtcacgatctctcttgggggaggaacttgctcagttaggacccagacgggaaccatggaagccccagctcagcttctcttcctcctgctactactcggctcccagactaccaccgagaattgtgttgacactagtctccagccaccctgtctttcgtcgtaccgggggaaanacgcccaccctcacctgcgacgggtccagtcaggagttagtagcagtctaacttagccgtaggttacccaacgtaacgaaacccgtggtaccagttaccctccgaaggtccttacccgtactattactaagtgtactgaccctactaaccggaacgacgggccctaacggtcggacctaccgtaccccgtacggaccgttacggtacttacgggcggtacgtagggttacggggtcgtaacgggtaactacgtaccggtttntaaaccgttccgtaaccaaccgttaggacccaaggtacccggtacgaaccggttacgaccgttaccgaaggttaaccggtttaatttccggtaacgtttaaacggtttttacttaaccttacgggacttaaccggacggttaaaccgaccggtttaagaaacccccggttcgtttaacgacccggttaacttaccccgggttaacccgtaaccccgggtttaagggacccggtaaacggggtaaccgttaacccgggtaacggttaacggggttaaacgtaagtttaaccccgggaaaaacggttttcccggtaccgggtttacccggtaacccgtttaacccgggtaacctaacccgtttaacccgg

SEQ ID NO: 255859 - DNA, 871 bp, Homo sapiens
  misc_feature: GYAE6OF02I9JYW.17.36.D03.1.454.CMB.1.raw
  modified_base (205)..(205): a, c, t, g, unknown or other
  misc_feature (205)..(205): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtaccggggaaanagcccaccctctcctgacgagggccagtcagtagtaggttacgacgagtactacgttacgccgttacggtaaccaaacgtaacgaaaacccttggaccgtagtacccgtaccccgaacgggtcccttcccgtaactacgttacctaagtcggtaactacggacctaacctacccgaaaaccggacccgggtaccctaaccggttacgggaaccaaccccggtttaccccgaacggttacccccggtaaaggggtttaccgaacgggttaccggggtaccggttaaacggggttccggggtttaccggttaaacgggggaaaccgttacggtttaacccgtttaccgttaaccgttttaccgtaaaacccgttaacccgtaacgttacccgaacgggtaaccctaacggttaacccgtacggtaaccgccgtttaaagggtaaacgttttcgtttaacgttcgttttaacggttttaaacttccgtacgttaccgacggttcgtaaacgttcgtaacgtacggttactcggttacccaagttacccgtaccttaaccggttaccggaaccgtacgggtacctaaccgggtaacgtacgggtaagaaaccggttaaccgaaacggttaccgggtgtaaccgggtcctaacgaccccgtagttaaccgg

SEQ ID NO: 255860 - DNA, 893 bp, Homo sapiens
  misc_feature: GYAE6OF02JDWVI.17.36.D03.1.454.CMB.1.raw
tcagcgtagactagcacgaccggtgctcgatttagctgcgtcacgagtctctcttggggaggaactgctccagttacggacccgagtagggaaccattggaagtccccagctcaggcttctacttccgtcctgactactctggcgtcctaggactaccaccggacgtaattgttcgttagacgaactagttactccgacgtccaccgtgtacgtttgtccggtaccggggaaatacggccctaccctcgtccggtgggacgacgggtccgacgttccgaacggtacggttacgttacggtcgacggtaccgttaccttacggccgttacggtaaaccctaaccgtaacggtaaccgttaccggtacccgttaccggttacccggtaccccgtaaccggtcccttacccgtacttaacttaccggttacgtacggtaacggttcccggaacctaaccggttaacccccgaaaccgggtaaaccggggacccgttaaccgggtcggtaaccgtaccgtaccccggtacgtaccggttaacggttacgtacgggtaccgggtagtacgggtacgggttacgaacggtactacggttacctacgtaccgttaccaccgtaacctcgtacgaccgtaccaaccggtctaaccggtacgtaccttaaggtaaaccggttattacggtaaccgtttagtttaaactttcgtaaccgttaggaacggtactacggtaaacccttagaacccggttacgttcgaaccggtactaaccgacccggttaaccgcccggggtaacaacccgggttacggacccgtaaaggaaccggtataaaccggtaacgtaaccggttacggtccgggttacgaacccggtacgtaacccggactttaaccgg

SEQ ID NO: 255861 - DNA, 781 bp, Homo sapiens
  misc_feature: GYAE6OF02H4FOT.17.36.D03.1.454.CMB.1.raw
  modified_base (152)..(152): a, c, t, g, unknown or other
  misc_feature (152)..(152): n is a, c, g, or t
  modified_base (213)..(213): a, c, t, g, unknown or other
  misc_feature (213)..(213): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccgganaaattgtgttgacactagtactccgagtcccacccttgtctttcgtcgtaccgggggaaanaccgccctaccctctccgtagaccgagggcctagtctaggagtagttagacaggtcttaacttacgccgtagtaaccaacaacgaaacctcggacctacgtccgtaccgacggtcctcctcacttcctagtcgtagtcgacactaccgtaacgacggaccctacgtacggactacctacccgacgtaccgtacggttacgacggtacgggacgtacggttcgggtaccggtacgggtaaccgtacgggttaaccttactacgtttacccgttacccgtaacgtaaccgtaccgtaacggtaccgaaccggttcccgtaaacggtaccggttaaccggttaacgttaaacggtttacggtttttaccggttaaggtttaaaccgttttaacgtttacgttaccgggtactaccgtagttaaccgggtacgttaacgtaccgtacgtacggttacctaccgttaaccgtaccgtaccgttacccggtaccgaaccggtaacgaccggtacgtacgggtacgtaacggtacgaaacgtacgtacgtcggtacgtacgtaccgtacttaccg

SEQ ID NO: 255862 - DNA, 746 bp, Homo sapiens
  misc_feature: GYAE6OF02HA36Z.17.36.D03.1.454.CMB.1.raw
  modified_base (213)..(213): a, c, t, g, unknown or other
  misc_feature (213)..(213): n is a, c, g, or t
  modified_base (244)..(244): a, c, t, g, unknown or other
  misc_feature (244)..(244): n is a, c, g, or t
  modified_base (253)..(253): a, c, t, g, unknown or other
  misc_feature (253)..(253): n is a, c, g, or t
  modified_base (279)..(279): a, c, t, g, unknown or other
  misc_feature (279)..(279): n is a, c, g, or t
  modified_base (300)..(300): a, c, t, g, unknown or other
  misc_feature (300)..(300): n is a, c, g, or t
tcagcgtagactagcacgaccggtgctcgatttagctgcgtcacgatctctcttgggggaggaactgctcagttaggacccagagggaaccatggaagccccagctcagcttctcttcctcctgctactctggcctcccagatacccaccggagtaaattgtgttgacacagtctccagcccaccctgttcctttgtccgtaccgggggaaanacgcccaccctctcctgcgaggccagtcagngtgtagcanctactgcctagtaccaacgagaaccnggccagtcctccgagcctccncatcgtatagatgacctatacccgaacggcggaccctacggtgacctaccgtcccgacggccgtaggttaccgagggtcggcggtagggttcggggtacgtaggggaacctacgtacctttacgtaccgttccgaccctaacctacgtcccgacgaccgtaacgtacccggtaagtaccggtaccgtaaaggttaaacggttttcgttttaacggtaccgttttaagtttttaacccgtttacgttcggtaacgtacgtacgtaacggtccggttaaccgaaccgttaagttccggtaacctacgtaacccgttaccgtaacccggttaccggaaccgggtaacggaacccgttaacgggtaacgttcggggtaaaagttaaccgtaaaccgggttaaacgttacgggttcggaaccggtcccgttaacgtaccgttaccctacgg

SEQ ID NO: 255863 - DNA, 633 bp, Homo sapiens
  misc_feature: GYAE6OF02FSV0X.17.36.D03.1.454.CMB.1.raw
  modified_base (206)..(206): a, c, t, g, unknown or other
  misc_feature (206)..(206): n is a, c, g, or t
tcagcgtagactagcacgaccggtgctcgatttagctgcgtcacgatctctcttggggggaggaactgctcagttaggacccagagggaaccatggaagccccagctcagcttctcttcctcctgctactctggctcccagataccaccggagaaattgtgttgacacagtctccagccaccctgtctttgtcgtccgggggaaanagccaccctctcctgcagggccagtcagagtgttagcagtctacttagcctggtaccaacagaaacctggaccagtcctcccaggcctcctcatctatgatgcataccaagacgggccacgtcggccactcccgagccgtaggttcaggtggctaggtgggtcgtagggactaagtacttcactttccgtacaccgtatcgagtcacgaccgttagacgtcctagtaagttacgttttagactttaagttttaacttacgttcgtactagaccgagtacggtagacctaagttcggaccttacgacttacccgtaccgtttacccgggaaccgtaacgggacccgaaccggttaacgtacgggaacgtaacgtaaacggaaaccggtacgttacgggtaccgggtactacggaccctaccgttaacg

SEQ ID NO: 255864 - DNA, 768 bp, Homo sapiens
  misc_feature: GYAE6OF02GT9YB.17.36.D03.1.454.CMB.1.raw
  modified_base (156)..(156): a, c, t, g, unknown or other
  misc_feature (156)..(156): n is a, c, g, or t
  modified_base (167)..(167): a, c, t, g, unknown or other
  misc_feature (167)..(167): n is a, c, g, or t
  modified_base (173)..(173): a, c, t, g, unknown or other
  misc_feature (173)..(173): n is a, c, g, or t
  modified_base (209)..(209): a, c, t, g, unknown or other
  misc_feature (209)..(209): n is a, c, g, or t
tcagcgtagactagcacgaccggtgctcgatttagctgcgtcacgatctctcgttgggggaggaactgctcagttaggacccagagggaaccatggaagccccagctcagcttctcttcctcctgctactctggctacccagactaccgaccgganaaattgtggtnacaacngtctcacgccacctgtcttgtaccggtacggggaanacgccctacctctccgtcgcgacggacctacgtaccgaggtaggttacggttaacgccgacgtaccgtacgttacgaccgttaccggtaaccaaacgaacggtaaaccgtcgggtactaccgttcctaccgacggccttcctacctactacgtaagtcgtactgacctaacgtaccgaaacgccggacctaccgtcggacctaccgacccgtacgtacgtacggtacgacgtacggtacgtagggttcggggtacggtacggtcgtaaccgtacgtttacaacgtttcctaacccgactacggtactaccggcttacggaccgttacggtaccggtaccttaagggttacttaacgtttcgtacgtttaaccgtttacgtttacctcgttaaccgtcgacgttaccgtaacggttacgaacctacgggtaccgtaccttacgttaacccgtaccgttaacccggttaccggaaccggtaccgtaaccggtaggttaccggaaggtaacctacggtaaaacgtacgacggtacttaccgggctaacggacctagttaacc

SEQ ID NO: 255865 - DNA, 494 bp, Homo sapiens
  misc_feature: GYAE6OF01D2MU8.40.2.A02.1.454.CMB.1.raw
  modified_base (274)..(274): a, c, t, g, unknown or other
  misc_feature (274)..(274): n is a, c, g, or t
  modified_base (342)..(342): a, c, t, g, unknown or other
  misc_feature (342)..(342): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcagaaaccaggaaaagcccctnagctcctgatctatactgcatccaactttacaaagtggactccatcaaggttcagcgcagtggatcgnggcacagtattcactctcaccatcagcacgcctgcagcctagaagtattttcgactaactttatactgtactacaagtattacaacttaccgtcgtactttcggccgtaggggtacctggctaggagactacgaaacgtactgtggtctacg

SEQ ID NO: 255866 - DNA, 494 bp, Homo sapiens
  misc_feature: GYAE6OF01B89SV.40.2.A02.1.454.CMB.1.raw
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcagaaaccaggaaaagcccctcagctcctgatctatactgcatccactttacaaagtgagtccatcaaggttcagcggcagtggatctggcacagtatttcactctcaccatcagcagcctgccagcctagaagtattttgactaactttattactgtactacaagtattaacaattaccctgtaccttttcgggacctacggggtacctggctaggatagtacaaacgactggtggctacg

SEQ ID NO: 255867 - DNA, 561 bp, Homo sapiens
  misc_feature: GYAE6OF01BZZVZ.40.2.A02.1.454.CMB.1.raw
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcaagaaaccaggaaaacgcccctcacgcctcctgatctatactgcatcctactttacaagtggactcccatcaaggttcagcggcaggtggatcgtggcacgagtactttcactctcacctatcagcagcctgcacgtcctagtaagttatttgacttaactttattactcgttactaactaagtaacttaacctaacgtttaccccgttacggttaccgttttcgggacccggtaacgggggtacccttcgggtcgttagggaacgtaacgtaaccaaaaccggtaacgttcgggtcggtcgtaccgg

SEQ ID NO: 255868 - DNA, 510 bp, Homo sapiens
  misc_feature: GYAE6OF01AEGYB.40.2.A02.1.454.CMB.1.raw
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcagaaaccaggaaaagcccctcagctcctgatctatactgcatccactttacaaagtgagtcccatcaaggttcagcggcagtggatctggcacagtatttcactctcaccatcagcagcctgcagcctagaagtattttgactaactttacttactgtactacaagtatttacaactttaccctcggtaccttttggacccgtaggggtaccctgggcctgggaagaacgttacaaaacgtaactggtcggcgtacg

SEQ ID NO: 255869 - DNA, 539 bp, Homo sapiens
  misc_feature: GYAE6OF01EFV83.40.2.A02.1.454.CMB.1.raw
  modified_base (276)..(276): a, c, t, g, unknown or other
  misc_feature (276)..(276): n is a, c, g, or t
  modified_base (337)..(337): a, c, t, g, unknown or other
  misc_feature (337)..(337): n is a, c, g, or t
  modified_base (404)..(404): a, c, t, g, unknown or other
  misc_feature (404)..(404): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccggcaagtcagggcattggaaatgatttagcctggtatcagcaagaaaccaggaaaacgcccctanagcctcctgactctatactgctatccaatttacaagtgacgtcccatcaaggttcagcggnagtgatcgtggacactagtactttcacttcctacacctatcagcacgcctgccagcctagaacgttntttcgactaacttattactgttactaactaagtacttactaacttacccgtcggttaccgtttacgggaccggtacggggtacccttggggtcctagggtaagtactaacgaaaccgtaagtggtacggctacgg

SEQ ID NO: 255870 - DNA, 518 bp, Homo sapiens
  misc_feature: GYAE6OF01CK6T8.40.2.A02.1.454.CMB.1.raw
  modified_base (275)..(275): a, c, t, g, unknown or other
  misc_feature (275)..(275): n is a, c, g, or t
  modified_base (385)..(385): a, c, t, g, unknown or other
  misc_feature (385)..(385): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcagaaaccaggaaaacgcccctnagctcctgatctatactgcatccatttacaagtgatccatcaaggttcagcggcagtgatcgtggcacagtatttcactctcacatcagcagcctgcagcctagtaagtnttttacgactaaactttattactagtactaactaagtacttactaactttacccgtacggtaccttttgggacccgtaggggtacctgggtacttagggaactaacgtaccaaaacggtactggtcggctacg

SEQ ID NO: 255871 - DNA, 752 bp, Homo sapiens
  misc_feature: GYAE6OF01CI8H9.40.2.A02.1.454.CMB.1.raw
  modified_base (212)..(212): a, c, t, g, unknown or other
  misc_feature (212)..(212): n is a, c, g, or t
tcagtctagcgactcacgaccggtgctcgatttagactcatctacagggggagtcagacccactcaggacacagcatggacatgagggtccccgctcagctcctggggctcctgctgctctggctccaggcgccagatgtgccatccagatgacccagtctccatcctcactgtctgcatctgtaggagacagagtcacatcacgtgccggnaagtcagggcattggaatgtattagctggtatcagacaagaaaccaaggaaaaccgcccctacgacgcctacctgacttactaatactgactactcctaactttaacgaaaggttcggaacgttacccaagtacgtaaacggttcaacggtccggacgtaagggttacggaacgttcggtacgggacctaacgtaagttacttttaccaaccttcccgttaaccaaccctaattacccgaacgtacccgtaacgtccccgttacggaccaaccggtcccgttaagggtaaacgttttacttttacggtaacctttaaacgttttaacgtttaacccgttacggttaaccttaaacgttaaacggttaaccttttaaccgtaaacccgttttaaccccggttaccggtttaaacccggtttttaccggggaaccccggttaacggggggtacccttacgggggtacccgttagggggtaaaccttaacggttaaaccccggaaaacggttaccggttcgggttacgggtcccgttaaccgg

SEQ ID NO: 255872 - DNA, 497 bp, Homo sapiens
  misc_feature: GYAE6OF01DYDEZ.40.2.A02.1.454.CMB.1.raw
  modified_base (391)..(391): a, c, t, g, unknown or other
  misc_feature (391)..(391): n is a, c, g, or t
  modified_base (410)..(410): a, c, t, g, unknown or other
  misc_feature (410)..(410): n is a, c, g, or t
  modified_base (490)..(490): a, c, t, g, unknown or other
  misc_feature (490)..(490): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcagaaaccaggaaaacgcccctcagctcctgatctatactgcatccactttacaagtggagtcccatcaaggttcagcggcagtgatctggcacagtactttcactctacaccatcagcagcctgcagcctagaagttntttgactaactttatactntactaacaagtacttacaacttaccctggtacctttggaccgtaggggtacctggctggaatacgtacaaaacgattggnggctacg

SEQ ID NO: 255873 - DNA, 570 bp, Homo sapiens
  misc_feature: GYAE6OF01BNOVT.40.2.A02.1.454.CMB.1.raw
  modified_base (297)..(297): a, c, t, g, unknown or other
  misc_feature (297)..(297): n is a, c, g, or t
  modified_base (411)..(411): a, c, t, g, unknown or other
  misc_feature (411)..(411): n is a, c, g, or t
  modified_base (442)..(442): a, c, t, g, unknown or other
  misc_feature (442)..(442): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcaagaaaaccaaggaaaacgcccctcacgctcctgatctatactncactcctaactttaacaaagtcggacgtcccaatcgtaaggttcaggcggcaggtggactcgtggcactagtactttcacttcacaccatcagcagcctgcacgctagtaattntttcgacttaactttattactgtaccttaanaagttacttaactaacctttacccgttcgggttaccgttttcgggaccccggtaagggggtacccttgggtccgttagggaacgtaacgttaaccgaaaacggtaaccgtttcggtgggtcctaccgg

SEQ ID NO: 255874 - DNA, 536 bp, Homo sapiens
  misc_feature: GYAE6OF01EP1EX.40.2.A02.1.454.CMB.1.raw
  modified_base (347)..(347): a, c, t, g, unknown or other
  misc_feature (347)..(347): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcaagaaaccaggaaaacgcccctcacgctcctgatctatactgcatcctactttacaaagtggacgtccatcaaggttcagcggcagtggatcgnggcacagtattcactctcacctatcagcacgcctgcagtcctagaagtattttcgacttaactttattacgtgttactaactaagtacttaactaactttacccgtacggttaccgttttcgggaccgtaacggggtacccttgggctagggacgtacttaaccgaaaacggtacttcggtgtctacgg

SEQ ID NO: 255875 - DNA, 532 bp, Homo sapiens
  misc_feature: GYAE6OF01DA2LY.40.2.A02.1.454.CMB.1.raw
  modified_base (408)..(408): a, c, t, g, unknown or other
  misc_feature (408)..(408): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatccctcactgtctgcatctgtaggagacagagtcaccatcacttgccgggcaagtcagggctatggaatgattagctggtatcagacagaaaccaggaaaacgcccctcagcctcctgatctatactgcactcctactttaacaaagtgacgtacccagtacgaaggttcacgcggacaggtcggatcgtggctaacagtacttcactctaccacctatcagcagcctagcacgctagaactntttagactaacttatactagtactaacagtaacttactaactttaacccgtcggtacctttcggaccgtacggggtacctacgggcttacgggaatacgtacgaaacggtactggtcggcgtcg

SEQ ID NO: 255876 - DNA, 775 bp, Homo sapiens
  misc_feature: GYAE6OF01C5PDG.40.2.A02.1.454.CMB.1.raw
  modified_base (228)..(228): a, c, t, g, unknown or other
  misc_feature (228)..(228): n is a, c, g, or t
  modified_base (272)..(272): a, c, t, g, unknown or other
  misc_feature (272)..(272): n is a, c, g, or t
  modified_base (304)..(304): a, c, t, g, unknown or other
  misc_feature (304)..(304): n is a, c, g, or t
tcagtctagcgactcacgaccggtgctcgatttagactcatctacagggggagtcagacccactcaggacacagcatggacatgagggtccccgctcagctcctggggctcctgctgctctggcctcccaggcgccagatgtgccatccagatcgacccagtctccatcctcactgtctgcatcgtaggtaggagacaggtactcaccatctacgttggacccggganaaggtcgaagggctaagttaggaaatgtatttagccgtaggtancagacaagaaaccgaaggaaaaccgcccctanacgtcctacctagtacttctaatacgtgacctacttaaccctaacttttaacgaaaaggttccggaacgttacccaagttacgaaacggttacgaacggtaccgggacgtaagggtacggtacgttacggtacggacctaacgtaagtttacctttaacctacctaccttaccaaacccttaagtaccgaacgtaccgtaaccgcccgttacgacctaaccggtaaccgttaaaggtttaaacgtttacgtttttaccgaaacctttaaaactttttaacgttaccttaacggttaaccttaaaaacgtaagttaaacgtttaaacccttaaacccgttttaccccggtaacgggtttaaccgttttacccggggaacccggttacgggggtaaccctcggggtaaccggtagggtaaaacccgtaacttaaacccggaaaaacgtacggttgggttaacgcccgtaaccg

SEQ ID NO: 255877 - DNA, 586 bp, Homo sapiens
  misc_feature: GYAE6OF01BYFMO.40.2.A02.1.454.CMB.1.raw
  modified_base (580)..(580): a, c, t, g, unknown or other
  misc_feature (580)..(580): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcagttggaatgatttagcctaggtatcagacagaaaccaggaaaacgcccctagagtcctcctagtacttactatactgactactaccgtatttaacgaaagtcggacgtaccctagtacgtaaggttcaggcggactagtgatcgtggcatacgtacttcacgtctacactatacacgtcagtccctagacctagtacctaggaacttcgttttacgaactaacgttttattacgttacgtacctaaacgtaacgtaactttaacctaaaccgtttccgttaaccggttacgttttacgggaccgtacggggtaccctaggtcgtaggtaagactacgaaacggtagtcgtcggntaccgg

SEQ ID NO: 255878 - DNA, 487 bp, Homo sapiens
  misc_feature: GYAE6OF01EKCNX.40.2.A02.1.454.CMB.1.raw
  modified_base (214)..(214): a, c, t, g, unknown or other
  misc_feature (214)..(214): n is a, c, g, or t
  modified_base (298)..(298): a, c, t, g, unknown or other
  misc_feature (298)..(298): n is a, c, g, or t
  modified_base (349)..(349): a, c, t, g, unknown or other
  misc_feature (349)..(349): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccggnaagtcagggcattggaaatgatttagcctggtatcagcagaaaccaggaaaaagcccctcagctcctgatctatactgcatccnctttacaaagtggagtcccatcaaggttcagcggcagtgatctggcacagnttcactctcacatcagcagcctgcagcctgaagtattttgctaacttattactgtactacaagtacttacaacttaccctcggtactttcggccgtacggggacctggctggagactacaaacgtaactgtggctacg

SEQ ID NO: 255879 - DNA, 524 bp, Homo sapiens
  misc_feature: GYAE6OF01EFLL7.40.2.A02.1.454.CMB.1.raw
  modified_base (341)..(341): a, c, t, g, unknown or other
  misc_feature (341)..(341): n is a, c, g, or t
tcagtctagcgactcacgaccggtgctcgatttagactcatctacagggggagtcagacccactcaggacacagcatggacatgagggtccccgctcagctcctggggctcctgctgctctggctcccagacgccagatgtgccatccagatgacccagtctccatcctcactgtctgcatctgtaggagacagagtcaccatcacttgccgggcaagtcaggcattggaaatgatttagcctggtatcagcaagaaaccaggaaaacgcccctcagctcctgatctatactgcatccaactttacaagtgacgtccatcaaggtcagcggcagtgatcgnggcacagtattcactctcacatcagcagcctgcagctagaagtatttgactaacttattactgtactacaagtacttactaacttacccgtaggttaccttttacgggacccgtaacgggggtaccttgggtccgttagggtaacgtaacgtaaccgtaaaacgtacgttggtacggtctacg

SEQ ID NO: 255880 - DNA, 627 bp, Homo sapiens
  misc_feature: GYAE6OF01CTIDJ.40.2.A02.1.454.CMB.1.raw
  modified_base (299)..(299): a, c, t, g, unknown or other
  misc_feature (299)..(299): n is a, c, g, or t
  modified_base (384)..(384): a, c, t, g, unknown or other
  misc_feature (384)..(384): n is a, c, g, or t
tcagtctagcgactcacgaccggtgctcgatttagactcatctacagggggagtcagacccactcaggacacagcatggacatgacgggtccccgctcagctcctggggctcctgctgctctggctcccaggcgccagatgtgccatccagatcgacccagtctccatcctcactgtctgctatcgtggtaggagacaggactcacctatcacgttcggccggacaagtcgagggactaagttaggaatgtattagcctaggtactcgagacaacgaaaccgaaggaaaccgcccctanacgcctcgtagtactactactactcgactactacctaactttaacgaaggtcggtaactaccagtaccgtaaggttcaggtcggngtaggtcgtacgtcgtaggactaagtagttacttacactctacctacatacgacgaccgtacgcctagacctacgtacgtaagtaactttacgttacgaactttaacgttacttacgtacgttaactaaactaacttaaccttacttaacccgttaccgttacggttacgtttaccgggaccggttacgggtacgtcggacgtacggtacgtacgtaaccgaacgtacgtggtacgctaaccg

SEQ ID NO: 255881 - DNA, 610 bp, Homo sapiens
  misc_feature: GYAE6OF01A1QOU.40.2.A02.1.454.CMB.1.raw
  modified_base (276)..(276): a, c, t, g, unknown or other
  misc_feature (276)..(276): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcacatcacttcgccggcaagtcagggcagttggaatgtattagctggtatcagacaagaaaccaggaaaacgcccctanacgcctctgtactacctatactcgactactacctaactttacgaaagtcggactcccaatacgtaacggttcacggcggtcgagtaggattacgcggactaacgtagtactttacaccttctacctacctatacgacgacacgtcctgaccacgtaccgtagaacgtttcgtttacgtactaaactttacgttaccttgttaactaacgtaacgtaacttaacctaaccgtttacccgtacggtttaccgttttacgggaccggttaacggggtaccgttaggtccgtaggaacgttaactaaccgaaacgtaacgttggtacggacgtaccgg

SEQ ID NO: 255882 - DNA, 695 bp, Homo sapiens
  misc_feature: GYAE6OF01AQM6G.40.2.A02.1.454.CMB.1.raw
  modified_base (193)..(193): a, c, t, g, unknown or other
  misc_feature (193)..(193): n is a, c, g, or t
tcagtctagcgactcacgaccggtgctcgatttagactcatctacagggggagtcagacccactcaggacacagcatggacatgagggtccccgctcagctcctggggctcctgctgctctggcctcccaggcgccagatgtgccatccagatcgacccagtctccatccctcactgtctgcatctgtagganacagagtccaccatcacttcggccggtacaagtcgaggctagtaggaaatgtatttagccttggtactcgagacgaacgaaaccgaacggaaaacgccccctacgacgcctacctagactacctatactgacctaactaccctaactttaacgaaaggtacggtaacgttaccccaagttaccgtaaacggttccgaacggtccgggacgtacgggttacgggacttccggtacgggactaacgtaacgttacttttaccacccttacctaccacccgtaacttccgacgtaccgtacgtccctacggacctacggtacccgttaagtaacgttacgttttacgactttaaaccgttatttacccgtagttaacctaacgtaaattaaccttaaccgtaacctttacccgtacggttttaccttaccgggaccggtaacggggtcctagggtacgtaggtaacgtaacgtaaccgtaaaccgtaggttcggtcggtcgtacg

SEQ ID NO: 255883 - DNA, 612 bp, Homo sapiens
  misc_feature: GYAE6OF01BSBYJ.40.2.A02.1.454.CMB.1.raw
  modified_base (287)..(287): a, c, t, g, unknown or other
  misc_feature (287)..(287): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagatccaccatccacttcggccgggcaagtcaggggctagttggaaatgtatttagcctggtatcagacaagaaacccgaggaaaccgcccctanacgctccgtagtacttcctatactgactactacctaactttacgaaagtcgacgtccatacgaacgttcaggcggcaggtcgactcgtggactacgagttactttcgacttctacgacctagtcagccacgtcctgaccgacgtaccttaggtaagttacttttacgaccttaacttttacgttaccttacgtaacccttaagtaaacgtacctttaacgtaacctttcccgtacgggttaccgttttacggggacgtaaccggggtctacggggtctacgggaacgtacgttaaaccgaaacggtacgttggtccggtctacgg

SEQ ID NO: 255884 - DNA, 641 bp, Homo sapiens
  misc_feature: GYAE6OF01BUMB8.40.2.A02.1.454.CMB.1.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtcctgcatctgtagganacagagtccaccatcacgttcggccggnaaggtcagggctagttggaaatgtatttacgcgttaggtatcagacaagaaaccaaggtaaaaccgcccctagacggtctaccgtgaacttctactactgcacttaccaactttaacgaagtcggacgtcccctaataccgtaacggttcacggtcgtactaggtacggtactgtacggactaacgtacgttactttaccaccgttacctacctaacgtattacccgacgtacgacggtccctaggacctacggtacccgtaggtaacgtttacttttacggaccttaaccttttaacgttacgtacgttaacctaagtaaaccgttacttaacgtaacttcccggttacgttacgtttaccggaccggtagggtcccttaggccttagggacctacgtaccaacggtatggtcgtctacgg

SEQ ID NO: 255885 - DNA, 756 bp, Homo sapiens
  misc_feature: GYAE6OF01C5I8G.40.2.A02.1.454.CMB.1.raw
  modified_base (211)..(211): a, c, t, g, unknown or other
  misc_feature (211)..(211): n is a, c, g, or t
  modified_base (715)..(715): a, c, t, g, unknown or other
  misc_feature (715)..(715): n is a, c, g, or t
tcagtctagcgactcacgaccggtgctcgatttagactcatctacagggggagtcagacccactcaggacacagcatggacatggacgggtcccccgctcagctccgtggggctcctgctgctctggcctcccgaggcgccagatgtcgccatccgagatacgaccctagtcctccactccctctactgtctgctatcgtggtaggacganaagacgtccaacctatacctacggttcggaccgggtacaaggtcggagggtactagtaggtaatgtagttacgcgtaggtactacgagaacaacggaaaccgaaacggtaaacccgtccccacgacgtcctccgtataccgttacttactactacgtaccttaaccttacccgttaaacgtttaaccgtaaaggttccggtaacccttacccgtaaacgttacggtaacggtaccgaagggtacggtacgtagggtacgtacgtccggtacggtaaccgtaacgtaacgtttccttaccaacctttaccgaacccacttagaacccacgacgtaccgtcccgtagaccgtaaccggtcttaaagggtacttttaggttaacctaacgtttaaactttacgtaccttaaccgttaaacgtaaataacgttaaccttaacccgtaaaccgtttcccggtaccggtttaccggtacgggtacccggtaagggtcctaggtccggtanaaccggtactaaacgaaggttaccgttggaccgtctaaccg

SEQ ID NO: 255886 - DNA, 764 bp, Homo sapiens
  misc_feature: GYAE6OF01B6B39.40.2.A02.1.454.CMB.1.raw
  modified_base (539)..(539): a, c, t, g, unknown or other
  misc_feature (539)..(539): n is a, c, g, or t
tcagtctagcgactcacgaccggtgctcgatttagactcatctacagggggagtcagacccactcaggacacagcatggacatgagggtccccgctcagctcctggggctcctgctgctctggctccaggcgccagatgtgccatccagatcgacccagtctccatcctcactgtctgcatctggtaggagacagacgtcaccatcacgttcggccgggacaaggtcgagggctaagttaggaaattgtatttacgccgttaggtactcaagacaaacggaaaaccgaagggaaaaccgtccccctagacgtcctaccgtagtaacttctaacttaccgtcgacctaacttacccttaacttttaaaccgaaaggttccggaacgttacccctaagttacgtaacggtttccaacggtcggactagggtcgtactacgtacggactaacgtagttactttccaacttcccgtacaaccctactaccgaacggacctacggacccgtaggaccctacggtacccgttaggtaaacgtttnttttaacccgaacgttttaaactttacgtttacccgttagttaacccgtaaacttaacgttaaccttttaaacccgaaaccgtttttaccccggttacgggtttaccgttttaccggggaacccgggttaaccggggttacctcggggttaaccggttacggtaacgggttaaacccttaacccggtaaaaacggttgttaacgggtccggtaacgttaccccgg

SEQ ID NO: 255887 - DNA, 627 bp, Homo sapiens
  misc_feature: GYAE6OF01DEUTB.40.2.A02.1.454.CMB.1.raw
  modified_base (134)..(134): a, c, t, g, unknown or other
  misc_feature (134)..(134): n is a, c, g, or t
  modified_base (172)..(172): a, c, t, g, unknown or other
  misc_feature (172)..(172): n is a, c, g, or t
  modified_base (193)..(193): a, c, t, g, unknown or other
  misc_feature (193)..(193): n is a, c, g, or t
  modified_base (222)..(222): a, c, t, g, unknown or other
  misc_feature (222)..(222): n is a, c, g, or t
  modified_base (292)..(292): a, c, t, g, unknown or other
  misc_feature (292)..(292): n is a, c, g, or t
tcagtctagcgactcacgaccggtgctcgatttagactcatctacagggggagtcagacccactcaggacacagcatggacatggagggtccccgctcagctcctggggctcctgctgctctggctcccaggcnccagatgtgccatccagatcgacccagtctccatcctnactgtctgcatcgtgtagganacagacgtcaccatcacgttgaccgggtnaagtccgagggctagttggaaattgtatttagccgtggtaatcagacaagaaccaggtaaacgcccctanagccttccagactacgtatactgacctattacccaagttacaaaggtggaaccttccagttacaacgggttcacggtcggcaaggttcgactcgtggtaccagtaacgttactttcctactcccgttacaacccgtattacgagaccctggcccttaggactacgtaccgtaggttaaactttgtttacgaacctaatttacttactacgttaacctaaggttaatacctttaactaccggtttcctacggttaccgtttcgggaccggttaccggtaacggtcggtccgtaaggcttaaacgtaaccgtaaaggtacttgggaccgtggtaccc

SEQ ID NO: 255888 - DNA, 744 bp, Homo sapiens
  misc_feature: GYAE6OF01B8JT0.40.2.A02.1.454.CMB.1.raw
  modified_base (294)..(294): a, c, t, g, unknown or other
  misc_feature (294)..(294): n is a, c, g, or t
  modified_base (487)..(487): a, c, t, g, unknown or other
  misc_feature (487)..(487): n is a, c, g, or t
tcagtctagcgactcacgaccggtgctcgatttagactcatctacaggggggagtcagacccactcaggacacagcatggacatgagggtccccgctcagctcctggggctcctgctgctctggcctcccaggcgccagatgtgccatccagatgacccagtctccatccctcactgtctgcatctggtaggagacagacgtcaaccatctacgttcggccggacaagtcgaggctagttaggaatgtatttagccgttaggtatacagacaacggaaaaccgaaggaaacccncccctagacgtcctaccgtagtactacttaacgtactgacctaacgttaccctaaacgtttaacgaaaggtcggaaccgtacctaacgtacggttaaacgggttccacggggtccgtaacgtaagggtacggttactacggtacggacctaacggtatttaccctttacccactttcccaaccgtaaaccgtnaccggtaccgacctacgtcccgtaaggccgtaaccgttaccgtaagggtttaacctttattttaccggaaacctttaacgttttaagttacccgttagttaacctaaaacgttaacgttaaccttttaacccgtaaccggtttaccccgtttagggttacccgtttaccggggaacccgggttagggtaccccgttgggtactaacgggtaacgtaaccgtaaaccggtaacggttgtacgggtcggtcgtaacccg

SEQ ID NO: 255889 - DNA, 735 bp, Homo sapiens
  misc_feature: GYAE6OF01DJNZT.40.2.A02.1.454.CMB.1.raw
  modified_base (345)..(345): a, c, t, g, unknown or other
  misc_feature (345)..(345): n is a, c, g, or t
tcagtctagcgactcacgaccggtgctcgatttagactcatctacagggggagtcagacccactcaggacacagcatggacatgacgggtccccgctcagctccgtggggctcctgctgctctggcctcccaggccgccagatgtcgccatccagatcgacccagtcctccatccctcactgtctgctagtcgtaggaggacgacaggacgtaccaaccagttcctaccggttcgggaccgggactaacggtacggacggggtacttaaggttaagggaaaattggttaactttacgaccgttaggttactacgaacgacgaaacgaaaccgaaacggaaacccnccccgtacgaacgtcctaccgtagtaccttactaacgtactgtacctaacttacccgtaaagtttaacggaacggtcgtaacccgtacctaagttaccgtaaacggttccgacggtacgggtacgtaggtacgtacgtacgtacggactaacgtagttaccttaccgtactcctactaacctagtaccgacgtccagtcccgacgacgtaaccgtcgtaagttacggtttactttacgaacttaactttacgtaccttacgtaactaaacgtacttaactaaccgtacccgtttacggttaccgttacggttacgggaacccggtggtacccggtggtaccgtaggtaactaccgtaaaccggtaacgtagttcggtaggtcctaaccgg

SEQ ID NO: 255890 - DNA, 882 bp, Homo sapiens
  misc_feature: GYAE6OF01DZBEP.40.2.A02.1.454.CMB.1.raw
tcagtctagcgactcacgaccggtgctcgatttagactcatctacgagggggagtcagacccactcaggacacagcatggacatggacgggtccccgctcagcctccgtggggcctcctgctgctcgtggcctcccgaggccgccagatgtcgccatccgagactcgacccctagtcctacctactccctactacgttcgtctgctagtcgtaggtaggacgacgaagtacgtaccaacctacgtaccgtaccgttcgggacccgggtaacgtaacggtacggacgggtaccttaaggttaagggtaaattaggttaacgttttacggaccgttaggttaacgtacgaacggaaccaaaccggtaaaacccgaaacgggtaaaacccctccccgttacgaccggttacccttaccgtacgttaacttacctaacgtaccgtaccgtaccttaaaccgttacccttaaacgttaaccggaaaggttaccggtaacccttaacccgtagttaaccggtaacggttaccggacgggtacggtacggtacggttacggtacttcggtacgggaactcgttaacttccgttaccaacccgttccaaacctccgtaacgacgtccgacgtaccgccggtatccggaaccgttagttaaacgtagtttactttaccgtaaacttttaaccgttaccttacgttaaccgttaaccttaacgttaaacgttaacccgttttaacggttaaccccgttttaccccggttaggggtttaccccgtaaccggggggtaacccggttcgggtaaccggttcgaaacgggggttcctaaaacggtacccgttaaacggttaacccgggtggttcccggttaagccccgggtaaacc

SEQ ID NO: 255891 - DNA, 649 bp, Homo sapiens
  misc_feature: GYAE6OF01AUIJA.40.2.A02.1.454.CMB.1.raw
  modified_base (490)..(490): a, c, t, g, unknown or other
  misc_feature (490)..(490): n is a, c, g, or t
  modified_base (522)..(522): a, c, t, g, unknown or other
  misc_feature (522)..(522): n is a, c, g, or t
tcagtctagcgactcacgaccggtgctcgatttagactcatctacagggggagtcagacccactcaggacacagcatggacatgacgggtccccgctcagctccgtggggctcctgctgctctggcctcccaggcgccagatgtgccatccagatcgacccagtcctccatcctcactgtctgctatctggtaggagacagcgtaccaccatccacgttcggccggacaaggtcgaggggactagttaggaaagtgtaatttacgcgttaggtactacagacaaacgaaaccgaacggaaaccgtcccccagacgtcctcctagtactactactactcgaccttactacccttaactttaacggaacggttacggaccgtacctaagtaccgtaacggttacgacggccggtacgtaggtcgattccggtaggacacgtaacgttacttcgaccttaccactaactcgtacacgtacaccgtcgtgaccngtaccgtagtacttacgttacacttaactttntacctagttaacaagttaactactttaaccgaaccttccggtacggtttaccgttccgggaccggtagggtaccctagggtaccaagggtaataacccgtaacgaaacgttcgtaggccgtctaacg

SEQ ID NO: 255892 - DNA, 561 bp, Homo sapiens
  misc_feature: GYAE6OF01CCZGA.40.2.A02.1.454.CMB.1.raw
  modified_base (273)..(273): a, c, t, g, unknown or other
  misc_feature (273)..(273): n is a, c, g, or t
  modified_base (280)..(280): a, c, t, g, unknown or other
  misc_feature (280)..(280): n is a, c, g, or t
  modified_base (305)..(305): a, c, t, g, unknown or other
  misc_feature (305)..(305): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
  modified_base (417)..(417): a, c, t, g, unknown or other
  misc_feature (417)..(417): n is a, c, g, or t
  modified_base (443)..(443): a, c, t, g, unknown or other
  misc_feature (443)..(443): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttggccgggcaagtcagggcagttaggaaatgtattagcctggtatcagacaagaaaccaggaaacncccctanacgtcctacctgactactatacgtnactacttccaactttaacgaagtgacgtccatcgaaggtcagcgacagtgatcnggacanagtcttacactctacacctatcagcacgctgccacgtacctagtaacgtttntttacgaacttaactttattaccgtnttactaacaattacttaacctaacctttcccgtacggttaccgtttacggaccggtacgggtaccttagggcgttaggagtaaacttacggaaacgttacgtggttcggtcctaacgg

SEQ ID NO: 255893 - DNA, 811 bp, Homo sapiens
  misc_feature: GYAE6OF01C69L0.40.2.A02.1.454.CMB.1.raw
  modified_base (192)..(192): a, c, t, g, unknown or other
  misc_feature (192)..(192): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatcgacccagtcctccatcctcactgtctgcatctgtagganacagacgtcaccatccacgttcggccgggacaagtcgaggggctaagttaggaaatgtaatttagcctggtatacgagacaacgaaaccgaaggaaaaccgcccctacgacgtccttaccgtagtacttacttaattacgtacgacctaacttaccctaacgttttaaacgaaaggttaccggtaccgttacccctaagttaccggtaaacgggtttccgaacggtaccgggtactaaggggttacggtaacgttccggtacgggtacctaacgttacggttaacctttttacccgaacccttttacccctaaccgtaacccgtaacgttaccggaaccggtacccgtaaccggtcccgtacggtacccgtaaccggttaccgttaaggttaaacgtttacgttttaccgtaactttaaacctttaacgtttacgttaacgtttaaccgtaaacgttaaacttaaaccgtttacccgttaaaacccgtttacccccggtttaagggtttaccccgtttaggggaaccccgggttaacggggtacccgttacggggtaccggtaaggtaaccgtaaacgttaaaccggtaaacggttacgttcgggtcgtacgtacccgg

SEQ ID NO: 255894 - DNA, 640 bp, Homo sapiens
  misc_feature: GYAE6OF01AFFM3.40.2.A02.1.454.CMB.1.raw
  modified_base (633)..(633): a, c, t, g, unknown or other
  misc_feature (633)..(633): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttcggccgggacaaggtcgaggggactagttaggaaatgtaatttacgccgttggtactcagaccaaggaaacccgaaggaaaaccgtccccctacgacgcctacctgtacttactactactcgcctactaccctaactttaccgaaaggtcggacgttacccagtactaaggttcacggcggtataggtacgtacgtcgtcggacctagtacgtactttcactctaccacctatccgacgccagtcccgtgaccacgtaccgtaggtaactttacgtttacgactttaacgtttattaccgttagtacctaaactaagttaacttaacctaaccgttcccgtacgttaccgtttagggccccggtaggggtacccttagggacgttacgggaactaacgtaaccgtaaacggtacgttgtccggtntacccgg

SEQ ID NO: 255895 - DNA, 808 bp, Homo sapiens
  misc_feature: GYAE6OF01DOMFD.40.2.A02.1.454.CMB.1.raw
  modified_base (274)..(274): a, c, t, g, unknown or other
  misc_feature (274)..(274): n is a, c, g, or t
  modified_base (790)..(790): a, c, t, g, unknown or other
  misc_feature (790)..(790): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatcgacccagtcctccatcctcactgtctgcatcgtgtaggagtacagagtcaccatcacgttggaccgggacaagtccgagggcaagtttaggaaattgtaactttaggcccttaggttaacncgaggaccaaacggaaaacccgaaggggaaaaaccctccccccgttagaacggtcccttacccgtaggtaacttaccgttaaattacctacggtacctaactttaccccgtaaaacttttaacgaaaacggttcgggaacccttacccgaaagtttaaccgaaacggtttaccgaaacggtccgggtaacgtaacggtacgggtaactttaccggtaagggtaaccctaaacggttaaggttaccctttttacccggaaaccgtttccccttaacccgaaaccctaaacgttaccgaaacggttacccgaaaccggtcccgttaacggaaccctaacggtaccccgttaaaggttaacggttttaacttttaccggaacttttaaacgtttacttacgtacgttaacctaacgtaacgtaactttacccgtaaacgttacccgttacggttacgtttacggaccggtaacgggtaccctaggacggttacgactaaacgtaacccgtaaaaggttntcgggtcgtcgtaacccg

SEQ ID NO: 255896 - DNA, 638 bp, Homo sapiens
  misc_feature: GYAE6OF01DGWRC.40.2.A02.1.454.CMB.1.raw
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
  modified_base (358)..(358): a, c, t, g, unknown or other
  misc_feature (358)..(358): n is a, c, g, or t
  modified_base (369)..(369): a, c, t, g, unknown or other
  misc_feature (369)..(369): n is a, c, g, or t
tcagtctagcgactcacgaccggtgctcgatttagactcatctacagggggagtcagacccactcaggacacagcatggacatgagggtccccgctcagctcctggggctcctgctgctctggctccaggcgccagatgtaccatccagatgacccagtctccatccctcactgtctgctatcgtgtaggagacagacgtccacatcacttcgccggcaagtcgaggctagtagaaatgatttacgcctggtatcagcaacgaaaccgaggaaaccnccctanacgtctcctagactctatacgtcgactatacctactttaacgaagtcggactcctagtacgaagttcgacgcganacggtgatcgnggactactagtactttcactcgtacgaccattccgagacctaacgtccctagacctacggtcccgtagtaaggtttacttttacgaccgttaaactttagttacctacggttactaaacgtaacgttactttaaccgtaccgttttaacccggttccgggttaaaccttttcgggacccgttaacgggggtacccttaggggtaccgttaggggaaaccttaacgtacccggtaaaacgttaacggtggttaccggctcggtaaccccg

SEQ ID NO: 255897 - DNA, 635 bp, Homo sapiens
  misc_feature: GYAE6OF01EUI2W.40.2.A02.1.454.CMB.1.raw
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttggccggcaagtcgagggcagttaggaaatgtaattttacgccgttaggtatacagacaacgaaaaccgaaggaaaaccgccccctacgacgtcctacctagtaactacctaatacctgacctactaccctaactttaacgaaaggtcggtaacgtacccaagtacgtaaggttcaggcggacgtaggtacgacttcgtaggactacgtaagttctttccacttcctacaaccctataccgagccaacgtcctgacacgtacctagtaaagtttctttacgacttaactttattactagttaacctaaactaagttaacttaacctaaccgtttacccgttacggttaccgtttacgggacccggtacggggtacccttgggacgttaggaactaacctaacgaaaaccgtacgttggtcgtcgtacg

SEQ ID NO: 255898 - DNA, 699 bp, Homo sapiens
  misc_feature: GYAE6OF01D3JV1.40.2.A02.1.454.CMB.1.raw
  modified_base (312)..(312): a, c, t, g, unknown or other
  misc_feature (312)..(312): n is a, c, g, or t
  modified_base (346)..(346): a, c, t, g, unknown or other
  misc_feature (346)..(346): n is a, c, g, or t
  modified_base (505)..(505): a, c, t, g, unknown or other
  misc_feature (505)..(505): n is a, c, g, or t
  modified_base (692)..(692): a, c, t, g, unknown or other
  misc_feature (692)..(692): n is a, c, g, or t
tcagtctagcgactcacgaccggtgctcgatttagactcatctacagggggagtcagacccactcaggacacagcatggacatggagggtccccgctcagctcctggggctcctgctgctctggcctcccgaggccgccagatgtgccatccagatcgacccagtcctccatccctcactgtctgctatctaggtaggagacagacgtccacctatcctacgttcgggccgggactaacggtcgagggactaagttaggaattgtatttacgcctggtactcgaacgacaacgaaaaccgaacggaaaaccncccctagacgtcctctagtactactactaccgtnacctaactaccctaacgttttaacgaacggttcggtaaccgtaccgtaactacggtaacggttcgacggccggtacgtagggtcggtacttcggtacggaccaacgtagtaccttttaccaccttccacctaaccctactccgaacgtaccacgtcccngtaccctagtaccgttagtaacgtttactttacgtacttaacgttttaacttacgtacgttactaacgtaaagtttaaccttacctttaaacccgtttccggttacgtttaccggtttaccgggaccgggtacggggtacttagggtcgtaacgggtactaacgtaacgaaacggtgtacggtccgngtacccg

SEQ ID NO: 255899 - DNA, 687 bp, Homo sapiens
  misc_feature: GYAE6OF01EGNUI.40.2.A02.1.454.CMB.1.raw
  modified_base (218)..(218): a, c, t, g, unknown or other
  misc_feature (218)..(218): n is a, c, g, or t
tcagtctagcgactcacgaccggtgctcgatttagactcatctacaggggggagtcagacccactcaggacacagcatggacatgagggtcccccgctcagctcctggggctcctgctgctctggctcccaggcgccagatgtgccatccagatgacccagtctccatcctcactgtctgcatctgtaggagacagatcaccatcacttcggccgggnaagtcgaggctattaggaatgtatttagcctggtatcgagaccaagaaaaccgaaggaaaaccgcccctacgagtcctacctagactactaatactcgactactaccctaactttaacaaacggtcggtactaccccaattaccgtaaacggttcacggcggactaagggttcggaattccgtagggtaccaaccgtaagtttacctttacctaacctacctaccaaaccctattacccgaagacctacggcctacgacgacgtaccttaaggtaatttacttttcgaactttaaccgtttacttacgttacgttaacctaaaccgttaaagttaaccttaacctaaccgtttaccccgttacgggtttaccggttttacccgggaccgggtaaaccggggtcccgttagggaccgttaaggacgtaaacgtacccgaaaaacggttacgttacgggcggtctacccgg

SEQ ID NO: 255900 - DNA, 820 bp, Homo sapiens
  misc_feature: GYAE6OF01AZE1C.40.2.A02.1.454.CMB.1.raw
tcagtctagcgactcacgaccggtgctcgatttagactcatctacagggggagtcagacccactcaggacacagcatggacatgagggtccccgctcagctcctggggctcctgctgctctggcctcccgaggccgccagatgtgccatccagactcgaccctagtcctaccactccctcacgttcgtctgctattcgtaggtaggagacagacgtccacctatccgtacgttcggaccgggactaaggtcgaacgggtctaagttaggaaacttgtaacgtttacgtccgttagttacacgacgaacgaaacggtaaaaccgaacgggaaaacccgtccccctagacccgtaccgttaccgtagtaccttacttacgttacgtcgtaacctaacttacccttaaccgttttaacggaacggttcggtaaccgttacctaacgtaccgtaacgggttacacggtcggtacgtaggtacggtactcgtacggactaacggttacgtactttcccgtaactcccgtaaccaaccttacgtaccgtacgtacccgtaccggaccttacgggtccctaaccggtacggttacgtttaacgtttaacgtttacttaacgtttaacctttaagttcccgttaacgtaacgttaaacgtaacgttaaaccttaacccgtttaacgttaaccccggttaacgggtttcccggttaacgggaaccccgggtttacggggtacccggttacgggttacggaaacggggttaaccttaaaccggtaaccgttaaacccgggtattaccggggtacgtccgttaaaccccgg

SEQ ID NO: 255901 - DNA, 1140 bp, Homo sapiens
  misc_feature: GYAE6OF01EDP4C.40.2.A02.1.454.CMB.1.raw
  modified_base (176)..(176): a, c, t, g, unknown or other
  misc_feature (176)..(176): n is a, c, g, or t
tcagtctagcgactcacgaccggtgctcgatttagactcatctacagggggagtcagacccactcaggacacagcatggacatggacgggtccccgctcagctccgtggggcctcctgctgctcgtcggcctccgaggcgccagattgtcgccatccagactcgaccctagttccncctacttcctactacgttcgtctcgactacgtcgtaggtaggacgaacgagtacgttaccaccgtacttaccgtaccggtccggaccgggacgtaacggtacgggacggggtacttaaggttaacggtaaattcggttaacgtttacggtccggttaaggttactaccggaaagtaccgaaaaccggaaaacccggtaacgggtaaacccctccccgttaaggaccgttaccctttaccgagttacctttaaccgtttacgtacgttacgtaccttaaccttaacccgtttaaagtttaaaccggtaacgggttaccggtaacccttacccgtaacgggttaaccgggtaacgggtttaccggaaacggggtacccgtacggttaaacggggtttaccgggtaacccggttttcggaaacccggttaaccgttaaaccggggttttactttttaaaccccttaccccgggttaaaaccccttttccccggaaccccgttttaaaccggtaaacccggtaccgaaaccggggttccccgtaaaaccccggggttccgtttaaccggggaaccccggttttaaacccggttaacgggttttaaacggttttaaccgtttttttaaccggtttaaaccccttaaccggttttttaaaacgttttttaaacccgggtttacccggttaaccttttaaaaaccccggttaaaacgttttaaaacccgtttaaaccccgttttttaaaaccccgggttaaacccccgggtttttttaccccggggttaaacccgggtttttttaacccggggaaccccgggggttttaacccgggggaaaacccggggttttacccgtttaacggggggtaaaccggttaacccggggttaaaacttaaaccccgggtttaaaccggggaaaaacgggtttccgggggtttacggtacccggttaaacccgtttaccccg

SEQ ID NO: 255902 - DNA, 772 bp, Homo sapiens
  misc_feature: GYAE6OF01DEDJA.40.2.A02.1.454.CMB.1.raw
  modified_base (290)..(290): a, c, t, g, unknown or other
  misc_feature (290)..(290): n is a, c, g, or t
  modified_base (325)..(325): a, c, t, g, unknown or other
  misc_feature (325)..(325): n is a, c, g, or t
  modified_base (352)..(352): a, c, t, g, unknown or other
  misc_feature (352)..(352): n is a, c, g, or t
  modified_base (516)..(516): a, c, t, g, unknown or other
  misc_feature (516)..(516): n is a, c, g, or t
tcagtctagcgactcacgaccggtgctcgatttagactcatctacagggggagtcagacccactcaggacacagcatggacatgagggtccccgctcagctccgtggggctcctgctgctctggcctcccgaggcgcctagatgtcgccatccgagactcgaccctagtcctccatccctctacgtgtctgctattcgtaggaggagacaggactccaacctatccgtaccgttcgggaccggactaacggtcggagggtctaagttaggaatgttattacgcgtagtancaggtaacaaacggaaacaacggaaacctccctanacgtccgtactagtacttactagtctnaaccttaacgttacccttaaaattaacgggaagtacgtaacccacgttaactaaggtacgggttcgaagtccggaattacggtggtactcggttaacggacacgttacgttaacttcccaccttaaccaccgtacttacgactaacgtccgaaccccgttcganacccggttacgtacgtttaggtttaacgtttactttaaccgttaacctttaacttttaacggttccgtaaactaccttaaagtaaccctttaagtttaccccgtaaacccgttttcccggtttaaacgggtttaccgggtacccgggtaaacgggtcccgggtaacggttaggggttaaccggtaaacggtttaaaccgaaccggttaaaaaccccggtacgggttttagacccgggttaccgttccggaaacccg

SEQ ID NO: 255903 - DNA, 834 bp, Homo sapiens
  misc_feature: GYAE6OF01DNWU8.40.2.A02.1.454.CMB.1.raw
tcagtctagcgactcacgaccggtgctcgatttagactcatctacagggggagtcagacccactcaggacacagcatggacatgagggtccccgctcagctccgtggggctcctgctgctctggcctcccgaggcgccagatgtgccatccagatcgacccagtcctccatcctcacttgtctgcattcgtaggtaaggagacagacgtccacctatccgtaccgtcggacccgggtacaaggtcgaggggtactaagttaggaaattagtagtttacgccgttaggtactacgaacgacgtaaacggaaaaccgaacggaaaacccgtcccctagacgtcctacctagtactcttaagtacctcgtacctacgttaacccttaagtttaaacgaaggttaccggtaccgtaacccgtaagtttaaccggaacggtttccgaacgggtcccggtacgtaggttacggtaacttccggtagggaacctacgttagttacctttcgacccttaccgtaccaaaccgtagttaaccgaacgtaccgtaccggtacctagggtacccgaacgtttaccgttaagttaaacgttttacgtttaacgtaaaccttttaaaccgttttacgtttaacgttaccgttaaaccgtaacgttaaaccgtttaaaccgtttacccgtttaaaccccgtttacccgggttttaacggtttaccgttacccggggggtaaccccgtttaacgggggtacccggtttgggtaacccgtagggttaaacccgttaaaccgtaaaccggttaaacccggttaggtttccgggtaaccgtcgttaaacccg

SEQ ID NO: 255904 - DNA, 895 bp, Homo sapiens
  misc_feature: GYAE6OF01BDNTK.40.2.A02.1.454.CMB.1.raw
tcagtctagcgactcacgaccggtgctcgatttagactcatctacagggggagtcagacccactcaggacacagcatggacatgagggtccccgctcagctcctggggctcctgctgctctggctcccgaggcgccagtatgtcgccatccagatcgacccagttcctccactcctctacgttgtcgtgactacgttccgtaggttaggaacgaacgaaggtacgttaccctaacctaactaccgtacgttcgggaccgggtaacgaaacggttccggacggggtacgtaagtttaagggaaacttggttaacgttttaccggaccggttaggtttaacaccgtaacggaaaccgtaaaaccggaaaacccggaaaacgggtaaaaccccgtccccccgtaacgaaccggttaccctaccgttaacggtacgttacccttaacgtaaccgtcgtaaccctaacggtttaaccccttaacgtttaaaccgtaacggttacggaaccgttaccccgtaagttaacgggttaacgtaccggaggtacccggtagtaagggttcgtaccgtacggtacggtacctaacgttaacgttaccgttaccttacgtaccttaacccgtaacgtacctaccggtaagacccgtaacgtccgtacgacgtaaccgtacggtagttaacgtttacgttaacgtaacgttaactttaacgttaacgttaccgttaacgtaacgtttaaaccgtttaacgttacgttaaccccgttaccggttaccgggttaaccggttttaccgggaaccgggttaccgggtaacgttcggggttaccgggtaagttaaaccgggtaacgttaaaccgtaacccggttaggttcggtaacccggtcgttaaccccgg

SEQ ID NO: 255905 - DNA, 706 bp, Homo sapiens
  misc_feature: GYAE6OF01ETMGD.40.2.A02.1.454.CMB.1.raw
  modified_base (160)..(160): a, c, t, g, unknown or other
  misc_feature (160)..(160): n is a, c, g, or t
  modified_base (203)..(203): a, c, t, g, unknown or other
  misc_feature (203)..(203): n is a, c, g, or t
tcagtctagcgactcacgaccggtgctcgatttagactcatctacagggggagtcagacccactcaggacacagcatggacatgagggtccccgctcagctccgtggggctcctgctgctctggctcccaggcgccagatgtgccatccagatcgacccngtcctccactccctcacttgtctgcatctggtaggagacgagntaccacctatcctacgttcggccggacgaacgtcgaggtctagttagaatgtattagcctggtatcgagacaacgaaacgaaggaaaccgcccctacgacgtcctcctgtactcgtactactgctacttacctaacgtttaacgaaaggttcggtaccgtaccctacgtacgtaacggttacgacggcggacgtaggttacggacgttcgtcggactacgtagttacttacccacctcctaccaacctactaccgaggtaccctcggacccgtggacctaccgttacgaacggtttaactttacgtttttacgaaccttttaaacgtttactttacccgttagttaacctaacgttaaaacgtttactaaacccgtttaaccgttaccccggttaaccgggttttcccgttaaccgggtacgggtaccggggttacgtacgggggtcctaacggtaacgtaaccctaacgggtaaaacccgtgtttcgggtagtcccgtaacg

SEQ ID NO: 255906 - DNA, 859 bp, Homo sapiens
  misc_feature: GYAE6OF01E5GPE.40.2.A02.1.454.CMB.1.raw
  modified_base (133)..(133): a, c, t, g, unknown or other
  misc_feature (133)..(133): n is a, c, g, or t
tcagtctagcgactcacgaccggtgctcgatttagactcatctacagggggagtcagacccactcaggacacagcatggacatgagggtccccgctcacgctcctggggctcctgctgctctgctccaggccncagatcgtgccatcagatacgaccagtactcactacctcactcgtctgctacttcgtagtaacggagaacagtacgtccaaccgatctacgttcgacccggggtacaaacggtcgacggggtactaaggttacggaaaagtttgtaacgtttttacgaccggttaacggttactaacgtaacggaccgaaaacggtaaaaccggaaaacggtaaaaccgtacccccgtacgaccgtaccgtacgttacgtacttaacttaacgtacgtacgttaactaacttacccctttaaacgtttaaaccgtaaacggttacgggtaacgtaacccgttaacttaacggggttaaacccggtttacaacccgggtaccgggtaacgtacggtaacggggttaccgttacgtccgggtaactaaccggttaacgtttacctttaccggtaccttacctaccgtaacctaacggtaaccgtaacgtccggttaacgtacccgtacggtactaacccggtacgtacggttaaacggtttacttttaaccgaacgtttaaaccttttaattaaccggttacgttacttaaacggtaacttaaccgttaacgtttaaccctacccggtttcgtaaccgttttacggggaaccgttacgggtacccgggttaacgggtcgttaacgggaacttaaacggtaacgtaaacggttaacggtcggtaaccggtccgtaacgg

SEQ ID NO: 255907 - DNA, 482 bp, Homo sapiens
  misc_feature: GYAE6OF02I2F5I.40.2.A02.1.454.CMB.1.raw
  modified_base (461)..(461): a, c, t, g, unknown or other
  misc_feature (461)..(461): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcagaaaccaggaaaagcccctcagctcctgatctatactgcatccactttacaaagtgagtcccatcaagttcagcggcagtggatctggcacagatttcactctcaccatcagcagcctgcagcctgaagtattttgactaactttattactgtctaacaagtattacaattaccctcgtacttttggcctaggggacctggctgganatacaaacgactgtcgctacg

SEQ ID NO: 255908 - DNA, 582 bp, Homo sapiens
  misc_feature: GYAE6OF02I62CQ.40.2.A02.1.454.CMB.1.raw
  modified_base (279)..(279): a, c, t, g, unknown or other
  misc_feature (279)..(279): n is a, c, g, or t
  modified_base (343)..(343): a, c, t, g, unknown or other
  misc_feature (343)..(343): n is a, c, g, or t
tcagtctagcgactcacgaccggtgctcgatttagactcatctacaggggagtcagacccactcaggacacagcatggacatgagggtccccgctcagctcctggggctcctgctgctctggctcccaggcgccagatcggtgccgataccgagactagacccagtctccatcctcactgtctgcatctgtaggagacagagtcaccatcacttgccggcaagtcagggcattggaaatgatttagcctggtatcagcagaaccaggaaaagcccctanagctcctgactctatactgcactcctactttaacgaagtcggactcccatacaagttcagcganagtgatcgtggacacagtactttcacttctaccaccatcgagcacgcctcgcacgtaccgtacgtaacgttacgtttacgtactaacttactttacttacgttacttaacgtaaacgtaacgttaaaccttaaaccttaacccgttaccggttaccgtttacggtaccggtacgggtaccggttacggtacgtacggtacgtacgtacgtaaaccgtaacgtacggtacggtacgtacg

SEQ ID NO: 255909 - DNA, 501 bp, Homo sapiens
  misc_feature: GYAE6OF02FQII8.40.2.A02.1.454.CMB.1.raw
  modified_base (274)..(274): a, c, t, g, unknown or other
  misc_feature (274)..(274): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcagaaaccaggaaaagcccctnagctcctgatctatactgcatccatttacaaagtgagtcccatcaaggttcagcggcagtggatctggcacagtatttcactctcaccatcagcagcctgcagcctagaatattttgactaacttattactgtactaacaagtaacttaactaattaccctcggttacttttggccgtaggggtacctgggcttggaagactacgaaacgtactggtacggtctacg

SEQ ID NO: 255910 - DNA, 516 bp, Homo sapiens
  misc_feature: GYAE6OF02HL7CF.40.2.A02.1.454.CMB.1.raw
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcagaaaccaggaaaacncccctnagctcctgatctatactgcatccactttacaaagtggatcccatcaaggttcagcggcagtggatcgtggcacagtatttcactctcaccatcagcagcctgcagcctagaagtatttgactaactttattactgtactactaagtacttaacaacttaccctcggtacttttcgggaccgtaacggggtaccttggtcgttaggacgtactaccgaaacgtaacgtggtacggtctacgg

SEQ ID NO: 255911 - DNA, 630 bp, Homo sapiens
  misc_feature: GYAE6OF02GRHGT.40.2.A02.1.454.CMB.1.raw
  modified_base (357)..(357): a, c, t, g, unknown or other
  misc_feature (357)..(357): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcgagggcattggaaatgtatttagctggtatcagacaagaaaccaaggaaaacgcccctacacgcctaccgtgatctatactgctactcctaactttaacaagtggacgtccatcaaggttcagcggacagtgatcgnggcacgagtactttcactctacacatcagcacgcctgacacgtccgtagtaacgtttacgttttacgaactttaaaccttttacgtttaccgttacgtttaacctaaaccgttaaagttaaaccttttaaaccgttaaaccgttttaaccccgttacgggtttaccgtttttaccggggaacccggtaacgggggttaccctacggggtaccgtagggtaacgtaacgttaaccggtaaaacggttaccgttagggttaccggacgttaccgg

SEQ ID NO: 255912 - DNA, 534 bp, Homo sapiens
  misc_feature: GYAE6OF02F149F.40.2.A02.1.454.CMB.1.raw
  modified_base (276)..(276): a, c, t, g, unknown or other
  misc_feature (276)..(276): n is a, c, g, or t
  modified_base (344)..(344): a, c, t, g, unknown or other
  misc_feature (344)..(344): n is a, c, g, or t
  modified_base (391)..(391): a, c, t, g, unknown or other
  misc_feature (391)..(391): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcaagaaaccaggaaaacgcccctnagctcctgatctatactgcatccatttacaaagtgatcccatcaagttcagcggcagtgatctggcanagtactttcactctcaccatcacgcagcctgccagtcctagaagttnttttacgacttaactttattacgtagttactaactaacgtaattaacgaactttacccgtacgttacttttacggaccgtaaggggtaccttagggtccgttaggaacgtactacgtaaaccgtacgtcggtacggacgtacg

SEQ ID NO: 255913 - DNA, 509 bp, Homo sapiens
  misc_feature: GYAE6OF02GHBSG.40.2.A02.1.454.CMB.1.raw
  modified_base (274)..(274): a, c, t, g, unknown or other
  misc_feature (274)..(274): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcagaaaccaggaaaacgccctnagctcctgatctatactgcatccactttaacaaagtggactccatcaaggttcagcggcagtgatctggacacagtatttcactctcacatcagcagcctgcagcctagaattatttgactaacttattactgttactaactaagtacttaaaccaactttaccctcgttacgtttcggaccgtagggtacctcggacgtacggaagtactacgaaacgtacgtaggtcgctacg

SEQ ID NO: 255914 - DNA, 516 bp, Homo sapiens
  misc_feature: GYAE6OF02HFK9A.40.2.A02.1.454.CMB.1.raw
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccggcaagtcagggcattggaaatgatttagcctggtatcagcagaaaccaggaaaacgcccctcagctcctgatctatactgcatccactttacaaagtgatcccatcaaggttcagcgcagtgatctggcacagtatttcactctcaccatcagcagcctgcagcctgaatatttcgactaacttattactgtactactaagtaacttaactaacttacccgtacggtacttttcggaccgtaaggggtaccctgggtcgttacggaagtacgtacgtaaacgtacgtacggtacggtactacgg

SEQ ID NO: 255915 - DNA, 577 bp, Homo sapiens
  misc_feature: GYAE6OF02IJWVP.40.2.A02.1.454.CMB.1.raw
  modified_base (151)..(151): a, c, t, g, unknown or other
  misc_feature (151)..(151): n is a, c, g, or t
  modified_base (158)..(158): a, c, t, g, unknown or other
  misc_feature (158)..(158): n is a, c, g, or t
  modified_base (188)..(188): a, c, t, g, unknown or other
  misc_feature (188)..(188): n is a, c, g, or t
  modified_base (216)..(216): a, c, t, g, unknown or other
  misc_feature (216)..(216): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (356)..(356): a, c, t, g, unknown or other
  misc_feature (356)..(356): n is a, c, g, or t
  modified_base (370)..(370): a, c, t, g, unknown or other
  misc_feature (370)..(370): n is a, c, g, or t
  modified_base (401)..(401): a, c, t, g, unknown or other
  misc_feature (401)..(401): n is a, c, g, or t
  modified_base (521)..(521): a, c, t, g, unknown or other
  misc_feature (521)..(521): n is a, c, g, or t
  modified_base (532)..(532): a, c, t, g, unknown or other
  misc_feature (532)..(532): n is a, c, g, or t
  modified_base (541)..(541): a, c, t, g, unknown or other
  misc_feature (541)..(541): n is a, c, g, or t
  modified_base (550)..(550): a, c, t, g, unknown or other
  misc_feature (550)..(550): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagntgacccngtctccatcctcactgtctgacatctgagngacagtagtcaacatcacgttgccgggnaagtcaagggcagttggaaatgtagtttagcctggtactcgaagcagaaccaggaaacnccctanagcctcngatactatactgctaactccaagtttacaaaggcgtactcccgtatactaaggtctacgacggctagnggtactcgtcgganacgtaagtactttacactcgttacaaacccnttacgaacgcaacggtcctcggcctaacgccgttagtaacgtatttcgacttaaaccttattcgtagtactaaccgaagttacttaaactacgttaaccttccgggtattttacccgggnaaccggggttntaccgggtntacgggtanacgtacaagtaacctgtcggtatccgg

SEQ ID NO: 255916 - DNA, 615 bp, Homo sapiens
  misc_feature: GYAE6OF02FP4QC.40.2.A02.1.454.CMB.1.raw
tcagtctagcgactcacgaccggtgctcgatttagactcatctacagggggagtcagacccactcaggacacagcatggacatgagggtccccgctcagctccgtggggctcctggcgtgctctggctcccacggcgccagatgtgccatccagatgacccagtctccatcctcactgtctgcatctgtaggagacagagtcaccatcacttgccggcaagtcagggcagttggaaatgtatttagctggtatcgagacaagaaaccgaggaaaaccgcccctacacgtctaccgtgtactactatacgtgacctataccctaacttttaacaaaaggttcggaacgttccctaagtacgtaaacggttcaaggcggacgtaaggtcggtattcggtggacctaacggtactactttaccactctacaaccctatacctagcctacggcctcgacgactccgtagtaagtcttttagacttaacctttagttacctagttacctaacgtaaacttaacttaacctaaccgtttacccgagttacgtttccgggaccgtagggtacccgtcggtacgtacggtaacgacttaacgaacgtaactggtcgtacgtcc

SEQ ID NO: 255917 - DNA, 814 bp, Homo sapiens
  misc_feature: GYAE6OF02HXO7R.40.2.A02.1.454.CMB.1.raw
  modified_base (294)..(294): a, c, t, g, unknown or other
  misc_feature (294)..(294): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtccaccatcacgttcgccgggacaaggtcaggggcagtttggaaaattgtaatttagccgttggtatcagcaagaaaccgaaggaaaacgccccctanacgtcctaccgtagacttctatacctgactacttacctaactttaaccgaaaggttcggaaacgttccccaagttaccgtaaacgggtttcgaacggtccgggtaacgtaacgggtacgggtaaacgttcggttacgggacctaaaccgtaaggttaacttttacccgacctttccttaaccaaccctagtaaccgacgtccgaacggtccctacggaccgtaccgaccgtttaggaaacgttttacttttaccgggaactttaaacccgttttaacgtttaacccggtttacgttaaacccgtttaaaccgtaaaacggtttaaaccgttttaaaaccttaaaacccgtttttaacccccggttaccggttttaacccggtttttttacccggggaacccggttaaccgggggttaaccccgtttcggggtaaccgggttacgggtaaacgggttaaccttaaaccccggtaaaacggttaacccggttttagggtaccggggttacccttaacccggg

SEQ ID NO: 255918 - DNA, 710 bp, Homo sapiens
  misc_feature: GYAE6OF02F0GYF.40.2.A02.1.454.CMB.1.raw
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
tcagtctagcgactcacgaccggtgctcgatttagactcatctacaagggggaagtcagacccgactcaggactacagcatggaacgaagtgagggtccccgctcagcttcccgtcgggcctcctgctgctctggctccgaggcgccagatgtgccatccagatgacccagtctccatcctcactgtctgcatctggtaggagacagagtcaccatccacttggccgggcaagtcgagggctagttaggaaatgtatttagcctggtatcagacaagaaaccaaggaaaaccncccctanacgcctcctgatctatactcgactacttacctaactttaacgaaaggtacggtacgttaccccaattaacgtaaacggtttccgaacggtcggactaagggttcggtattaccggtaggaccaagtacgtttacttttacccaacctttccctaccaaacccgtactaccaaggtccaaccgtcccgttagcctacggtacccttaagggaacttttacgttttacgaacctttaacttttaactttaccgttacgttaacttaaccttaagtaacctttaaacgtaaccttttaccccgtaggttttacccgtttacgggacccggtacggggttacccttacggggtaacgttacggtaacgtaacgtaaccggtaaaccgttacggtcggttaccgggacttaccgg

SEQ ID NO: 255919 - DNA, 676 bp, Homo sapiens
  misc_feature: GYAE6OF02IGA8O.40.2.A02.1.454.CMB.1.raw
  modified_base (188)..(188): a, c, t, g, unknown or other
  misc_feature (188)..(188): n is a, c, g, or t
  modified_base (328)..(328): a, c, t, g, unknown or other
  misc_feature (328)..(328): n is a, c, g, or t
  modified_base (661)..(661): a, c, t, g, unknown or other
  misc_feature (661)..(661): n is a, c, g, or t
tcagtctagcgactcacgaccggtgctcgatttagactcatctacaggggagtcagacccactcaggacacagcatggacatgaggtcccgctcagctcctgggctcctgctgctctggctcccaggcgccagatgtgccatccagatcgacccagtcctccatcctcactgtctgcatctgtagganacagagtcacctatcacttcggaccgggctaacggtcgacggggactaagtttcggaaaattgtaagttttaacgccgtttaggtactccagaacctaacgaaaaccgaacggtaaaacgccccctaacgagccttaccngacttacgtacttacctgactaacttccctaacttttaacaaacggttacgaaccgttccctaaatacggtaaacggttaccgtaacggacgaccttagggtaggtaaccgtctcggggaaccaactacggttaacttttaccaccttactacccgaaccgttagtacctcggacctacgtaccctacgccgtaaacgccgttaagtaacgttacttttacggaccttaaagttttacaccgttcgtaataaaccgtataacttaactaaaccgttccgttagtcgttaacgccgaacggtacctggtagtacgtaagcttaaccgaacgttntagtccggtactacg

SEQ ID NO: 255920 - DNA, 615 bp, Homo sapiens
  misc_feature: GYAE6OF02JIF4D.40.2.A02.1.454.CMB.1.raw
  modified_base (214)..(214): a, c, t, g, unknown or other
  misc_feature (214)..(214): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccggnaagtcagggcattggaaatgatttagcctggtatcagcaagaaaccaggaaaacgcccctacagcctcctgatctatactgcataccacttaacaaagtggacgtcccattcaaggttcagcggcagtgatcgtggcacagactttacaccttctcaacctatccaggccaagccctgacgacgcccgtagtacgttacttttcgacttaaacgtttaatttaccttaggttacctaacgtaaagtaactttaaacctaaacgtttaccccgtagggttacccgtttttcggggaacccgtaacggggggttaacccttacggggtaccgtttaacgggtaacgtaacgttaaccgtaaaaccggtaaccggttttacggtaccgggtacgttaacccggg

SEQ ID NO: 255921 - DNA, 534 bp, Homo sapiens
  misc_feature: GYAE6OF02HQPNM.40.2.A02.1.454.CMB.1.raw
  modified_base (281)..(281): a, c, t, g, unknown or other
  misc_feature (281)..(281): n is a, c, g, or t
  modified_base (414)..(414): a, c, t, g, unknown or other
  misc_feature (414)..(414): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcgagggcattaggaaatgtatttagcctggtatcagcaagaaaccaaggaaaacgcccctanacgtcctcctagactctatactgctatcctaactttaacaagtggactcccatcgaagtcagcgcagtgatcgtggacacgagtactttaccactcctacacctatccagcagcctgacacgcctagaacgtnttttacgacttaacttattacgtagtactaacaatacttaactaaccttaccgtcgttacgtttcggaccgtagggtcctggacgtaggactacgtacgaaacgtacgtggtacgctacg

SEQ ID NO: 255922 - DNA, 650 bp, Homo sapiens
  misc_feature: GYAE6OF02H3RWU.40.2.A02.1.454.CMB.1.raw
  modified_base (95)..(95): a, c, t, g, unknown or other
  misc_feature (95)..(95): n is a, c, g, or t
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
tcagtctagcgactcacgaccggtgctcgatttagactcatctacagggggagtcagacccactcaggacacagcatggacatgagggtccccgntcagctcctggggctcctgctgctctggctcccaggcgccagatgtgccatccagatgacccagtcctccatcctcactgtctgctatctggtaggagacagagtccaacntcacttcggcggnaagtcgagggcagttaggaatgtaattagccgttaggtactcgagtacaacgaaaccgaacggaaaacgcccctagacgtccttaccgtagtactacctactactgacctaacttacccttaacgtttaacaaaggtccgtaccgtaccctagtacgtaaggttaccaaggccggtactaggtacggtattacgtaggactaacgtgttaacttctaccttccgaacctacgtaactcgacgtacctaaccgtccgtcgacgtaccgtaccgtacgtaagttactttacgaaccttaaacgtttcttaccgtactaacggttaacaaacgttacttaaaccgtaccttaaccggtagttaccgtttcgggaccggtacggtaccgtaggtaccgtagacgttacaacggtaaccgtgtaggtcgctaccgg

SEQ ID NO: 255923 - DNA, 568 bp, Homo sapiens
  misc_feature: GYAE6OF02HVJBI.40.2.A02.1.454.CMB.1.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (278)..(278): a, c, t, g, unknown or other
  misc_feature (278)..(278): n is a, c, g, or t
  modified_base (361)..(361): a, c, t, g, unknown or other
  misc_feature (361)..(361): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtagganacagagtcaccatcacttgccggnaagtcagggcattaggaaatgattagcctggtatcagacaagaaaccaaggaaaacgcccctanagcctacctgatctaatactcgactactacctaactttaacgaaaaggtcggacgtacccaatacgtaaggttcaggacgganaggtggactcgtaggacactagtatttacactctacaccatcagcacgctgacacgcctagaagtattttacgacttaactttattactagtactaacgtaagtaacttaaactaaactttacccgtacggttacgtttcggaccggtacgggtacctgggtacttaggaagtacgtaacgaaacgtagtttcggtaggtacctacg

SEQ ID NO: 255924 - DNA, 591 bp, Homo sapiens
  misc_feature: GYAE6OF02IA0TT.40.2.A02.1.454.CMB.1.raw
  modified_base (272)..(272): a, c, t, g, unknown or other
  misc_feature (272)..(272): n is a, c, g, or t
  modified_base (336)..(336): a, c, t, g, unknown or other
  misc_feature (336)..(336): n is a, c, g, or t
  modified_base (346)..(346): a, c, t, g, unknown or other
  misc_feature (346)..(346): n is a, c, g, or t
  modified_base (402)..(402): a, c, t, g, unknown or other
  misc_feature (402)..(402): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagacaagaaaccaaggaaaacncccctacagctcctgatctatactgacactacctactttaacaagtgactccatcagtcagcgnagtgactcgngcactagtatttcactctacactatcagcagtcctgcgacgtacctagtaacgttnttttacgaccttaaactttacttacgtacgttaacttaaactaagttaactttaaacctaaaccgttttaccccgttacgggtttaaccgtttttacggggacccggttaacgggggtacccttaggggtaccgttagggtaacgtacttaaaccgaaaccgggttaacttcgggttacggccgtacgg

SEQ ID NO: 255925 - DNA, 538 bp, Homo sapiens
  misc_feature: GYAE6OF02H6RZW.40.2.A02.1.454.CMB.1.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (262)..(262): a, c, t, g, unknown or other
  misc_feature (262)..(262): n is a, c, g, or t
  modified_base (269)..(269): a, c, t, g, unknown or other
  misc_feature (269)..(269): n is a, c, g, or t
  modified_base (276)..(276): a, c, t, g, unknown or other
  misc_feature (276)..(276): n is a, c, g, or t
  modified_base (335)..(335): a, c, t, g, unknown or other
  misc_feature (335)..(335): n is a, c, g, or t
  modified_base (406)..(406): a, c, t, g, unknown or other
  misc_feature (406)..(406): n is a, c, g, or t
  modified_base (429)..(429): a, c, t, g, unknown or other
  misc_feature (429)..(429): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtagganacagagtcaccatcacttgccggnaagtcaggcattggaatgattagcctgtatcagcagaaccaggaaacncccctanagtctcngatctatactgcactcctaactttaacaaagtcggactacccatacaaggttcagcganagtgatcgtggacacgtagtactttcgactctacactatacacgtcacgtcctagcacgcgtagtaagttntttacgactaactttattacgtntactaactaagtacttactaacttacccgtcgttacgttttcggaccggtaagggtaccttggtaccttaggacgtacgtaccgaaacgtacgtaggtcggtataccgg

SEQ ID NO: 255926 - DNA, 615 bp, Homo sapiens
  misc_feature: GYAE6OF02GJP47.40.2.A02.1.454.CMB.1.raw
  modified_base (223)..(223): a, c, t, g, unknown or other
  misc_feature (223)..(223): n is a, c, g, or t
  modified_base (397)..(397): a, c, t, g, unknown or other
  misc_feature (397)..(397): n is a, c, g, or t
  modified_base (437)..(437): a, c, t, g, unknown or other
  misc_feature (437)..(437): n is a, c, g, or t
tcagtctagcgactcacgaccggtgctcgatttagactcatctacagggggagtcagacccactcaggacacagcatggacatgagggtccccgctcagctcctggggcctcctgctgctctggctcccaggcgccagatgtgccatccagatcgacccagtctccatcctcactgtctgcatctggtaggagacagagtccaccatcacgttcggccggganaagtcgagggctaagttaggaaatgtatttacgccgtaggtactcgagacgaaacggaaaccgtaaggaaaaccgcccctacgacgtcctaccgtagacttacgttaactacgtgacctacgtaccctaactttaacgaaaggtcggactacccatacgtaaggttcaggcganaggtgactcgtggacactagtacttcacttctacacctancacgcacgtcctagcagtccgtagaacgttatttacgaactttaacttacttacgtcgttactaactaagttaacttaacctaacgtttacccgtaggttacgtttcggaccggtaacggggtacctgggtacgttacggaattacgtacgtaaaccgtacgtcggtacgactaccgg

SEQ ID NO: 255927 - DNA, 595 bp, Homo sapiens
  misc_feature: GYAE6OF02FPDY5.40.2.A02.1.454.CMB.1.raw
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccggcaagtcagggcattggaaatgatttagcctggtatcagcagaaaccaggaaaacncccctnagcctcctgatctactactgctactcctaactttacaaagtcggacgtccctataccgaaggttcaggtcggactagtggatcgtaggcacgagtactttacacttcctacaccgtatcacgcacgcctcgacagtacctaggtaaacttcgtttttacgaccttaaacgtttactttacgttacgttactaacgtaacgttaaactttaacgaaactttacccgttcggttacgttttaccgggaccggtaaacggggtaccgttgggaccgttgggtaacgtacgttaccgtaaaaccgtacgtcggtacggtcgtacg

SEQ ID NO: 255928 - DNA, 552 bp, Homo sapiens
  misc_feature: GYAE6OF02G2FHW.40.2.A02.1.454.CMB.1.raw
  modified_base (276)..(276): a, c, t, g, unknown or other
  misc_feature (276)..(276): n is a, c, g, or t
  modified_base (425)..(425): a, c, t, g, unknown or other
  misc_feature (425)..(425): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccggcaagtcagggcattgaaatgtattagcctggtatcagcaagaaaccaaggaaaacgcccctanacgcctccgtgactctaatactgcactacctacttttaacaaaggttcgacgtcccaatacgtaacggttcacggcggacaggtaggacttcgtcggacacgtagtactttcacctctacacctatcacgcacgctgcagctagagttntttcgactaacttattactacgtctaacgaagtacttacaactttacccgtacggttactttcggaccggtaggggtccgtacggtcgtacgggtagtacgtaccgaaacgtacgtggtacgctacg

SEQ ID NO: 255929 - DNA, 727 bp, Homo sapiens
  misc_feature: GYAE6OF02G21EL.40.2.A02.1.454.CMB.1.raw
  modified_base (273)..(273): a, c, t, g, unknown or other
  misc_feature (273)..(273): n is a, c, g, or t
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagacgtcaccatcacttcgccgggcaagtcgagggcagttggaaatgatttaggcctggtatcagcaagaaccaggaaacncccctnacgcctccngactctactactcgaccattaccctaatttaacgaaacgtcggaacgtcccatacgtaaggttccgaaggtccggtaggtaacggttggtaacttcggtacgggacctaacgtaacggttaccttttaccgaccctttacctacctaaacccgtacttaccgaacggtaccctaaccggtcccgtacggacccgtaacccgggttacccttaagggttaaacgtttaccgttttttacggaacccgttttaaacctttttaacgtttacccgtttacggttaccttaaacgttaaacggttaaacctttaaaccgttaaacccgtttacccgttacgggtttacccgtttttacggggaaccccgttaagggggtacccttcgggtcgttaacgggacgtaacgtacgtaaacgtaccggttcggtacggtctaaccgg

SEQ ID NO: 255930 - DNA, 659 bp, Homo sapiens
  misc_feature: GYAE6OF02JCMLD.40.2.A02.1.454.CMB.1.raw
  modified_base (190)..(190): a, c, t, g, unknown or other
  misc_feature (190)..(190): n is a, c, g, or t
  modified_base (457)..(457): a, c, t, g, unknown or other
  misc_feature (457)..(457): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtagganacagacgtcacctatctacgttcggccgggactaagtccgagggctagttaggaaaatcgtatttaggccttggtatcgagtcaaggaaaccgaaggaaaaccgaccccctgacgccttcctaggtaacttctaacgtactgacctactacctaactttaacgaaagtcggtacctaccctagtactaacggttcaggtacgacgtaggtggactcgtaggactacgtagttatttccgactctaccacgtactcgagcctagtccncgtcacgtacttaggtaacgtttactttacgaacttaacgtttacttacgttacgttaacgttaacgaaagttaacctttaaaccgtaaccgtttacccgttacgttaccgttttacggacccgggttaacgggtaccttcgggtaccttacgggaacttaaccggtactaaacccggtagttcggtaccgtacttacccgg

SEQ ID NO: 255931 - DNA, 616 bp, Homo sapiens
  misc_feature: GYAE6OF02JUARH.40.2.A02.1.454.CMB.1.raw
  modified_base (134)..(134): a, c, t, g, unknown or other
  misc_feature (134)..(134): n is a, c, g, or t
  modified_base (203)..(203): a, c, t, g, unknown or other
  misc_feature (203)..(203): n is a, c, g, or t
  modified_base (208)..(208): a, c, t, g, unknown or other
  misc_feature (208)..(208): n is a, c, g, or t
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
  modified_base (400)..(400): a, c, t, g, unknown or other
  misc_feature (400)..(400): n is a, c, g, or t
  modified_base (571)..(571): a, c, t, g, unknown or other
  misc_feature (571)..(571): n is a, c, g, or t
tcagtctagcgactcacgaccggtgctcgatttagactcatctacagggggagtcagacccactcaggacacagcatggacatgagggtccccgctcagctctgggctcctgctgctctggctccgaggcgccngatggtgcctatccgagatcgacccgagtcctaccatcccgtcacgtgtcctgacattctggtacggancgagngtccacatcgacgttgccggacaaggtcagggctaagttggaatagacttagctggtatcgagcgtaagaacctaagggaaacnccccgtnacggtctaccgtagtactcgtacgtactcgtaccacttacccgtaatttaacgaacggtggtaaccttaccccagttaccgtaagtttaccacggtcggtntaacgtgtactcgtagctacgagtacttcactcgtcaccgtatcagcctagcctaggctacgccgttacgaagttacgtcgaacttaacgttcttaacgtcgtttaaccgacttaaggactttaaaccgaacgtttacctccggtttacgttacggacggtacggttaacnggtccgtaggtacgcggtaacctaagttagacgtcgacgtaccgg

SEQ ID NO: 255932 - DNA, 545 bp, Homo sapiens
  misc_feature: GYAE6OF02GSQ88.40.2.A02.1.454.CMB.1.raw
  modified_base (270)..(270): a, c, t, g, unknown or other
  misc_feature (270)..(270): n is a, c, g, or t
  modified_base (277)..(277): a, c, t, g, unknown or other
  misc_feature (277)..(277): n is a, c, g, or t
  modified_base (285)..(285): a, c, t, g, unknown or other
  misc_feature (285)..(285): n is a, c, g, or t
  modified_base (297)..(297): a, c, t, g, unknown or other
  misc_feature (297)..(297): n is a, c, g, or t
  modified_base (345)..(345): a, c, t, g, unknown or other
  misc_feature (345)..(345): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccggcaagtcagggcagttggaaatgtatttagccgtgtatcagcaagaaaccaggaaacncccctanagcctccngtactctatacngcatcctattaacaagtgactccatcaaggttcagcggcagtgatcgnggtcaacagtactttcgacttcctacacccattcacgtcaacgcctgccagcctagaaacgtatttcggactaaactttacttacgtattactaataagttaacttaactaacgtttaaccctcgggttaccttttgggacccgtaacggggtaacctgggtcgtaggaactacgtacgaaaggtacctggtcgacgtcg

SEQ ID NO: 255933 - DNA, 691 bp, Homo sapiens
  misc_feature: GYAE6OF02GFXN7.40.2.A02.1.454.CMB.1.raw
tcagtctagcgactcacgaccggtgctcgatttagactcatctacagggggagtcagacccactcaggacacagcatggacatgagggtccccgctcagctcctggggctcctgctgctctggactccaggcgccagactgtgccatccagatcgacccagtctccatcctcactgtctcgcactctaggtaggagacagacgtccaactatccgaccttcggccggacaaggtcgaacgggtctagttaggaaattgtaatttacgccgtaggttacacgtagacaaacggaaaccgtaaggaaaccctcccctagtaccggtccttaccgtagtacctactaacgtaccgtgacctaccgttaccttaactttaaaccgaacggttacggaccctaccgtaattaccggtaaggttacgacggcgtacgtaggtacgtataccggtacggactaacgtagtttaccttacgacttaccgttaccaccgttaacgcctaacggacccgtacgtcccgtagaccgtacgtaccgttaagtacggttactttaccgacttaacgttacgttacgtacgttaactaacgtaactttactaaacttacccgttaccgtagtttaccgttaggtccggtaacggtacgtcggacttaggactacgtaacgtaaccgcgttacggcgtacgtaccg

SEQ ID NO: 255934 - DNA, 798 bp, Homo sapiens
  misc_feature: GYAE6OF02HBO6H.40.2.A02.1.454.CMB.1.raw
tcagtctagcgactcacgaccggtgctcgatttagactcatctacagggggagtcagacccactcaggacacagcatggacatgagggtccccgctcagctccgtgggctcctgctgctctggctccaggcgccagatgtgccatccagatcgacccagtcctccatccctcactcgtctgcattctaggtaggagacgagacgtaccaacctagtacctacgttcggacccgggtactaacggtaccgaggggtactaagttagggtaaaacgttgtaacttttaaggcccgttagggtaactacgaacgtaccgaaacggtaaaacccgaaagggaaaacccgtccccctacgaacgtcctccgtagtaccttactaacgtaccgtcgtactaaccttacccgtaactttaaacgaacggtcggtaacctaccccgtaagttaaccgtaacgggttcacggtcggacgtacgggtagtacgttcggtcggtactaaccgttagtacctttaccgacgttaccctactaacccgtacttacgacgtacgaccgtacgtcggaaccgtacggtaccgttaagtaacgtttacgtttactaaccttaacgtttaaacgtttcctacgttacctaaacgttaacgttaaccttaactttaaccggttaaccccgttaaggtttacccggtttacgggtaaccggggaccgggtttaccggtacggttccgttaaagggtaacctaaccggtttaaaccggaaacggttacccggttcggtaaccggtacccgttaaccgg

SEQ ID NO: 255935 - DNA, 881 bp, Homo sapiens
  misc_feature: GYAE6OF02GNWZ9.40.2.A02.1.454.CMB.1.raw
tcagtctagcgactcacgaccggtgctcgatttagactcatctacagggggagtcagacccactcaggacacagcatggacatgagggtccccgctcagctcctggggctcctgctgctctggctcccagcgccagatgtgccatccagatgacccagtctccatccctcactgtctgcatctggtaggagacagacgtcaaccatcacgttcggccgggacaagtccgagggctaagttaggaaattgagttttacgccgttaggtatcgacgacgtaacgaaaaccgaaggaaaaaccgtcccctacgtaacgcctccgtagtactaccgttaactcctagacctaacttacccttaacttttaacgaaacgtcggtaaccgttaccccaacgtttaacgtaaccgggttacgaacgggtaccggtacgtaacgggtacgggtacttacggtcggtaacgaacgttaagtttacccgttttaacacctttaccccaacccgtaaccctaacttaccgaaccggtccgtaaccgtccccttaaggtacccgtaacccggtaacccgttaaaggttaaacgtttaccgttttaaaccgaaacgtttttaaacccgtttttagtttaaacccgtttaaccggttaaccgtttaaaccgttaaaaccggtttaaaccttttaaaacccgttaaaccccgtttttaacccgggtttacccgggtttttaaccgttttcccgggggtaaccccgggtttaaccggggggtaacccccgtttcgggggtaaacccgggtttagggtaaaacccgttacgggttaaaacccggttaaacccgggtttaaaccggtttacgggtacccgggttacccgttaacccggg

SEQ ID NO: 255936 - DNA, 607 bp, Homo sapiens
  misc_feature: GYAE6OF02F0ADO.40.2.A02.1.454.CMB.1.raw
  modified_base (261)..(261): a, c, t, g, unknown or other
  misc_feature (261)..(261): n is a, c, g, or t
  modified_base (316)..(316): a, c, t, g, unknown or other
  misc_feature (316)..(316): n is a, c, g, or t
  modified_base (371)..(371): a, c, t, g, unknown or other
  misc_feature (371)..(371): n is a, c, g, or t
  modified_base (404)..(404): a, c, t, g, unknown or other
  misc_feature (404)..(404): n is a, c, g, or t
  modified_base (417)..(417): a, c, t, g, unknown or other
  misc_feature (417)..(417): n is a, c, g, or t
tcagtctagcgactcacgaccggtgctcgatttagactcatctacagggggagtcagacccactcaggacacagcatggacatgagggtccccgctcagctcctggggctcctgctgctctggcctcccgaggcgccagatgtcgccatccagatcgacccagtctccatcctcactgtctgctatctaggtaggagacagtagtccacctatcgacttcggccggacaagtcgaggcagtagaatgtattacgctggtancgagccaagaaaccgaggaaacctccctgacgcctccgtagtatctaactacgtnactactacctaacgtttaacgaaggtcgtactacccattacgagttacgaggcgngtaagtgattcgacggtactacgagtacttacnctcctactactanacacgctacgacctgactacgtacgtagtaacgttattacgtacttaacgttactacgttactactaacgtaagttacttaacgttaccgttaccgttacggtacgtttccgggaccggtacgggtacccgtacgggtacgttacggtaacgtacgtaaccgtaaaccgtcggtacgttcgtacgtaccg

SEQ ID NO: 255937 - DNA, 541 bp, Homo sapiens
  misc_feature: GYAE6OF02HCHJ4.40.2.A02.1.454.CMB.1.raw
  modified_base (281)..(281): a, c, t, g, unknown or other
  misc_feature (281)..(281): n is a, c, g, or t
  modified_base (344)..(344): a, c, t, g, unknown or other
  misc_feature (344)..(344): n is a, c, g, or t
  modified_base (384)..(384): a, c, t, g, unknown or other
  misc_feature (384)..(384): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttcggccgggacaagtcgagggcattggaaatgtatttagcctggtatcagcaagaaaccaaggaaacgcccctnacgctcctgatctatctgcatcctaattaacaagtgactccatctagtcagcgcagtgatcgnggcagacgtattcactctacactatcgagcagcctgaccngtacctgtaactcttttcgaacttactttacttcttagtacttaacaacgttacgttaaactaacgtttacccgtagttaccgttttggacccggtacgggtacctgggacgtacggagttaacgaaccgtaaagtccggtaggttaccgactaccg

SEQ ID NO: 255938 - DNA, 715 bp, Homo sapiens
  misc_feature: GYAE6OF02G6870.40.2.A02.1.454.CMB.1.raw
  modified_base (303)..(303): a, c, t, g, unknown or other
  misc_feature (303)..(303): n is a, c, g, or t
  modified_base (456)..(456): a, c, t, g, unknown or other
  misc_feature (456)..(456): n is a, c, g, or t
tcagtctagcgactcacgaccggtgctcgatttagactcatctacagggggagtcagacccactcaggacacagcatggacatgagggtccccgctcagctcctggggctcctgctgctctgcctcccaggcgccagatgtgccatccagatgacccagtctccatcctcactgtctgcatctggtaggagacaggagtccacctattccgtacgttcggcccgggactaacggtcgagggctagttagggtaaatgtagtttacgccgttggtatcgagacaacgaaacccaaggaaaaccncccctagactaccctccgtagtacttacctatactcgactacttaccctaactttaacggaaggtcggtaacctaccctagtacggtaacggttcgaggtcggtcgaggtacggtacgtcgtcggactaacgtagttacttaccctacttccnccaaccgtctacgacgcctacgtccgtacgtaccgtaccggtactaggtacgtttactttcggacctttaaacgtttctttaccgtagtttaacccgtaaagttaccgtttaaaccgtttaaccttaaccgtttaccccgttaggggtttttacccgttttaccggggacccggttaacgggggtccccgtttagggtccgtaaggtaaccgaccgttaaaccgaacgggtttacgttccggttacgggtactaaccgg

SEQ ID NO: 255939 - DNA, 628 bp, Homo sapiens
  misc_feature: GYAE6OF02I1L7P.40.2.A02.1.454.CMB.1.raw
  modified_base (196)..(196): a, c, t, g, unknown or other
  misc_feature (196)..(196): n is a, c, g, or t
  modified_base (213)..(213): a, c, t, g, unknown or other
  misc_feature (213)..(213): n is a, c, g, or t
  modified_base (243)..(243): a, c, t, g, unknown or other
  misc_feature (243)..(243): n is a, c, g, or t
  modified_base (273)..(273): a, c, t, g, unknown or other
  misc_feature (273)..(273): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgaccatccagatgacccagtctccatccctcactgtctgcatctgtagagacagntcacatcactgccgganagtcaggcattgaatgattagcctgtactngcaagaaccagaaacgcccctacagctccngattactatctgacattacctatttacaagtgacgtccatcaagttcgagcgcgagtgactctggcagtagtactttacgtactacgacctaccgtatccgacgaccgaccgcctacgccacggccgttaggtaaagtttacttttacggaaccttaacgttttacgtttaacgtttcgttaacgtttaaactacggttaaacctttaacgttaaaaccgttttaccccgtaccgggttttacgttttacccgggtaacccggttaacgggggttaacccgttaggggttaccggttaacgggtaggtaacgtaaccgttaaaaccggtacgttacgggttacggtcctaacggg

SEQ ID NO: 255940 - DNA, 696 bp, Homo sapiens
  misc_feature: GYAE6OF02HWIA4.40.2.A02.1.454.CMB.1.raw
tcagtctagcgactcacgaccggtgctcgatttagactcatctacagggggagtcagacccactcaggacacagcatggacatgagggtccccgctcagctccgtggggctcctgctgctctggctcccaggcgccagatgtgccatccagatcgaccctagtctacctactcctcacgtgtctgcatctaggtaggacgtacaggactcaacctatacacgttcggccggtataacggtcgagggctaagttaggtaattgtatttacggccgttagtactacgacgacgtaaacgaaaaccgaacggtaaaaccctccccgtacaccgtcttaccgtagtactactactacgtcgacctacttaccctaacgtttaaacggaacgtacggtaaccgtacctaacgtacgtaacggttcacggtacggtagtacggtacggtactcggtacggtacaacgtagttaccttccgtaacttcctaactaccgtaatcgaacggtccacggtccagtaccgtaccgttaccgtaagtaacgttcgtttacaacctttaacgttttactacgtttacgtaactaaccgtaaagttaccttaaacgttaccgtttacccgtacggttttaccgtacggaccggtacggtacgtaccgagtacggtaacctacgtaccggtaacgtcgtacggctacgtcc

SEQ ID NO: 255941 - DNA, 637 bp, Homo sapiens
  misc_feature: GYAE6OF02F9GJ4.40.2.A02.1.454.CMB.1.raw
  modified_base (214)..(214): a, c, t, g, unknown or other
  misc_feature (214)..(214): n is a, c, g, or t
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
tcagtctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagatcaccatcacttgccggtnaagtcaggcatggaaatgtattagctggtatcagcagaaaccagaaacgcccctanagtctctgactctanactgacactctacttacaagtgacgtaccatcgtaagtcagcgacaggtcgatcgtggcacgtagtactttacgactcgaccaaccgtataccgaagtccacggtccgtagtacgacgtacccgttaagggtaactttattttacggaaccttaaacgtttactttaaaccgttggttaaccctaaacgttaaacgttaacgtttaaacccgtaaacttttaccccgggtaacgggtttaccgttttaccgggaacccggtaacggggggtaccttaccggggtaccgttagggaaaccgtaccgttaacccggtaaaaccggtacttacgggttacggtaccccgtaacgg

SEQ ID NO: 255942 - DNA, 512 bp, Homo sapiens
  misc_feature: GYAE6OF01BV4A2.15.31.C09.1.454.CMB.1.raw
  modified_base (308)..(308): a, c, t, g, unknown or other
  misc_feature (308)..(308): n is a, c, g, or t
  modified_base (454)..(454): a, c, t, g, unknown or other
  misc_feature (454)..(454): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaagcccccaaaactcatgatttangaggtcagtaatcggccctcgaggggtttctaatcgcttctctggctcaagtctggcaacatcggccctccctgacctatcctcgtgggcctccgaggctgaggacgaggctgatttatactgcagctcatatacaagcagcagcnctccgttgggtgttcggcggaggaccagcgtcgaccgtcgaggtcacgcccaggtccc

SEQ ID NO: 255943 - DNA, 525 bp, Homo sapiens
  misc_feature: GYAE6OF01BGQ05.15.31.C09.1.454.CMB.1.raw
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaagcccccaaactcatgatttatgaggtcagtaatcggccctcaggggtttctaatcgcttctctggctccaagtctggcaacatggccctccctgaccatctctgggctccaggctgaggacgaggctgatttattactgcagctcatatacaagcagcagcactccgttgggtcgttcgggcggagggaccaaggcctaggacccgttccgtaggtaccacggtccccgaagggtcccg

SEQ ID NO: 255944 - DNA, 548 bp, Homo sapiens
  misc_feature: GYAE6OF01AC4QR.15.31.C09.1.454.CMB.1.raw
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaacgcccccaaatcatgatttatgaggtcagtaatcggccctgaggggtttctaatcgcttctctggctccaagtctggcaacatcggcctccctgaccatctcgtgggcctccgaggctggaggacgaggctgatttattactgcagtctcaatataacaagcagcacgctacgtccgttgggtgttccgggacgggtagggaaccaaggtcctacggtacccggttaccgttacgggtacccacggccccgaagggtccccg

SEQ ID NO: 255945 - DNA, 553 bp, Homo sapiens
  misc_feature: GYAE6OF01EW1O3.15.31.C09.1.454.CMB.1.raw
  modified_base (368)..(368): a, c, t, g, unknown or other
  misc_feature (368)..(368): n is a, c, g, or t
  modified_base (454)..(454): a, c, t, g, unknown or other
  misc_feature (454)..(454): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacacgaaccaggcaaacgcccccaaactcatgatttatgagtcagtaatcggccctgtagggtttctaatcgcttctctggctccaagtctggcaacntcggccctcctagacctatctcgtgggctccgaggctggaggacgaggctgaattattactgcagctacaatactaacaagcaagnagccacgttccgttagggtcggttacgggcgggaacgggtaccaaaggccgtacggaccccgttcgtaacggtaccgaaccgtcccgaaagggtccccg

SEQ ID NO: 255946 - DNA, 525 bp, Homo sapiens
  misc_feature: GYAE6OF01BLEIQ.15.31.C09.1.454.CMB.1.raw
  modified_base (307)..(307): a, c, t, g, unknown or other
  misc_feature (307)..(307): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctctggtaccaacagaacccaggcaaacgcccccaaactcatgatttangaggtcagtaatcggccctcgagggtttctaatcgcttctctggctcaagtctggcaacatcgccctccctgaccatctcgtgggcctccgaggctggaggacgaggctgatttatctgcagctcatatacaagcagcagctactcgttgggtcgttcgggcggtagggacctaagccgtacggacccgttcctacggtccacggcccgaagggtccc

SEQ ID NO: 255947 - DNA, 513 bp, Homo sapiens
  misc_feature: GYAE6OF01BRZ1F.15.31.C09.1.454.CMB.1.raw
  modified_base (430)..(430): a, c, t, g, unknown or other
  misc_feature (430)..(430): n is a, c, g, or t
  modified_base (442)..(442): a, c, t, g, unknown or other
  misc_feature (442)..(442): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaagcccccaaaactcatgatttatgaggtcagtaatcggccctgagggtttctaatcgcttctctggctccaagtctggcaacatcggcctccctgaccatcctcgtgggctccaggctggaggcgagctgattatactgcagctnatatacaagcancagctactcgttgggtgttcgggcggagggaccagctggacccgtccgtaggtaccagcccgaaggtcccg

SEQ ID NO: 255948 - DNA, 549 bp, Homo sapiens
  misc_feature: GYAE6OF01EXG24.15.31.C09.1.454.CMB.1.raw
  modified_base (231)..(231): a, c, t, g, unknown or other
  misc_feature (231)..(231): n is a, c, g, or t
  modified_base (308)..(308): a, c, t, g, unknown or other
  misc_feature (308)..(308): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgagcccagtctgccctgactcagcctgcctccgtgtctgggtctcttggacagtcgatcaccatcctcctgcactggaaccngcagtgacgttgtacttataactatgtctctggtaccaacagaacccaggacaaacgcccccaaactcatgatttangaggtacagtaatcggccctcgtagggtttctaatcgtcttctctcggctccaagtctggacaacatcggcctccctgaccatctcgtggtcctccgaggctaggacggacgaggtctgtatttattactgcagctacatatacagcagcagctaccgttccgttgggtcggttcgggacgggaacgggaccaacggccgtacggtacccgttacgtaacgggtccacggcccgtaacggg

SEQ ID NO: 255949 - DNA, 518 bp, Homo sapiens
  misc_feature: GYAE6OF01ANPAX.15.31.C09.1.454.CMB.1.raw
  modified_base (230)..(230): a, c, t, g, unknown or other
  misc_feature (230)..(230): n is a, c, g, or t
  modified_base (307)..(307): a, c, t, g, unknown or other
  misc_feature (307)..(307): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccngcagtgacgttggtacttataactatgtctcctggtaccaacagaacccaggcaaacgcccccaaatcatgatttangagtcagtaatcggcctcaggggtttctaatcgcttctctggctcaagtctggcaacatcggcctccctgacctatctcgtggctccgaggcgtagagggacgaggctagattatactgcagtctacatactacaagcagcagcacttccttgggtcgttcggcggagggaccaggtctggaccgtcctagggacacggcccgaggtcccg

SEQ ID NO: 255950 - DNA, 545 bp, Homo sapiens
  misc_feature: GYAE6OF01D53DB.15.31.C09.1.454.CMB.1.raw
  modified_base (432)..(432): a, c, t, g, unknown or other
  misc_feature (432)..(432): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttgtacttataactatgtctcctggtaccaacagaaccagcaaacgccccaaactcatgattatgaggtcataatcgccctcgtagggtttctaatcgtcttctctgctcagtctggacacatcggccctcctcgaccatctcgtggcctcaggctaggaggacgaggtctgaatttattactgacgacgctnaattataactaagactagacagtactacgttccgttgggtcggttacgggcgggtacgggaccgaggtccgtcgacccgttaccgtacggtaccacggcccgaagggtccccg

SEQ ID NO: 255951 - DNA, 551 bp, Homo sapiens
  misc_feature: GYAE6OF01D6NH5.15.31.C09.1.454.CMB.1.raw
  modified_base (429)..(429): a, c, t, g, unknown or other
  misc_feature (429)..(429): n is a, c, g, or t
tcagtctacgtagccacgaccggtgctcgatttagacgtctcatcaaggaaggaaggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacacgaacccaggcaaacgcccccaaactcatgtatttatgaggtcagtaactcggccctcgtaggggtttctaatcgtctttcgtctggctccgaagtctggcaacgatcggccctccctacgcctactcctcgtggcctccgagctggaggacggngctgtatttattctagcagtctactataacgtaacaagtacagcacgtacctaccgttcgttggggtcgttcgggcgggacggaccaagcgtacgaccgtcgtacggcacgccgaggtcccg

SEQ ID NO: 255952 - DNA, 539 bp, Homo sapiens
  misc_feature: GYAE6OF01BY00D.15.31.C09.1.454.CMB.1.raw
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttgtacttataactatgtctcctggtaccaacagaacccaggcaaacgcccccaaatcatgatttatgagtcagtaatcggccctcgagggtttctaatcgtcttctctggcctcagtctgcaacatcggccctccctgaccctatcctcgtgggcctccgaggctggacggacgaggtctagtatttattactgcagctcaatataacaagcagcacgcctaccgttcgttggggtgttccgggcggacgggaccaggctacggtacccgtcgtacggtccacggcccgaaggtccccg

SEQ ID NO: 255953 - DNA, 544 bp, Homo sapiens
  misc_feature: GYAE6OF01CP4RT.15.31.C09.1.454.CMB.1.raw
  modified_base (308)..(308): a, c, t, g, unknown or other
  misc_feature (308)..(308): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaacgcccccaaactcatgatttangaggtcagtaatccggccctcgaggggtttctaagtcgtcttctctggctccaagtctggcaacagtcggccctcccgtgaccatcctcgtcgggtcctccgaggcctggaacgggacgagggccttagtatttattactgcagtctacaatactacaagcagcagcctacgtcgttgggttgtcggcggagggaccaagcgtagacccgtctacggtcaacgcccgaaggtcccg

SEQ ID NO: 255954 - DNA, 552 bp, Homo sapiens
  misc_feature: GYAE6OF01A8H46.15.31.C09.1.454.CMB.1.raw
  modified_base (312)..(312): a, c, t, g, unknown or other
  misc_feature (312)..(312): n is a, c, g, or t
  modified_base (539)..(539): a, c, t, g, unknown or other
  misc_feature (539)..(539): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgccactggaaccagcagtgacgttggtacttataactatgtctcctggtaccaacacgaaccacggacaaacgcccccaaactcatgatttagngaggtcagtatcggccctcgtagggtttactaagtcgtcttctctggctcaagtctggacaacagtcggccctcccgtcgacctactctcgtcggggcctcccgaggtccgtggaacgggacgaggcgttagtactttagttactgcagctacatactaacagtcagcacgcctacgttcgttgggtggttcgggcggaggaccgagctcggaccgtcgtacggacncgccgaggtcccg

SEQ ID NO: 255955 - DNA, 594 bp, Homo sapiens
  misc_feature: GYAE6OF01D31V4.15.31.C09.1.454.CMB.1.raw
  modified_base (232)..(232): a, c, t, g, unknown or other
  misc_feature (232)..(232): n is a, c, g, or t
  modified_base (368)..(368): a, c, t, g, unknown or other
  misc_feature (368)..(368): n is a, c, g, or t
  modified_base (477)..(477): a, c, t, g, unknown or other
  misc_feature (477)..(477): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatccaccatcctcctgcactggaaccngcagtgacgttgtacttatactatgtctctgtacacagaaccagacaacgccccaatcatagtattagtagagtcagtaactcgtcctgtagggtttctaatcgtcttcgtctcggcctacgaagtctcggcaacncgtcggccctcccgtacgacctactcctcgtcgggctcccgaggtcgtaggacggaccggaggtctagtactttacgtacgtcgacgtacgtctactaatactaacganaccgagcctacgccttaccgttcggttcgggtacggtccgggtacgggtaaggacccgtacggtccgtacggtaccccgttacggtacggtacccgaacggcccgagggtaccccgg

SEQ ID NO: 255956 - DNA, 570 bp, Homo sapiens
  misc_feature: GYAE6OF01CAN8L.15.31.C09.1.454.CMB.1.raw
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacagaaccaggacaaacgccccaaatcatgattatgaggtcagtaatcggcctacgtagggtttctaatcgcttctctggctcaagtctggacaacagtcgccctccgtcgacctacttctcgtcgggtcctccgaggctggaggacgagctagtacttagttactcgcacgtctacatacgtaacaagacagaccagacctacgtccggttggggttacgttccgggacgggacgggaacgtaacggtcgtacggtaacccgttccgtacggtaccgacgaccccggtaagggtccccg

SEQ ID NO: 255957 - DNA, 650 bp, Homo sapiens
  misc_feature: GYAE6OF01DWLX5.15.31.C09.1.454.CMB.1.raw
tcagtctacgtagccacgaccggtgctcgatttagacgtctcatcaaggaaggaagggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatcctcctgcacgtaggaaccagcagtgacgttgtacttataactatgtctctgtaccaacagaaccaggacaacgaccccaaatcatcgtattagtgaggtacagtaactccggccctacgtagggtttctaagtccgacttctcgtggcctccgaaagtctacggacaacacgtcggccctacccgtacgacctattccgtacgttcgggacctccgaggtctacggaacggtaacggacggtcttacgtaagtttacttacgtcgactagacttctaattacggtaaacaacggtacacgaccgaacgccgttaaccgttccggttacggggttacgggttcggggaccgggtaacgggaccggtaaccgggtcccgttacgtaccccggttacgttaacggtaccgtaacccggtaccccgaggttacccccgg

SEQ ID NO: 255958 - DNA, 673 bp, Homo sapiens
  misc_feature: GYAE6OF01ATNR9.15.31.C09.1.454.CMB.1.raw
  modified_base (231)..(231): a, c, t, g, unknown or other
  misc_feature (231)..(231): n is a, c, g, or t
  modified_base (281)..(281): a, c, t, g, unknown or other
  misc_feature (281)..(281): n is a, c, g, or t
  modified_base (313)..(313): a, c, t, g, unknown or other
  misc_feature (313)..(313): n is a, c, g, or t
  modified_base (379)..(379): a, c, t, g, unknown or other
  misc_feature (379)..(379): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcgttggacagtcgatcaccatctcctgcactggaaccngcagtgacgttggtacttataactatgtctcctggtaccaacagaacccnggaccaaacgcccccaaactcatgtatttacngagtcaagtaatccggcctcgtagggttctaagtcgtcttctctcggctccgaagtctcgacaacngtcggccctcccgtcgtacccattccgtacgttcgggtcctacccgacggtcgtggacggacggaggtcgttagtatttacttacgtcgacctagtactactaactaacgtaacgaacgccgtaacgaccgtaacgacccgttaaccgttccggggtttaccgggttacggggtttacccggggacggggtaacccgggtaaccgtaaaccgggttcccgacggttaacccccggtttacccgggttaacggtaccccgtaacccgggtacccccggtaaacgggttcccccgg

SEQ ID NO: 255959 - DNA, 688 bp, Homo sapiens
  misc_feature: GYAE6OF01A3Z1J.15.31.C09.1.454.CMB.1.raw
  modified_base (193)..(193): a, c, t, g, unknown or other
  misc_feature (193)..(193): n is a, c, g, or t
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
  modified_base (306)..(306): a, c, t, g, unknown or other
  misc_feature (306)..(306): n is a, c, g, or t
  modified_base (349)..(349): a, c, t, g, unknown or other
  misc_feature (349)..(349): n is a, c, g, or t
  modified_base (446)..(446): a, c, t, g, unknown or other
  misc_feature (446)..(446): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctcgtgtctgggtctnttggacagtcgatcaccatctcctgcacgtggaaccagcagtgacgttggtacttataatatntctctagtaccaanacgaccaggacaaacgccccaatcatgtactttagngtagtcagtacgtcggtcctcgtagggtttctaactcgtcttntctcgtactcgtaagtctcggactaacgtagtcggcccttaccctagtaaccctgttacctcgtacgggtcctaccgaggtctaggaacggtacggngtcgttaggtatttacgtttacgcgtactacgtcgttaacaacgttacgtaaccgaaacgtaccgtaacgacgaaccgtaccggttacccgttttccggggtttaccggggttccgggttaaccgggggtaccgggtaaccgggggtacccgtaaacggtacccgggttacggttaacccccggttaccggttaccggggttacccaacccggggtaacccgttaaccggggttccccccgg

SEQ ID NO: 255960 - DNA, 753 bp, Homo sapiens
  misc_feature: GYAE6OF01AUDSO.15.31.C09.1.454.CMB.1.raw
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacagaaccaggacaaacgacccccaaactccatagtatttatggtaggtactaagtacgtccggccctacgtacggggtttactaacgttctcgtttctcgtcggtccttaccaacggttccgtacggtaccaaacgtacgttccggtaccccgttcccctacggaacccttacttcccgttaccggttcggggtaccctcccgtaacgggtccgttacgggaaccggggtaaccggacgggtacgttacgtaaacgttttaacgtttaccgtacggtacgacgtaccgttaacctaacttaacgtaaacgtaacgtaccggaacaccgaacgtacccgttaaccgttcccggtttgggggttacccgggtttacggggacccgggggtaccggggtaaacccgtacgtacccggtaccggttaacccccggttacggttaccgggtaacccgacccggtaacccgggtaacgggtcccccgg

SEQ ID NO: 255961 - DNA, 743 bp, Homo sapiens
  misc_feature: GYAE6OF01BQ6RY.15.31.C09.1.454.CMB.1.raw
  modified_base (142)..(142): a, c, t, g, unknown or other
  misc_feature (142)..(142): n is a, c, g, or t
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (229)..(229): a, c, t, g, unknown or other
  misc_feature (229)..(229): n is a, c, g, or t
  modified_base (312)..(312): a, c, t, g, unknown or other
  misc_feature (312)..(312): n is a, c, g, or t
  modified_base (655)..(655): a, c, t, g, unknown or other
  misc_feature (655)..(655): n is a, c, g, or t
tcagtctacgtagccacgaccggtgctcgatttagacgtctcatcaaggaaggaaggggggggtctcaggaggcagcgctctcaggacatctccaccatgcctggctctgctgctcctcaccctcctcactcgagggcacgngggtcctgggcccagtctgccctgactcagcctgcctccgtgtctggtcctgttggacngtcgatcacntctccgtgcactgaaccngcagtgagttgtacttatactatgtctcgtagtaccacaacgaccgaggaccaaccgccccaaactcatgtattcgtgacgtntaagtacgtccggacccttaggtacgggttttacacgtcgtctttccgtacgtcggtcctacgtacgttcgacggactaaacgtcgtaccggtcccctcccgttacgtaacccgtaccttacccggttccggtacggtaccccgtttaccggacgggtccgtaacgggaacgggtaacggccgggtattaacggttaacgtttacgtctaccgggtactaccggtactacctaaagttaaccgaacgtaccggaacgtactaaccgtacgtacccgttaaccggttcccggggttttcgggtacggggtttaccggggaacccggggacgtttaaaccccggnggttaccccggttaccgggttaaccccggttaccggtaacccgggtacccggtaacccggtacccccgggtgggttaacccccccggg

SEQ ID NO: 255962 - DNA, 669 bp, Homo sapiens
  misc_feature: GYAE6OF01CTJ0P.15.31.C09.1.454.CMB.1.raw
  modified_base (234)..(234): a, c, t, g, unknown or other
  misc_feature (234)..(234): n is a, c, g, or t
  modified_base (313)..(313): a, c, t, g, unknown or other
  misc_feature (313)..(313): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacgagggtcctgggcccagtctgccctgactcagcctgcctccgtgtcgtgggtctcttggacagtcgatcaccatcctcctgcacgtggaaccngcagtgacgttggtacttataactatgtctccgtgtaccaacacgaaccaggacaaacgaccccaatcatcgtatttangaggtacagttaagtccggtccctaggtacgggtttactaagttccgtctttccgtacgttcggcctacctaaaggttcgtacggtaccaaactacgttcggtaccccttccctacggtacctacttccgtacgtccggggtccacccggtaggtaccgtagggaacgggaccggtacgggacttgtaactttacgttacgtcgacgtacgcttaacattaacgtaacgagtacgaacgacgacgtactaccgttccggttggggttcgttccggggacggaaccgggtaccgtaaacggcccgtaggtacccggttacccgttacgggtacgacccgtacccggaacggtccccg

SEQ ID NO: 255963 - DNA, 863 bp, Homo sapiens
  misc_feature: GYAE6OF01B7IUM.15.31.C09.1.454.CMB.1.raw
  modified_base (237)..(237): a, c, t, g, unknown or other
  misc_feature (237)..(237): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcgagggcacgagggtcctgggcccagtctcgccctgactcagcctgcctccgtgtcgtgggtctcgttggacagtcgatcaccatcctcctgcactcggaaccngcagtgacgttgtacttataactatgtctctgtacacagaaccaggacaaacgaccccaatcatgtattagtagaggtcagtactcggcctgtagggtttactaatcgtcttcgtctggtcctacgtacgtcgtacggacaacgtacgtccggtcccttacccgtacgaaccgtaccgttccgttacccgggttcgggtccccttaccgggtacgggttaccgggtacgggtaaccgggggtaaccggtacggggttaccgtttaacgggtttaaacgttttaaccgttttaaccggttaccggaacccggttaccggttaccgtttaaaccgtaaaccggtttaaacctaaaccggttaaaccgggaaaccgttaacgggtaaccccgtaaaccgggttccccgttttaaacccggggttttacccggggttttccgggggggttttaccgggttaacccgggggggtaaaccccggggtaacccggggggttaaaaccccggtacggggttaaccccgggttaccccggggtttaaccccccgggttttaaacccgggtacccggggtttaaaccccgaacccggggtaaccccccgggttaaacgggttacccccccccgggg

SEQ ID NO: 255964 - DNA, 672 bp, Homo sapiens
  misc_feature: GYAE6OF01D4RUM.15.31.C09.1.454.CMB.1.raw
  modified_base (237)..(237): a, c, t, g, unknown or other
  misc_feature (237)..(237): n is a, c, g, or t
  modified_base (263)..(263): a, c, t, g, unknown or other
  misc_feature (263)..(263): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacgagggtcctgggcccagtctcgccctgactcagcctgcctccgtgtcgtgggtctcgttgacaggtcgactcacctatctcctgcactcggaaccngcagtgtacgttggtacttataactntagttcctctacggtacaacacaaccgagacaaaccgaccccaatcatagtatttatggagtctatacgtccgcctcgtagggtttctagtcgtctcttcgtcgtcctacgtacgtcgtggtacaactgtcgtccccttaccgtacggaccctaaatcccttacggtccgggccgttacccggtaggcgtaacgggtaacgggaacggtacggggtacgttaggtaagttttaacttaccggtaggtactacggtctaccgttaaactaacgtaacgtaacgtaccgaagtaccacggtcctaacgttccggttacgggtttacgggtcccgggacggggtaacggccgtaaacgtcgtacggtacccggttccggtaagtacccgaacggtcccgaacggttccccgg

SEQ ID NO: 255965 - DNA, 887 bp, Homo sapiens
  misc_feature: GYAE6OF01EMOAB.15.31.C09.1.454.CMB.1.raw
  modified_base (131)..(131): a, c, t, g, unknown or other
  misc_feature (131)..(131): n is a, c, g, or t
  modified_base (253)..(253): a, c, t, g, unknown or other
  misc_feature (253)..(253): n is a, c, g, or t
tcagtctacgtagccacgaccggtgctcgatttagacgtctcatcaaggaaggaagggggggggtctcaggaggcagcgctctcaggacatctccaccatggcctgggctctgctgctcctcaccctcctnactcgagggcacgagggtcctcgggcccagtctcgccctagactcagcctgcctccgtgtcgtgggtctcgttcggacaggtcgactccacctactccttccgtgaccaacgtacggaaccnggacgtacggtggtaccggtttaggttaacttaactaacgttacgttcgtcccgtaccggttacgtaaacccgaacgaaccggaaacccggacggaaccaaaccccgtacccccgtaaaatcgtaacgttacggtaattttacggacggtaacggtacggtaaacgttaccgtcccggtaccgttacggttaacgggtttacctacgttccgtaccgtttccgttcggtaccgggttcctaacggtacggttccgtacgggtaaacctaacggtccgttacccgggtcccctttaacccgtacggaaccctttcgttcccgttaccggggttccggaccttaccgggtacgggtacggtaacgggtacggggaaccgggttacgttacggttacgttaacgttttaccgttaccggacgtaccgtacgttaaccgtaacgtaacgttaaacgaaccgggtaaagtcccggagtaccgtaccggtttaccgttccggtttacgggggttcgggttaacccggggtaacgggaaccgggggtaaccggaacccgttacgggtacccggttacccgggttacccgttacgggtacccgtaaccgggacccggaaacccggtcgggttaaccccccgg

SEQ ID NO: 255966 - DNA, 872 bp, Homo sapiens
  misc_feature: GYAE6OF01BUTGG.15.31.C09.1.454.CMB.1.raw
tcagtctacgtagccacgaccggtgctcgatttagacgtctcatcaaggaaggaaggggggggtctcaggaggcagcgctctcaggacatctccacatggcctgggctctgctgctcctcaccctcctcactcgagggcacgacgggtcctcgggcccagttctcgccctagactcacgtcctcgccgttccgtgtcgtggttcctcgttaggacagtcgactcctacctatcctcctcgacacgtcgaaccagtcgtaggtcgtacggtttagtaacttactaacgtagttcgtcctaccgtacggtaaccaaccgaaccggaacccgtacggaaccaaaccccgtaccccctaaacgtacgtaacgttgttaacgtttagtacgggtacgtaccgtaacggtaccgtccccggtaacccgttacgggttaacgggtttccttaacgtccgttaccttccgtacgtcggtaccttaacccggtaggttacccgtacgaaccgtaaacccggtacgttccccggtaccccgtttacccgttaacgtcccgttaacggtttccccgtagggttaccgggtaaccccgtaccggttaacggccgggttaagggaccggggtaaccggtacgttacccggttaaagtttaagtttaaccggtttaccgacgggtttaccacgggttaccttacgtaaaccgtaaccgtaacgtaaccggtataccgtaaccggcgtacccgtttaccgggttccgggtttaccgggtcgggtacccgggtaagggtacccgggtaacgtcccgggttacccggtaaccgttacccggttacgtacccgggtaaccggtacccgtcccggtaaccggttaccccgg

SEQ ID NO: 255967 - DNA, 545 bp, Homo sapiens
  misc_feature: GYAE6OF02GQTKG.15.31.C09.1.454.CMB.1.raw
tcagtctacgtagccacgaccggtgctcgatttagacgtctcatcaaggaaggaagggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacagaacccaggacaaagcccccaaactcatgatttatgaggtcagtaatccggcctcaggggtttctaatcgcttctctggctcaagtctggcaacatggccctccctgaccatcctcgtgggcctccgaggctggagggacgaggcttgatttattactgcagctcatactacaagcaagcacgcacgttccgttggggttcgttcggggcgggacgggacccaaggtccgtacggtacccgtccgtaggtccaacggccccgaagggtccccg

SEQ ID NO: 255968 - DNA, 516 bp, Homo sapiens
  misc_feature: GYAE6OF02FIDQC.15.31.C09.1.454.CMB.1.raw
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactccttgtggttttcggcgtagggaccagctgaccgtctaggtcagccaaggctcgcccctcggtcactc

SEQ ID NO: 255969 - DNA, 505 bp, Homo sapiens
  misc_feature: GYAE6OF02GVE6W.15.31.C09.1.454.CMB.1.raw
  modified_base (307)..(307): a, c, t, g, unknown or other
  misc_feature (307)..(307): n is a, c, g, or t
  modified_base (434)..(434): a, c, t, g, unknown or other
  misc_feature (434)..(434): n is a, c, g, or t
  modified_base (449)..(449): a, c, t, g, unknown or other
  misc_feature (449)..(449): n is a, c, g, or t
  modified_base (461)..(461): a, c, t, g, unknown or other
  misc_feature (461)..(461): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctctggtaccaacagaacccaggacaaacgccccaaactcatgatttangagtcagtaatcggcctgtagggtttctaatcgcttctctggctccaagtctggcaacatcggcctcctagaccatctcgtcgggctccgagctaggaggacgaggtctgtatttatactgcagctnatatacaagcagcancactcgttgggngttcggcggaggaccagctagaccgtcgtaggcacgccaggtcc

SEQ ID NO: 255970 - DNA, 527 bp, Homo sapiens
  misc_feature: GYAE6OF02HME4I.15.31.C09.1.454.CMB.1.raw
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaacgcccccaaactcatgatttatgaggtcagtaatcggcctcgtaggggtttctaatcgcttctctgctccaagtctggacaacatcggccctcctgacctatcctcgtcgggcctccgaggctggacggacgaggctagtatttattactgacagctacatatacaagcagcagcacgttcgttgggtcgttcgggcggacggaccaagcgtagaccgtcctaggccacgcccgaaggtcc

SEQ ID NO: 255971 - DNA, 517 bp, Homo sapiens
  misc_feature: GYAE6OF02F9RIR.15.31.C09.1.454.CMB.1.raw
  modified_base (309)..(309): a, c, t, g, unknown or other
  misc_feature (309)..(309): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaacgcccccaaaactcatgatttangaggtcagtaatcggccctcgtaggggtttctaatcgcttctctggctccaagtctggcaacatcggccctccctgaccatctcgtgggcctccgaggctggaggacgaggctgatttattactgcagctcatatacagcagcagcactccgttgggtgttcgggcggaggaccaagctgaccgtcgtaggcacggcccaaggtcccg

SEQ ID NO: 255972 - DNA, 503 bp, Homo sapiens
  misc_feature: GYAE6OF02JC6QI.15.31.C09.1.454.CMB.1.raw
tcagtctacgtagccacgaccggtgctcgatttagacgtctcatcaaggaaggaagggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaagcccccaaactcatgatttatgaggtcagtaatcggccctcaggggtttctaatcgcttctctggctccaagtctggcaacatggcctccctgaccatctctgggctccaggctgaggacgaggctgattattactgcagctacatatacaagcagcagcactccgttggtgttcggcggtaggaccaagctgaccgtcgtacgtcacgcccaggtcc

SEQ ID NO: 255973 - DNA, 707 bp, Homo sapiens
  misc_feature: GYAE6OF02G6FTQ.15.31.C09.1.454.CMB.1.raw
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgccccgtgtctggtcgtcttgtcgacgtcgctcaccactctcctcgtcgacctacggtaaccgaacgcgacgtaggtacggttacgggtttacgttaatttaaactaaacttgttccgttcccttcgggttaaccgtaaaccaacgaaaccccgaaccggacgaaaaccgaacccccgaaaccctaacactagtatttaattgaggtacgtaacgtaagtaccggccccgtctaggggtttacgttaactacgtcttcttcgtcgtcgtcctaacgtcgtcggtcgaaccagtcggcccgtccctcgaccgtactcgttctcggggctcccgtaggacgtgacgggaacgacgggcgtcgtaattacgtttactcgacgacgtctcctataacttaccaaagcgaccgacgacgacctacctttccgttcggggttgtttccggggaccgggacggggtaaccgaaacgtcgtaccggttaccggtacccgttacgggttaccgccgaacccggtacgggacgttcccccgg

SEQ ID NO: 255974 - DNA, 541 bp, Homo sapiens
  misc_feature: GYAE6OF02F3W0A.15.31.C09.1.454.CMB.1.raw
  modified_base (314)..(314): a, c, t, g, unknown or other
  misc_feature (314)..(314): n is a, c, g, or t
  modified_base (378)..(378): a, c, t, g, unknown or other
  misc_feature (378)..(378): n is a, c, g, or t
  modified_base (440)..(440): a, c, t, g, unknown or other
  misc_feature (440)..(440): n is a, c, g, or t
  modified_base (449)..(449): a, c, t, g, unknown or other
  misc_feature (449)..(449): n is a, c, g, or t
tcagtctacgtagccacgaccggtgctcgatttagacgtctcatcaaggaaggaagggggggtctcaggaggcagcgctctcaggacatctccaccatggcctgggctctgctgctcctcaccctcctcactcgagggcacgagggtcctgggcccagtctgccctgactcagcctgcctccgtgtctgggtctcttggacagtcgatcaccatctcctgcactggaaccagcagtgacgttggtacttataactatgtctcctggtaaccaacagaacccaggccaaacgcccccaaaactcaatgtatttangaaggtcagtaatcggccctgaggggtttcaatcgctttctctggcctcaagttctggacaacntcggccctacccgtgaccatctcgtgggcctaccgaggctgaggacgaggctgatttatacngcagtctanaattatacaagcagcagcacttccgtgggtgttcgggcgggaagggtaccaaggctacggaccgttctacggtcacggtccccgaagtcccg

SEQ ID NO: 255975 - DNA, 560 bp, Homo sapiens
  misc_feature: GYAE6OF02FZBCP.15.31.C09.1.454.CMB.1.raw
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacagaacccagcaaacgcccccaaactcatgatttatgaggtcagtaatccggcctctaggggtttctaatcgcttctctgctccagtctggacaacatcggcctccctcgaccctactcctcgtgggtcctccgacggctaggacggacgagggcttagatttacttacgtgctagcctcaatataacaagcgagcagcctaccgttccgttgggtcggttcgggcggaacgggaccaaggtccgtacgtacccggtccgtacggtaccgaccggacccgaaggtcccg

SEQ ID NO: 255976 - DNA, 524 bp, Homo sapiens
  misc_feature: GYAE6OF02GCWL2.15.31.C09.1.454.CMB.1.raw
  modified_base (434)..(434): a, c, t, g, unknown or other
  misc_feature (434)..(434): n is a, c, g, or t
  modified_base (452)..(452): a, c, t, g, unknown or other
  misc_feature (452)..(452): n is a, c, g, or t
  modified_base (456)..(456): a, c, t, g, unknown or other
  misc_feature (456)..(456): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacagaacccaggaccaaacgcccccaaaactcaatgatttatgaggtcagtaactcggccctcgtaggggtttctaatcgtcttctctgctccaagtctgacaacatcgcctccctgaccatctcgtggcctcgaggctggacggacgaggcttgattattacngtcagctgatatacgaancgancagccactccgttgggtcgtcggcgggacggaccagctgaccgtcgtaggtcgacggccgaggtcccg

SEQ ID NO: 255977 - DNA, 676 bp, Homo sapiens
  misc_feature: GYAE6OF02HR11I.15.31.C09.1.454.CMB.1.raw
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtaacttataactatgtctcctggtaccaacagaacccaggaccaaacgcccccaaactcaatgatttatgtaggtacagtaactccggccctcgtaggggtttactaagtcgtacttctcgtggctccaagtctggacaactatcggccctcctacgtacccattcctcgtcgggtcctccgaggtcgtaggacgggtacggaggcgttacggtaatttaacgtttacgttcggactacggtcttacaattaactaaccgaaacggactaacggactaacggacccttaaccgttccgggttttaggggtccgggttttacccggggacggggtaaccgggggtaaccctaacggtaccggttaccggtaacccccgggttacccgtaacggggttacccgtaacccgggtacccggtaaacccgggtcccgg

SEQ ID NO: 255978 - DNA, 524 bp, Homo sapiens
  misc_feature: GYAE6OF02F00R0.15.31.C09.1.454.CMB.1.raw
  modified_base (427)..(427): a, c, t, g, unknown or other
  misc_feature (427)..(427): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaacgccccaaatcatgatttatgaggtcagtaatcggccctgaggggtttcaatcgcttctctggctacaagtctggcaacatcggcctcctgaccatctcgtgggcctccgaggctggacggacgaggctagatttattacngcagctcatatacaagcagcagcacgttcgttgggtcgttcggcgggtagggaccaaggtcgtacggaccgtcgtacggtccacggcccaggtcccg

SEQ ID NO: 255979 - DNA, 674 bp, Homo sapiens
  misc_feature: GYAE6OF02G35WV.15.31.C09.1.454.CMB.1.raw
  modified_base (230)..(230): a, c, t, g, unknown or other
  misc_feature (230)..(230): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccngcagtgacgttgtacttataactatgtctccgtagtaccaacacgaacccaggacaaaccgacccccaaactcatgtatttagtggaggtcaagttaacgtccggcccttacgtaggggtttactaagtccgtctttctcgtggtcctaccgtaagtcgtggacaactacgtcggtccctcccgtacgacctattccgtccgtcgggtacctccggacggcgtaggacgggacggaggtccttaggtaattttacgtactcgactacggtactacgtaattaacgtaaaccgaaggtccaagtccgaaacgtcccttaaccggttccggtttaggggttccggtttacggggaccgggggtaacggaaacccgtaacggtccgtaaccgggttacccggttaccggtaacggtaccggaccggtaccccggtacggtcccccgg

SEQ ID NO: 255980 - DNA, 556 bp, Homo sapiens
  misc_feature: GYAE6OF02JLO2J.15.31.C09.1.454.CMB.1.raw
  modified_base (231)..(231): a, c, t, g, unknown or other
  misc_feature (231)..(231): n is a, c, g, or t
  modified_base (312)..(312): a, c, t, g, unknown or other
  misc_feature (312)..(312): n is a, c, g, or t
  modified_base (394)..(394): a, c, t, g, unknown or other
  misc_feature (394)..(394): n is a, c, g, or t
  modified_base (437)..(438): a, c, t, g, unknown or other
  misc_feature (437)..(438): n is a, c, g, or t
  modified_base (463)..(463): a, c, t, g, unknown or other
  misc_feature (463)..(463): n is a, c, g, or t
tcagtctacgtagccacgaccggtgctcgatttagacgtctcatcaaggaaggaaggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccngcagtgacgttggtacttataactatgtctcctaggtaccaacagaaccacggcaaacgccccaaacgtcactgactttangagtcaagtatcggcctctaggggtttctaagtcgctttactcgtaggctacgaacgtcttaggcaacatcggcctcccgtnaccgatcgtctgggctccgagctgaggcgagctgtattgtacnncgagtcacataactagacgacgacncaggacctactccggtttgggacgttccgggccggtaaggaccgaacgcgttacggacccgtaccgtacgtcgacggtcccgtaaggccccgg

SEQ ID NO: 255981 - DNA, 552 bp, Homo sapiens
  misc_feature: GYAE6OF02HNWED.15.31.C09.1.454.CMB.1.raw
  modified_base (350)..(350): a, c, t, g, unknown or other
  misc_feature (350)..(350): n is a, c, g, or t
  modified_base (372)..(372): a, c, t, g, unknown or other
  misc_feature (372)..(372): n is a, c, g, or t
  modified_base (434)..(434): a, c, t, g, unknown or other
  misc_feature (434)..(434): n is a, c, g, or t
  modified_base (443)..(443): a, c, t, g, unknown or other
  misc_feature (443)..(443): n is a, c, g, or t
tcagtctacgtagccacgaccggtgctcgatttagacgtctcatcaaggaaggaagggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctgtaccaacagaacccaggacaaacgcccccaaaactcatgatttatgaggtcagtactcggcctagtagggtttctaatcgcttcnctggctaccaagtctggcaacntcgccctcctagaccatcctcgtcgggctccgagctggaggacgagcttgtattactttacngtcagtctnaatactaacaagcaagcgacgacctacgttccggttcgggtcgtttcggggacgggtacggaaccgtaagccgttacggacccgtcgtagtccgacgaccgaggtcccg

SEQ ID NO: 255982 - DNA, 615 bp, Homo sapiens
  misc_feature: GYAE6OF02GHAPG.15.31.C09.1.454.CMB.1.raw
  modified_base (231)..(231): a, c, t, g, unknown or other
  misc_feature (231)..(231): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatcctcctgcactggaaccngcagtgacgttgtacttataactatgtctctgtaccaacacgaaccagcaaacgccccaaactcatgatttatgaggtcagtaatcggccctcgtacggggtttctaactcgtcttctctgctacaagtctggacaactatcggcctcccgtcgacctattcctcgtcgggtcctccgacggtcgtacggaacgggacggacggtacgtacgtaatttaacttacgtcgacgtagtactactaacgttactaacgaacgtacaacgtcacgacctaccgttccgttgggttacggttaccggggccggtaacgggtaacccgtaacggtccgtacggtacccgtccggtaaccggtaccgtaccggtacccgaaggtaccccgg

SEQ ID NO: 255983 - DNA, 554 bp, Homo sapiens
  misc_feature: GYAE6OF02FVL8E.15.31.C09.1.454.CMB.1.raw
  modified_base (231)..(231): a, c, t, g, unknown or other
  misc_feature (231)..(231): n is a, c, g, or t
  modified_base (364)..(364): a, c, t, g, unknown or other
  misc_feature (364)..(364): n is a, c, g, or t
  modified_base (375)..(375): a, c, t, g, unknown or other
  misc_feature (375)..(375): n is a, c, g, or t
  modified_base (395)..(395): a, c, t, g, unknown or other
  misc_feature (395)..(395): n is a, c, g, or t
  modified_base (428)..(428): a, c, t, g, unknown or other
  misc_feature (428)..(428): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgcccctgactcagcctgcctccgtgtctgggtctcttggacagtcgatcaccatctcctgcactggaaccngcagtgacgttgtacttataactatgtctctgtaccaacagacccaggcaacgccccaaatcatgtattatgagtcagtaagtcggccctcgtagggtttctaatcgtcttctctgtctcaagtctagcaacntcgcctccctnacctatctcgtcggctccgngcgtggacggacgaggtctagtatttattacgngtcacgctacatataccgagcgacgtcaacgtcctacgtccgttcgggtggttccgggacggtacggaacctacggtccgtaccggtaccgtacgttacggtaccacccggtaccgcggtaccccg

SEQ ID NO: 255984 - DNA, 644 bp, Homo sapiens
  misc_feature: GYAE6OF02HSQZ1.15.31.C09.1.454.CMB.1.raw
  modified_base (494)..(494): a, c, t, g, unknown or other
  misc_feature (494)..(494): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctggtctcgttggacagtcgatcaccatctcctgcactgaaccagcaggtgacgttgtacttataactatgtctctaggtaccaacacgaaccaggacaaaccgacccccaaatcatgtaatttagtgacggtacaagtaacgtccggacccttggtacggggtttctaacgttcgtcttctcgttcggcctacgtaagtctaggaccaactacgtcggtaccctcccgtacgaacctactccgtcgtcgggtacctcccggaggtccgtacggaggtacggaggtcgttaggtaattacgtttaccgngacgacgtctactaagttaactaacgaacgactacgactaacgccttaccggttcgtttggggtcggtttaccggggacgggtaaccgggaacgtaacgtccgtaacggtcccgtaccggtagtacccggacgtacccggtagtccccgg

SEQ ID NO: 255985 - DNA, 698 bp, Homo sapiens
  misc_feature: GYAE6OF02JFFKN.15.31.C09.1.454.CMB.1.raw
  modified_base (450)..(450): a, c, t, g, unknown or other
  misc_feature (450)..(450): n is a, c, g, or t
  modified_base (689)..(689): a, c, t, g, unknown or other
  misc_feature (689)..(689): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacgacgggtcctgggcccagtctcgccctgactcacgcctgcctccgtgtcgtgggtctcttggacagtcgatcaccatctcctgcactcggaaccagcgaggtcgacgtttggttaacttaataacttatcgttctcctaggtaaccaaacacgaaaccctaggaccaaaaccggacccccaaacgtcacttagtactttaatacggtacggtacaacggttaagtccggacccctacggtacggggttttaaccaactccggttcttctccgttggaccttaaccgtaagtcgttacggactaaaccgngtccggacccttccgcgtacctactccgtacgtcgggtccctacccgttaggaccgttacgggagggtaaccggtagggtcttacgttaactttaacgttcgtcgtacgaaccggtctaactaccgttaactaaacgtacacggtacgaccctacgtaactccgttacgtcgggttacgggtcggacgggtaacggactagccgtttaacggccgttacggtacgtacgccggttaccncggtacccg

SEQ ID NO: 255986 - DNA, 558 bp, Homo sapiens
  misc_feature: GYAE6OF02FFWOY.15.31.C09.1.454.CMB.1.raw
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
  modified_base (393)..(393): a, c, t, g, unknown or other
  misc_feature (393)..(393): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctccngcactggaaccngcagtgacgttgacttatactatgtctctggtaccaacagaacccaggcaaagcccccaaaatccatcgatttatgaggtcagtaatcggccctcgtagggggtttctaaatcggctttctctggcctacaagtctggacaacatggccctccctgaccatcncgtggcctcccagggtctggagggacgaggtctagtactttaattactgacagtctcaatactacaagcagcacggcaccttaccgttgggtcgttcgggacgggaggacccaaggtccgtggaaccccgttcgtaacggtcaaccggaccgtacggtaccccgg

SEQ ID NO: 255987 - DNA, 693 bp, Homo sapiens
  misc_feature: GYAE6OF02IW8KM.15.31.C09.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (227)..(227): a, c, t, g, unknown or other
  misc_feature (227)..(227): n is a, c, g, or t
  modified_base (301)..(301): a, c, t, g, unknown or other
  misc_feature (301)..(301): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctctggacngtcgatcacntctctgcactggaaccngcagtgacgttgtactataactatgtctcctgtaccaacagaacccaggacaacgaccccaactcatgatttangaggtcagtactccggcctcgtagggtttctaagtccgtcttcgtcgtggacctctaaggtctggtaccaactagtcggtcccctcccgtacgacctacgtcctcggtcgggtaccctccggtacggtacttagggaacgggtaccggacgggtactttcggtaaattttaaccgttacgtacgtccgaacggttcctactaaattacgtaaccgaacgggtaaccgtacgaccgtaacgtaccctacccgtttcggggttaccggggtttcggttacccggggtaacgggggtaaccggtaacccggtaaaccggttcggttacccgggtaaccccggtttccggtaaccggttaccgaacccggttaaccccgggacggttaccccccgg

SEQ ID NO: 255988 - DNA, 533 bp, Homo sapiens
  misc_feature: GYAE6OF02G2S0P.15.31.C09.1.454.CMB.1.raw
  modified_base (310)..(310): a, c, t, g, unknown or other
  misc_feature (310)..(310): n is a, c, g, or t
  modified_base (320)..(320): a, c, t, g, unknown or other
  misc_feature (320)..(320): n is a, c, g, or t
  modified_base (341)..(341): a, c, t, g, unknown or other
  misc_feature (341)..(341): n is a, c, g, or t
  modified_base (380)..(380): a, c, t, g, unknown or other
  misc_feature (380)..(380): n is a, c, g, or t
  modified_base (401)..(401): a, c, t, g, unknown or other
  misc_feature (401)..(401): n is a, c, g, or t
  modified_base (475)..(475): a, c, t, g, unknown or other
  misc_feature (475)..(475): n is a, c, g, or t
  modified_base (484)..(484): a, c, t, g, unknown or other
  misc_feature (484)..(484): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatcgtctcctggtaccaacacgaacccaggcaaacgcccccaaactcatgatttangagtcagtancgcctgaggttcatcgcttcnctgctcagtctggcaacatcggcctccagaccatctcgnggctcaggctaggacggacgnggtctaggtatttaacgtactgaccgtagcctacgtaatacgtacaagtcagcacgctaccgttcgtttgggtnttaccgggnggtaccggacacgtcgtacgaccgtacgttacggcacggccgagtcccg

SEQ ID NO: 255989 - DNA, 598 bp, Homo sapiens
  misc_feature: GYAE6OF02HVQEK.15.31.C09.1.454.CMB.1.raw
  modified_base (311)..(311): a, c, t, g, unknown or other
  misc_feature (311)..(311): n is a, c, g, or t
  modified_base (389)..(389): a, c, t, g, unknown or other
  misc_feature (389)..(389): n is a, c, g, or t
tcagtctacgtagccacgaccggtgctcgatttagacgtctcatcaaggaaggaagggggggggtctcaggaggcagcgctctcaggacatctccaccatggcctgggctctgctgctcctcaccctcctcactcagggcacagggtcctgggccccagtctgccctgactcagcctgcctccgtgtctgggtctcttggacagtcgatcaccatctcctgcactcggaaccagcagtgacgttggtacttataactatgtctctggtaccaacagaacccagacaaacgccccaaatcatagtatttagngagtcagtagtccggcctcgaggtatttacgtaatcgtcttctctcggcctcaagtcgtagacaacatcgcctccctnaccatctcgtcgcgtccaggtcaggtacggacggaggtactgtaacttattacgcgtccaagtcctagacttaactaacgaagtcaacgcaacgacctaccgttaccggtttgggtccgggttcgggtaccgggtaacggggaaccgtacggtccgtacggttacccggttacccgttacgggtaccctaccgtacccggtaacccggg

SEQ ID NO: 255990 - DNA, 678 bp, Homo sapiens
  misc_feature: GYAE6OF02GUNAE.15.31.C09.1.454.CMB.1.raw
  modified_base (233)..(233): a, c, t, g, unknown or other
  misc_feature (233)..(233): n is a, c, g, or t
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacgagggtcctgggcccagtctgccctgactcagcctgcctccgtgtcgtgggtctcttggacagtcgatcaccatctcctgctactggaaccngcagtgacgttgtacttatactatgtctctgtaccaanacgaaccaggacaaacgccccaatcatgattangagtcagtatccgcctcgtagggttactagtcgtcttactctcggtacctacgtaacgtcgtacgacaatacgtcggtcctccctagacctagtcctcggtcggcctacgacggtctaggtacggacggtacgtacttagtaactttacgtaccgtgaacgtacggtccttaacgtaaccttacgtaaaccgaacggacgaccggtaacgacgtaacccgttaccgttacccgggttttgggttaacccggtttaccgggggaaccgggttaaaccgggttaacccggaacggttaacccggtacggttaacccccggttcccggttaacggggtaccctaaccccggttacccgggtaaccggttacccccgg

SEQ ID NO: 255991 - DNA, 617 bp, Homo sapiens
  misc_feature: GYAE6OF02IP5N4.15.31.C09.1.454.CMB.1.raw
  modified_base (308)..(308): a, c, t, g, unknown or other
  misc_feature (308)..(308): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacgagggtcctgggcccagtctgccctgactcagcctgcctccgtgtctgggtctcttggacagtcgatcaccatctcctgcactgggaaccagcagtgacgttggtacttataactatgtctcctggtaccaacagaacccaggcaaacgccccaaatcatgatttangagtcagtaatcggccctcgtaggggtttctaatcgtcttctctcggtactcctaagttctaggaccaactatcggtccctcccgtacgaccattcgtccgtcgggacctcccgaggtccgtaggacggacggaggtcgttaggtaactttacgttactcgacgtacgtcttacctaattactaaccgaagcgaagcgagacctaccgttccggtttggggttcggttccggggacgggacgggtaccaacggtcgttacggacccggttacgttaccgggtctaaccggtaccccggaaggtccccgg

SEQ ID NO: 255992 - DNA, 747 bp, Homo sapiens
  misc_feature: GYAE6OF02HWQI4.15.31.C09.1.454.CMB.1.raw
  modified_base (283)..(283): a, c, t, g, unknown or other
  misc_feature (283)..(283): n is a, c, g, or t
tcagtctacgtagccacgaccggtgctcgatttagacgtctcatcaaggaaggaaggggggggtctcaggaggcagcgctctcaggacatctccaccatggcctggctctgctgctcctcaccctcctcactcaggcacagggtcctgggcccagtctgccctgactcagcctgcctcgtgtctgggtctcgttggactagtcgatccactatctcctgctactaggaaccagcagtgtacgttgtacttataactatgtctcgtagtaccaacgacgaaccnggacaaaccgaccccaaatcatagtatttacgtagtacggtactaacgtaacgtccggtacccgttacggtacggggttttactaacgttccgctttctcgtacggtccttacgtaacgtcgtacggactaacgtacgttccggtaccctccacgtacctagtttacccgttccggtcgggttccctaccggtacgtacccgggtgggaacgggaacccggtaggtccgttaagttaacgtttacgtacgttacgtaccgtaacgttaccttacgtaaacttaacgtaaccgaacggtaccgaacgtacccgtagtaaccccgttaccgggtttcccgggtttcggggttaccggttttccgggggaaaccgggtaccgggtaaaccctacgggttacccgtacccggtacccggttaccggtaaccggttacccgaaacccggttcccgaaccgggttccccg

SEQ ID NO: 255993 - DNA, 676 bp, Homo sapiens
  misc_feature: GYAE6OF02F6O3K.15.31.C09.1.454.CMB.1.raw
  modified_base (202)..(202): a, c, t, g, unknown or other
  misc_feature (202)..(202): n is a, c, g, or t
  modified_base (232)..(232): a, c, t, g, unknown or other
  misc_feature (232)..(232): n is a, c, g, or t
tcagtctacgtagccacgaccggtgctcgatttagacgtctcatcaaggaaggaagggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacngtcgatcaccatctcctgccactggaaccngcagtgacgttggtaacttataactatgtctccgtagtaccaacacgaacccaggaccaaacgcccccaaactcatgtaattagtgaggtacagtaactccggccctggtacgggtttactaacgtcctactttcctacgtcggtacctaccgtaacgtcgtacggacctaactacggtaccggtccccttacccgtacgaaccctacgttccgtccggttacgggtcctaccggacggtacgtacgggacgggtaccggacggttcgtagtaatttacgtacgtgacctacgtctaactattacgtaacgaacgtcgaacgtctacgtaccttaccgttcgggttagggtcggttacgggacgggtaacggtaccgtaacggtaccgtaccggtacccgttaccggtaacggtaccgaacccggtacccgtaggtacccccgg

SEQ ID NO: 255994 - DNA, 697 bp, Homo sapiens
  misc_feature: GYAE6OF02FN71O.15.31.C09.1.454.CMB.1.raw
  modified_base (306)..(306): a, c, t, g, unknown or other
  misc_feature (306)..(306): n is a, c, g, or t
tcagtctacgtagccacgaccggtgctcgatttagacgtctcatcaaggaaggaaggggggggtctcaggaggcagcgctctcaggacatctccaccatggcctgggctctgctgctcctcaccctcctcactcagggcacagggtcctgggcccagtctgccctgactcagcctgcctcgtgtctgggtctcttggacagtcgatcaccatctcctgcactggaaccagcagtgacgttggtacttataactatgtctcctggtaccaacagaacccaggcaaacgccccaaactcatgatttangagtcagtaatcggcctcgaggggtttctaatcgtacttctctgctacaagtctaggacaacatcggcctccctgaccactactcgtcgggccttccgaggtcgtacggtacgggaacggacgggtaccgttaggtaacttttaacgttaaccgttcgacgtacgtaccgtactaacgttacgtaaaccgtaaacgtccgaaacgaccgtaacggtaccgtaacccgtttacccggttttacgggggttccggttttaccgggggacccggggtaaaccgggggtaaacccccgtaaagggttacccggttaaccgggtaaccccgggtttacccggtttaaccggggtacccgttaacccgggaccccgtaaacccggggttccccccgg

SEQ ID NO: 255995 - DNA, 656 bp, Homo sapiens
  misc_feature: GYAE6OF02GT4TX.15.31.C09.1.454.CMB.1.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (317)..(317): a, c, t, g, unknown or other
  misc_feature (317)..(317): n is a, c, g, or t
tcagtctacgtagccacgaccggtgctcgatttagacgtctcatcaaggaaggaagggggggggtctcaggaggcagcgctctcaggacatctccaccatggcctgggctctgctgctcctcaccctcctcactcagggcacagggtcctgggcccagtctgccctgactcagcctgcctccgtgtcgtggtctcttggacngtgactcaccatctctgctactggaaccngacagtgacgttggtacttactaactatcgtcctcgtacgtaccaacacgaacccaggaccaaacgccccaaatcgatagtattanggtacgtatagtaacgtccgacctcggttacgggttactaagtcgtcttctctcggtctaccgtagtcgtaggactaacctgtccggtacctccctaggaccctagtaccctacggtcgggtcctcggaacggtcgtagggaccggtacggagtcgtagttaactttaactcgtcgtacacgtactaacgaattacgtaagaaccgcgaacgaccgtaacgccgtacgtttcccggttagggttacgggttccgggaacgggtaccgggaaccgttaacgtaccggttacgtacccggttacgtaaccggtacgtaccggacccgtacccggtacccgg

SEQ ID NO: 255996 - DNA, 820 bp, Homo sapiens
  misc_feature: GYAE6OF02HY9WG.15.31.C09.1.454.CMB.1.raw
  modified_base (152)..(152): a, c, t, g, unknown or other
  misc_feature (152)..(152): n is a, c, g, or t
  modified_base (287)..(287): a, c, t, g, unknown or other
  misc_feature (287)..(287): n is a, c, g, or t
tcagtctacgtagccacgaccggtgctcgatttagacgtctcatcaaggaaggaaggggggggtcgtcgaggaggcgagcggctctcaggacatctccaccatggcctggctctgctgctcctcaccctcctcactcgaggcacagggtccngggccctagtcgtcgcccgtgacctcacgcctgccctacgtgtcgtgggtctcgttgggaacaggttcactccacctatcgtcctgctacgacggaaactgctaacgtggtacgtttggaactattaacgtagtnttactcgtacggtactaacgacgaaccgaggacaaaccgtacccaaccttaacactacgaacttaagtgtaactcgaagttaaactccggtaccgtaccgtaggggtttactaagttccgacttccgtacgttcggacttacgtacgtcgtacgtacgtaactacgtcggtaccctccgtcgtacctaacgtccgttacgtacgggtcccgttacggtacggtaccgtcgaacggggtaccgggtacgttacggtaacgttaaagtttaccgttaacgttacgggctaacggtccgtaactttaacgggtaaacctttaaaccgaaaccggtaccgttaaacgacccgttaaacgacccgtttaaacccgtttcccgggtttaacgggtttccgggggttaacccgggggacccggggttaaaccgggtttaaacccgaaacccgggtttcggttacccggtaaccccggggtttcccgggaaaccgggttaacccgtaccccgggttaaccggaaaccggggttccccccgg

SEQ ID NO: 255997 - DNA, 649 bp, Homo sapiens
  misc_feature: GYAE6OF02FWOFA.15.31.C09.1.454.CMB.1.raw
  modified_base (360)..(360): a, c, t, g, unknown or other
  misc_feature (360)..(360): n is a, c, g, or t
  modified_base (604)..(604): a, c, t, g, unknown or other
  misc_feature (604)..(604): n is a, c, g, or t
tcagtctacgtagccacgaccggtgctcgatttagacgtctcatcaaggaaggaagggggggggtctcaggaggcagcgctctcaggacatctccaccatggcctgggctctgctgctcctcaccctcctcactcgagggcacgagggtcctgggcccagtctcgccctgactcagcctgcctccgtgtctgggtctcgttaggacagtcgatcacctatcctcctgcctactacgggaaccaggctaggtcggtaacggtttcggttaacttaactaactatcgttacctaccgtacggtaaccaacgtaacgaaccccgaggaaccaaaccgacccccaaatacctatacgtattagnggacgtactagtaacgtccgcccgttgtacgggttactaactccgtacttccgtcgtcgaccttaccgtagtaccgtcggaacctaacgtacgtccggtcccttcccacgacctacgttccgtcggtacggtcctaccgagggtcgtacggacggaccgtgtcgttagtactttacacgtgactactctacaagttcaacgagcagcaccgtactcgttcgggttggcggtacgggcggtaacncggtacgtcgtaccggtcgtccgagcccgacggtccgagtccccg

SEQ ID NO: 255998 - DNA, 267 bp, Homo sapiens
  misc_feature: GYAE6OF01E1O9P.11.41.D08.1.454.CMB.1.raw
  modified_base (265)..(267): a, c, t, g, unknown or other
  misc_feature (265)..(267): n is a, c, g, or t
tcagcgagagataccacgaccggtgctcgatttagtcacgcgagaaagggaaaggggatatagtggctacaatcggccctactacggtatggacgtctggggccaagggaccacggtcaccgtctcctcagcctccaccaagggcccatcggtcttccccctggcaccctcctccaagagcacctctggggcacagcggccctgggctgcctggtcaaggactacttccgtatctctcgctgagcgggctggcaaggcgcatagnnn

SEQ ID NO: 255999 - DNA, 265 bp, Homo sapiens
  misc_feature: GYAE6OF01CCRWO.11.41.D08.1.454.CMB.1.raw
  modified_base (264)..(265): a, c, t, g, unknown or other
  misc_feature (264)..(265): n is a, c, g, or t
tcagcgagagataccacgaccggtgctcgatttagtcacgcgagaaagggaaaggggatatagtggctacaatcggccctactacggtatggacgtctggggccaagggaccacggtcaccgtctcctcagcctccaccaagggcccatcggtcttcccctggcaccctcctccaagagcacctctggggcacagcggccctgggctgcctggtcaaggactacttccgtatctctcgctgagcgggctggcaaggcgcatagnn

SEQ ID NO: 256000 - DNA, 268 bp, Homo sapiens
  misc_feature: GYAE6OF01EG9CN.11.41.D08.1.454.CMB.1.raw
  modified_base (266)..(268): a, c, t, g, unknown or other
  misc_feature (266)..(268): n is a, c, g, or t
tcagcgagagataccacgaccggtgctcgatttagtcacgcgagaaagggaaaggggatatagtggctacaatcggccctactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgtatctctcgctgagcgggctggcaaggcgcatagnnn

SEQ ID NO: 256001 - DNA, 265 bp, Homo sapiens
  misc_feature: GYAE6OF01CQL4N.11.41.D08.1.454.CMB.1.raw
  modified_base (259)..(265): a, c, t, g, unknown or other
  misc_feature (259)..(265): n is a, c, g, or t
tcagcgagagataccacgaccggtgctcgatttagtcacgcgagaaagggaaggggatatagtggctacaatcggcctactacggtatggacgtctgggccaagggaccacggtcaccgtctcctcagcctccaccaagggcccatcggtcttccccctggcaccctcctccaagagcacctctggggcacagcggcctgggctgcctggtcaaggctacttccgatctctcgctgagcgggctggcaaggcgcatagnnnnnnn

SEQ ID NO: 256002 - DNA, 270 bp, Homo sapiens
  misc_feature: GYAE6OF01BW0JA.11.41.D08.1.454.CMB.1.raw
  modified_base (267)..(270): a, c, t, g, unknown or other
  misc_feature (267)..(270): n is a, c, g, or t
tcagcgagagataccacgaccggtgctcgatttagtcacgcgagaaagggaaagggggatatagtggctacaatcggccctactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgtatctctcgctgagcgggctggcaaggcgcatagnnnn

SEQ ID NO: 256003 - DNA, 267 bp, Homo sapiens
  misc_feature: GYAE6OF01D384E.11.41.D08.1.454.CMB.1.raw
  modified_base (266)..(267): a, c, t, g, unknown or other
  misc_feature (266)..(267): n is a, c, g, or t
tcagcgagagataccacgaccggtgctcgatttagtcacgcgagaaagggaaagggggatatagtggctacaatcggccctactacggtatggacgtctggggccaagggaccacggtcaccgtctcctcagcctccaccaagggcccatcggtcttccccctggcaccctcctccaagagcacctctggggcacagcggccctgggctgcctggtcaaggactacttccgtatctctcgctgagcgggctggcaaggcgcatagnn

SEQ ID NO: 256004 - DNA, 270 bp, Homo sapiens
  misc_feature: GYAE6OF01ALWKA.11.41.D08.1.454.CMB.1.raw
  modified_base (266)..(270): a, c, t, g, unknown or other
  misc_feature (266)..(270): n is a, c, g, or t
tcagcgagagataccacgaccggtgctcgatttagtcacgcgagaaagggaaagggggatatagtggctacaatcggccctactacggtatggacgtctggggccaagggaccacggtcaccgtctcctcagcctccaccaagggcccatcggtcttccccctggcaccctcctccaagagcacctctggggcacagcggccctgggctgcctggtcaaggactacttccgtatctctcgctgagcgggctggcaaggcgcatagnnnnn

SEQ ID NO: 256005 - DNA, 270 bp, Homo sapiens
  misc_feature: GYAE6OF01EIGDK.11.41.D08.1.454.CMB.1.raw
  modified_base (265)..(270): a, c, t, g, unknown or other
  misc_feature (265)..(270): n is a, c, g, or t
tcagcgagagataccacgaccggtgctcgatttagtcacgcgagaaagggaaaggggatatagtggctacaatcggccctactacggtatggacgtctggggccaagggaccacggtcaccgtctcctcagcctccaccaagggcccatcggtcttccccctggcaccctcctccaagagcacctctggggcacagcggccctgggctgcctggtcaaggactacttccgtatctctcgctgagcgggctggcaaggcgcatagnnnnnn

SEQ ID NO: 256006 - DNA, 282 bp, Homo sapiens
  misc_feature: GYAE6OF01A7SDA.11.41.D08.1.454.CMB.1.raw
  modified_base (270)..(282): a, c, t, g, unknown or other
  misc_feature (270)..(282): n is a, c, g, or t
tcagcgagagataccacgaccggtgctcgatttagtcacgcgagaaagggaaagggggtagtatagtggctacaatcggccctactacggtatggacgtctgggccaagggaccacggtcaccggtctcctcagcctccaccaagggcccatcggttcttccccctggcaccctcctccaagagcacctctggggcacagcggccctgggctggcctggtcaaggactacttccgtatctctcgctgagcgggctggcaaggcgcatagnnnnnnnnnnnnn

SEQ ID NO: 256007 - DNA, 269 bp, Homo sapiens
  misc_feature: GYAE6OF01DA8XP.11.41.D08.1.454.CMB.1.raw
  modified_base (265)..(269): a, c, t, g, unknown or other
  misc_feature (265)..(269): n is a, c, g, or t
tcagcgagagataccacgaccggtgctcgatttagtcacgcgagaaagggaaaggggatatagtggctacaatcggccctactacggtatggacgtctggggccaagggaccacggtcaccgtctcctcagcctccaccaagggcccatcggtcttccccctggcaccctcctccaagagcacctctggggcacagcggccctgggctgcctggtcaaggactacttccgtatctctcgctgagcgggctggcaaggcgcatagnnnnn

SEQ ID NO: 256008 - DNA, 713 bp, Homo sapiens
  misc_feature: GYAE6OF01BHXY3.11.41.D08.1.454.CMB.1.raw
  modified_base (294)..(294): a, c, t, g, unknown or other
  misc_feature (294)..(294): n is a, c, g, or t
tcagcgagagataccacgaccggtgctcgatttagtcacgcgagaaagggaaaggggtctccgaagcccttcggagaccctgtcccctcaccttgcactgtctctggtgactccatcagtaggtactattggagctggatccggcagcccccagggtaagggactggagtggattgggtaggatgtattacagtggagcacaactacaacccctcctcgaagagtcgagtcaccgatatcagtagacatgtccaagaccagtcgcctccgtgaagtctgagctcgtgtgaccgntgcggacgacggccgtgtacttacgtgcgacggaaaggggataagtagtgactaacgaagtccggtaccctacgtaacggtagtagggaccggtcgtacggggacctaaacgggacccaccgggtaccacccgtctacccgtacgacgtccctacccgaaccgaaccgggcccctaacgttcccgggttaccccttacccccgtggaccccaccccgttcccgtaacccaaacggaccgcctaaccccgtcggtaccggggacaccgacggcccggtacccgtggggtcctacggcccggttacggtaccgaacgggtacctttaaccggttacccggtaacgtttccgtaccgttccggtacgttacgggacgggtcccgggttacgtaccgggacgaaccgggtcgccgtagtacgg

SEQ ID NO: 256009 - DNA, 268 bp, Homo sapiens
  misc_feature: GYAE6OF01A99YJ.11.41.D08.1.454.CMB.1.raw
  modified_base (267)..(268): a, c, t, g, unknown or other
  misc_feature (267)..(268): n is a, c, g, or t
tcagcgagagataccacgaccggtgctcgatttagtcacgcgagaaagggaaagggggatatagtggctacaatcggccctactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgtatctctcgctgagcgggctggcaaggcgcatagnn

SEQ ID NO: 256010 - DNA, 274 bp, Homo sapiens
  misc_feature: GYAE6OF01CNOMC.11.41.D08.1.454.CMB.1.raw
  modified_base (266)..(274): a, c, t, g, unknown or other
  misc_feature (266)..(274): n is a, c, g, or t
tcagcgagagataccacgaccggtgctcgatttagtcacgcgagaaagggaaagggggatatagtggctacaatcggccctactacggtatggacgtctggggccaagggaccacggtcaccgtctcctcagcctccaccaagggcccatcggtcttccccctggcaccctcctccaagagcacctctggggcacagcggccctgggctgcctggtcaaggactacttccgtatctctcgctgagcgggctggcaaggcgcatagnnnnnnnnn

SEQ ID NO: 256011 - DNA, 789 bp, Homo sapiens
  misc_feature: GYAE6OF01CEBKP.11.41.D08.1.454.CMB.1.raw
tcagcgagagataccacgaccggtgctcgatttagtcacgcgagaaagggaaagggtctccgaagccttcggagaccctgtccctcacctgcactgtctctggtgactccatcagtaggtactattggagctggatccggcacgcccccagggaagggactggagtggattggggtggatgtattacaggtgggagcaccaaactaccaacccctccctcaagagtcgagtcaccatatcagtagacatgtaccaaagaaccagtcgcctcccgtagaagcgtgacgctctggtcgacccgcgtcggaccggacgaccgggtccgtagttaacttacgtcggacggtaaccgggaaaaggggggtattaacgtagggtcgggtacctaacgaacggtcccggtaccctaaccgttaacgggtaacgtacgggtaccgttcgggtcggggacccgaaacggggacccgtacggtacccgacccgttccgtcccgtacgacgtcccgtaccccaaccggaaaccgggcccctacgtcccggttcccctttcccccgcggtaccccctaacccgttccccgtaacccgaaaccggccgtacccgtacccgttcccgggtacgggggacccaaccggaccggtccccggggccccggttcggggacccgtccgggtacccgttcggggtaacccgtaaccgggtacccttaacccgtttacccgttacgtcccgttaccgtccggcgttacgggcggtccgggacgtcgggaccgaaggtcccgcgtagtacg

SEQ ID NO: 256012 - DNA, 269 bp, Homo sapiens
  misc_feature: GYAE6OF01BEQ5R.11.41.D08.1.454.CMB.1.raw
  modified_base (267)..(269): a, c, t, g, unknown or other
  misc_feature (267)..(269): n is a, c, g, or t
tcagcgagagataccacgaccggtgctcgatttagtcacgcgagaaagggaaagggggatatagtggctacaatcggccctactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgtatctctcgctgagcgggctggcaaggcgcatagnnn

SEQ ID NO: 256013 - DNA, 267 bp, Homo sapiens; identical to SEQ ID NO: 256003
  misc_feature: GYAE6OF01BBNVZ.11.41.D08.1.454.CMB.1.raw
  modified_base (266)..(267): a, c, t, g, unknown or other
  misc_feature (266)..(267): n is a, c, g, or t

SEQ ID NO: 256014 - DNA, 274 bp, Homo sapiens
  misc_feature: GYAE6OF01B04BR.11.41.D08.1.454.CMB.1.raw
  modified_base (259)..(274): a, c, t, g, unknown or other
  misc_feature (259)..(274): n is a, c, g, or t
tcagcgagagataccacgaccggtgctcgatttagtcacgcgagaaagggaaagggggatatagtggctacaatcggccctactacggtatggacgtctggggccaagggaccacggtcaccgtctcctcagcctccaccaagggcccatcggtcttccccctggcaccctcctccaagagcacctctggggcacagcggcctggctgctggtcagactacttcgtatctctcgctgagcggctggcaaggcgcatagnnnnnnnnnnnnnnnn

SEQ ID NO: 256015 - DNA, 294 bp, Homo sapiens
  misc_feature: GYAE6OF01AEW6G.11.41.D08.1.454.CMB.1.raw
  modified_base (179)..(179): a, c, t, g, unknown or other
  misc_feature (179)..(179): n is a, c, g, or t
  modified_base (232)..(232): a, c, t, g, unknown or other
  misc_feature (232)..(232): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (271)..(272): a, c, t, g, unknown or other
  misc_feature (271)..(272): n is a, c, g, or t
  modified_base (274)..(275): a, c, t, g, unknown or other
  misc_feature (274)..(275): n is a, c, g, or t
  modified_base (277)..(294): a, c, t, g, unknown or other
  misc_feature (277)..(294): n is a, c, g, or t
tcagcgagagataccacgaccggtgctcgatttagtcacgcgagaaagggaaggggatatagtggctacaatcggcccgtactacggtatggacgtctggggccaagggaccacggtcaccgtctcctcagcctccaccaaggcccatcggtcttccccctggccaccctcctccaagngcacctctggggcacagcgccctgggctgcctggtcaaggctacttccgatcnctcgctgagcgggctaggccaaggcgctaatgncatnanncnncnnnnnnnnnnnnnnnnnn

SEQ ID NO: 256016 - DNA, 268 bp, Homo sapiens; identical to SEQ ID NO: 256000
  misc_feature: GYAE6OF02H1R66.11.41.D08.1.454.CMB.1.raw
  modified_base (266)..(268): a, c, t, g, unknown or other
  misc_feature (266)..(268): n is a, c, g, or t

SEQ ID NO: 256017 - DNA, 267 bp, Homo sapiens
  misc_feature: GYAE6OF02FWH6B.11.41.D08.1.454.CMB.1.raw
  modified_base (266)..(267): a, c, t, g, unknown or other
  misc_feature (266)..(267): n is a, c, g, or t
tcagcgagagataccacgaccggtgctcgatttagtcacgcgagaaagggaaaggggatatagtggctacaatcggccctactacggtatggacgtctggggccaagggaccacggtcaccgtctcctcagcctccaccaagggcccatcggtcttccccctggcaccctcctccaagagcacctctgggggcacagcggccctgggctgcctggttaaggactacttccgtatctctcgctgagcgggctggcaaggcgcatagnn

SEQ ID NO: 256018 - DNA, 269 bp, Homo sapiens
  misc_feature: GYAE6OF02HOC9N.11.41.D08.1.454.CMB.1.raw
  modified_base (266)..(269): a, c, t, g, unknown or other
  misc_feature (266)..(269): n is a, c, g, or t
tcagcgagagataccacgaccggtgctcgatttagtcacgcgagaaagggaaaggggatatagtggctacaatcggccctactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgtatctctcgctgagcgggctggcaaggcgcatagnnnn

SEQ ID NO: 256019 - DNA, 268 bp, Homo sapiens; identical to SEQ ID NO: 256009
  misc_feature: GYAE6OF02FK0Y1.11.41.D08.1.454.CMB.1.raw
  modified_base (267)..(268): a, c, t, g, unknown or other
  misc_feature (267)..(268): n is a, c, g, or t

SEQ ID NO: 256020 - DNA, 268 bp, Homo sapiens; identical to SEQ ID NO: 256009
  misc_feature: GYAE6OF02FQZWE.11.41.D08.1.454.CMB.1.raw
  modified_base (267)..(268): a, c, t, g, unknown or other
  misc_feature (267)..(268): n is a, c, g, or t

SEQ ID NO: 256021 - DNA, 271 bp, Homo sapiens
  misc_feature: GYAE6OF02H5RXA.11.41.D08.1.454.CMB.1.raw
  modified_base (263)..(271): a, c, t, g, unknown or other
  misc_feature (263)..(271): n is a, c, g, or t
tcagcgagagataccacgaccggtgctcgatttagtcacgcgagaaagggaaaggggagtatagtggctacaatcggcctactacggtatggacgtctgggccaagggaccacggtcaccgtctcctcagcctccaccaagggcccatcggtcttcccctggcaccctcctccaagagcacctctggggcacagcggccctgggctgcctggtcaaggactacttccgtatctctcgctgagcgggctggcaaggcgcatagnnnnnnnnn

SEQ ID NO: 256022 - DNA, 270 bp, Homo sapiens; identical to SEQ ID NO: 256002
  misc_feature: GYAE6OF02HFVP4.11.41.D08.1.454.CMB.1.raw
  modified_base (267)..(270): a, c, t, g, unknown or other
  misc_feature (267)..(270): n is a, c, g, or t

SEQ ID NO: 256023 - DNA, 271 bp, Homo sapiens
  misc_feature: GYAE6OF02IAR7P.11.41.D08.1.454.CMB.1.raw
  modified_base (266)..(271): a, c, t, g, unknown or other
  misc_feature (266)..(271): n is a, c, g, or t
tcagcgagagataccacgaccggtgctcgatttagtcacgcgagaaagggaaaggggatatagtggctacaattggccctactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgtatctctcgctgagcgggctggcaaggcgcatagnnnnnn

SEQ ID NO: 256024 - DNA, 658 bp, Homo sapiens
  misc_feature: GYAE6OF02G9RR7.11.41.D08.1.454.CMB.1.raw
  modified_base (307)..(307): a, c, t, g, unknown or other
  misc_feature (307)..(307): n is a, c, g, or t
  modified_base (313)..(313): a, c, t, g, unknown or other
  misc_feature (313)..(313): n is a, c, g, or t
  modified_base (321)..(321): a, c, t, g, unknown or other
  misc_feature (321)..(321): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
tcagcgagagataccacgaccggtgctcgattttagtcacgcgagaaagggaaagggggaagtaaggtagtggctaacaatcgggccttactacggtatcggacggtcttgggcctaagggaccacggttcaccgttcttccgtcagccttccgaccaacgggcccgatcggtcttcccctggcaccctcctccaacgagccaccctcgtgggggcacgtacgcggccgtggggctggcctggtcaacggacttacgttccgtaatcctctcgctgtagtcggctcggcaaaggacgacaattacgnctagcngcagaacngacatcctactagtcnctactattcgngcacgtcgtacggcgtccggtcgtacgacgcgtcgacggcgacgtacggcggtcagacgacgacgtacttctactactacgacgtacgtacacgacgtacgtacgtacgcgacgtacgtacgtagtagtacgtacgtacgttacgttacgttacgttacgtacgtacgtacgtacgttacttagttacgtacgttacgttacgtacgttacggttacggtacggtacgtacgtacgtacgtacgtacgtaacgtaacgtaacgtacgtacggtacgtactacgtacgtcgtcgttacgttcgtactctcg

SEQ ID NO: 256025 - DNA, 281 bp, Homo sapiens
  misc_feature: GYAE6OF02GNPBM.11.41.D08.1.454.CMB.1.raw
  modified_base (266)..(281): a, c, t, g, unknown or other
  misc_feature (266)..(281): n is a, c, g, or t
tcagcgagagataccacgaccggtgctcgatttagtcacgcgagaaagggaaagggggatatagtggctacaatcggccctactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgtatctctcgctgagcggctggcaaggcgcatagnnnnnnnnnnnnnnnn

SEQ ID NO: 256026 - DNA, 275 bp, Homo sapiens
  misc_feature: GYAE6OF02IZHU5.11.41.D08.1.454.CMB.1.raw
  modified_base (267)..(275): a, c, t, g, unknown or other
  misc_feature (267)..(275): n is a, c, g, or t
tcagcgagagataccacgaccggtgctcgatttagtcacgcgagaaagggaaagggggatatagtggctacaatcggccctactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgtatctctcgctgagcgggctggcaaggcgcatagnnnnnnnnn

SEQ ID NO: 256027 - DNA, 270 bp, Homo sapiens
  misc_feature: GYAE6OF02HSGUF.11.41.D08.1.454.CMB.1.raw
  modified_base (250)..(250): a, c, t, g, unknown or other
  misc_feature (250)..(250): n is a, c, g, or t
  modified_base (266)..(270): a, c, t, g, unknown or other
  misc_feature (266)..(270): n is a, c, g, or t
tcagcgagagataccacgaccggtgctcgatttagtcacgcgagaaagggaaagggggatatagtggctacaatcggccctactacggtatggacgtctggggccaagggaccacggtcaccgtctcctcagcctccaccaagggcccatcggtcttccccctggcaccctcctccaagagcacctctgggggcacagcggccctgggctgcctggtcaaggctacttccgtatctctcgctgagcgggntggcaaggcgcatagnnnnn

SEQ ID NO: 256028 - DNA, 292 bp, Homo sapiens
  misc_feature: GYAE6OF02INNN3.11.41.D08.1.454.CMB.1.raw
  modified_base (267)..(292): a, c, t, g, unknown or other
  misc_feature (267)..(292): n is a, c, g, or t
tcagcgagagataccacgaccggtgctcgatttagtcacgcgagaaagggaaagggggatatagtggctacaatcggccctactacggtatggacgtctggggccaagggaccacggtcaccgtctcctcagcctccaccaagggcccatcgatcttccccctggcaccctcctccaagagcacctctgggggcacagcggccctgggctgcctggtcaaaggctaacttccgtatctctcgctgagcggctggcaaggcgcatagnnnnnnnnnnnnnnnnnnnnnnnnnn

SEQ ID NO: 256029 - DNA, 276 bp, Homo sapiens
  misc_feature: GYAE6OF02HD846.11.41.D08.1.454.CMB.1.raw
  modified_base (266)..(276): a, c, t, g, unknown or other
  misc_feature (266)..(276): n is a, c, g, or t
tcagcgagagataccacgaccggtgctcgatttagtcacgcgagaaagggaaagggggatatagtggctacaatcggccctactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgatctctcgctgagcgggctggcaaggcgcatagnnnnnnnnnnn

SEQ ID NO: 256030 - DNA, 757 bp, Homo sapiens
  misc_feature: GYAE6OF02F0GPX.11.41.D08.1.454.CMB.1.raw
  modified_base (460)..(460): a, c, t, g, unknown or other
  misc_feature (460)..(460): n is a, c, g, or t
tcagcgagagataccacgaccggtgctcgatttagtcacgcgagaaagggaaagggtctccgaagccttcggagaccctgtccctcacctgcactgtctctggtgactccatcagtaggtactattggagctggatccggcagcccccagggaagggactggagtggattggggtggatgtattacaggtgggagcaccaacgtaccaaccccctccctacaagagtccgagtcaccaatatcagtagacatgtaccaagaaccacgtgcctccgtagactcgtagagcttctagtcggaccgcgtgaccggacgaccggccgttagtacttacgtggacggtacgggaaacgggggtataggtaggttcggtactacgtaacgtccggtaccctaacgtacggttacgtgggaccgttacgggacggggtaccggaaacggggtccgaaccgggtaccncccggttactcccgtacgacgtcccctaccgaacccggaacgggtcccctaacggttccggtaccccgtttcccccggtacggtccccgtaaccctcccgttaacccgaacgtaccgtcccttaacccggccgttcggggaccacgtacccgggccggtacccggtgggactccggtaccgttacgggacccgtaacgggtaccttccgtttacccgtacgttcccgttaacgtcgtacggtccggaccgggtcggccggtacgggtaccggaaccggtaccggtactaggtaacgg

SEQ ID NO: 256031 - DNA, 451 bp, Homo sapiens
  misc_feature: GYAE6OF01ENTW7.36.11.A11.1.454.CMB.1.raw
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (417)..(451): a, c, t, g, unknown or other
  misc_feature (417)..(451): n is a, c, g, or t
tcagtacgctgtctcacgaccggtgctcgatttagctacgactgcagggccagtcaggagtgtttacagcacctacttagccctggtaccagcagaaacctggccagggctcccaggctcctcatctatggtgcatccagtagggccacgtggcatcccgtagactaggttctagtggcagtgggtctgggacagacttcactcgtcgaccatcgagccaggactggacgccgtgaagtacttttgccgtgtattactgtcaacactatggtacctctctgtacacttttggcctaggggaccaagctggagactcaaacgaactcgtgggacgtgcacgagtctgtcttcatcttcccgcgatctgaagacagcgtactgagcgggcgtcggctaaggccgtcatagnagcanacnnnnnnnnnnnnnnnnnnnnnnnnnnnnnnnnnnn

SEQ ID NO: 256032 - DNA, 397 bp, Homo sapiens
  misc_feature: GYAE6OF01CQ246.36.11.A11.1.454.CMB.1.raw
  modified_base (343)..(343): a, c, t, g, unknown or other
  misc_feature (343)..(343): n is a, c, g, or t
  modified_base (377)..(397): a, c, t, g, unknown or other
  misc_feature (377)..(397): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctggggacagacttcactctcaccatcagcagactggagcctgaagattttgccgtgtattactgtcaacactatggtacctctctgtacacttttggccaggggaccaagctggagatcaaacgactgtgctgcaccatctgtcttcatctcccgcatctgaanacagcgtactgagcgggctggcaaggcgcatagnnnnnnnnnnnnnnnnnnnnn

SEQ ID NO: 256033 - DNA, 382 bp, Homo sapiens
  misc_feature: GYAE6OF01DEMD1.36.11.A11.1.454.CMB.1.raw
  modified_base (378)..(382): a, c, t, g, unknown or other
  misc_feature (378)..(382): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagattttgccgtgtattactgtcaacactatggtacctctctgtacacttttggccaggggaccaagctggagatcaaacgaactgtggctgcaccatctgtcttcatcttcccgcatctgaagcagcgtactgagcgggctggcaaggcgcatagnnnnn

SEQ ID NO: 256034 - DNA, 384 bp, Homo sapiens
  misc_feature: GYAE6OF01DEO1D.36.11.A11.1.454.CMB.1.raw
  modified_base (380)..(384): a, c, t, g, unknown or other
  misc_feature (380)..(384): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagtattttgccgtgtattactgtcaacactatggtacctctctgtacacttttggccaggggaccaagctggagatcaaacgaactgtggctgcaccatctgtcttcatcttcccgcatctgaagacagcgtactgagcgggctggcaaggcgcatagnnnnn

SEQ ID NO: 256035 - DNA, 379 bp, Homo sapiens
  misc_feature: GYAE6OF01D6SC5.36.11.A11.1.454.CMB.1.raw
  modified_base (374)..(379): a, c, t, g, unknown or other
  misc_feature (374)..(379): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagattttgccgtgtattactgtcaacactatggtacctctctgtacacttttggccaggggaccaagctggagatcaaacgactgtgctgcacatctgtcttcatctccgcatctgaagacagcgtactgagcgggctggcaaggcgcatagnnnnnn

SEQ ID NO: 256036 - DNA, 382 bp, Homo sapiens
  misc_feature: GYAE6OF01ELPZA.36.11.A11.1.454.CMB.1.raw
  modified_base (379)..(382): a, c, t, g, unknown or other
  misc_feature (379)..(382): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagattttgccgtgtattactgtcaacactatggtacctctctgtacacttttggccaggggaccaagctggagatcaaacgactgtggctgcaccatctgtcttcatcttcccgccatctgaagacagcgtactgagcgggctggcaaggcgcatagnnnn

SEQ ID NO: 256037 - DNA, 386 bp, Homo sapiens
  misc_feature: GYAE6OF01DJD07.36.11.A11.1.454.CMB.1.raw
  modified_base (373)..(373): a, c, t, g, unknown or other
  misc_feature (373)..(373): n is a, c, g, or t
  modified_base (379)..(386): a, c, t, g, unknown or other
  misc_feature (379)..(386): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatgatacatccaacagggccactggcgtcccagacaggttcagtggcagtgggtctgggacagacttcactctcaccatcagcagcctggagcctgaagattctgcagtttatactgtcagcagcgttacagttggcctccgctcactttcggcggagggtccaaggtggagatcaaacgaactgtggctgcaccatctgtctcatcttcccgcatctagagacagcgtactgagcgggctggcaggcncatagnnnnnnnn

SEQ ID NO: 256038 - DNA, 381 bp, Homo sapiens
  misc_feature: GYAE6OF01ASS0K.36.11.A11.1.454.CMB.1.raw
  modified_base (379)..(381): a, c, t, g, unknown or other
  misc_feature (379)..(381): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagattttgccgtgtattactgtcaacactatggtacctctctgtacacttttggccaggggaccaagctggagatcaaacgaactgtggctgcaccatctgtcttcatcttcccgcatctgaagacagcgtactgagcgggctggcaaggcgcatagnnn

SEQ ID NO: 256039 - DNA, 383 bp, Homo sapiens
  misc_feature: GYAE6OF01DRCGT.36.11.A11.1.454.CMB.1.raw
  modified_base (345)..(345): a, c, t, g, unknown or other
  misc_feature (345)..(345): n is a, c, g, or t
  modified_base (379)..(383): a, c, t, g, unknown or other
  misc_feature (379)..(383): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagtattttgccgtgtattactgtcaacactatggtacctctctgtactacttttggccaggggaccaagctggagatcaaacgaactgtggctgcaccatctgtcttcatctccgcatctgaancagcgtactgagcgggctggacaaggcgcatagnnnnn

SEQ ID NO: 256040 - DNA, 383 bp, Homo sapiens
  misc_feature: GYAE6OF01EEBWQ.36.11.A11.1.454.CMB.1.raw
  modified_base (379)..(383): a, c, t, g, unknown or other
  misc_feature (379)..(383): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagattttgccgtgtattactgtcaacactatggtacctctctgtacacttttggccaggggaccaagctggagatcaaacgaactgtggctgcaccatctgtcttcatcttcccgcatctgaagacagcgtactgagcgggctggcaaggcgcatagnnnnn

SEQ ID NO: 256041 - DNA, 385 bp, Homo sapiens
  misc_feature: GYAE6OF01CK9BE.36.11.A11.1.454.CMB.1.raw
  modified_base (381)..(385): a, c, t, g, unknown or other
  misc_feature (381)..(385): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagatttcgccgtgtattactgtcaacactatggtacctctctgtacacttttggccaggggaccaagctggagatcaaacgaactgtggctgcaccatctgtcttcatcttcccgcaatctgaagacagcgtactgagcgggctggcaaggcgacatagnnnnn

SEQ ID NO: 256042 - DNA, 396 bp, Homo sapiens
  misc_feature: GYAE6OF01CTSDW.36.11.A11.1.454.CMB.1.raw
  modified_base (312)..(312): a, c, t, g, unknown or other
  misc_feature (312)..(312): n is a, c, g, or t
  modified_base (390)..(396): a, c, t, g, unknown or other
  misc_feature (390)..(396): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcaggtgggtctgggacagacttcactctcaccatcagcagactggagcctgaagtattttgccgttgttattactgtcaacactatggtacctctctgtacacttttggcaggggaccaagctggagatcaaaacgaactgnggctgcaccatctgtcttcatctcccgcatctagaagacagacgtactggagcggggctggacgaagggcgacatagnnnnnnn

SEQ ID NO: 256043 - DNA, 391 bp, Homo sapiens
  misc_feature: GYAE6OF01AKVAV.36.11.A11.1.454.CMB.1.raw
  modified_base (384)..(391): a, c, t, g, unknown or other
  misc_feature (384)..(391): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagattttgccgtgtattactgtcaacactatggtacctctctgtacacttttggccaggggaccaagctggagatcaaacgaactgtggctgcaccatctgtcttcactccttcccgccatctgaacgacagcgtactgaggcgggctggcaaggcgcatagnnnnnnnn

SEQ ID NO: 256044 - DNA, 393 bp, Homo sapiens
  misc_feature: GYAE6OF01C78CL.36.11.A11.1.454.CMB.1.raw
  modified_base (389)..(393): a, c, t, g, unknown or other
  misc_feature (389)..(393): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagtattttgccgtgtattactgttcaacactatggtacctctctgtacacttttggcctaggggaccaagctggagatacaaacgaactgtggctgcaccatctgtcttcatcttcccgccatctgaacgacagcgtactgaggcgggctggcgaagggcgcgatagnnnnn

SEQ ID NO: 256045 - DNA, 391 bp, Homo sapiens
  misc_feature: GYAE6OF01COPUW.36.11.A11.1.454.CMB.1.raw
  modified_base (383)..(391): a, c, t, g, unknown or other
  misc_feature (383)..(391): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagtattttgccgtgtattactgtcaacactatggtacctctctgtacacttttggccaggggaccaagctggagatcaaacgaactgtggctgcaccatctgtcttcatccttcccgccatctgaagacagcgtactgagcgggctggcgaaggcacatagnnnnnnnnn

SEQ ID NO: 256046 - DNA, 247 bp, Homo sapiens
  misc_feature: GYAE6OF01AOT3A.36.11.A11.1.454.CMB.1.raw
  modified_base (238)..(247): a, c, t, g, unknown or other
  misc_feature (238)..(247): n is a, c, g, or t
tcagtacgctgtctcacgaccggtgctcgatttagctacgactgcaggggtagctggaattttgagtcctggggccagggaaccctggtcatcgtctcctcagcctccaccaagggcccatcggtcttccccctggcgccctgctccaggagcacctctgggggcacagcggccctgggctgcctggtcaaggactacttccagacagcgtactgagcgggctggcaaggcgcatagnnnnnnnnnn

SEQ ID NO: 256047 - DNA, 389 bp, Homo sapiens
  misc_feature: GYAE6OF01C146O.36.11.A11.1.454.CMB.1.raw
  modified_base (382)..(389): a, c, t, g, unknown or other
  misc_feature (382)..(389): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagtattttgccgtgtattactgtcaacactatggtacctctctgtacacttttggccaggggaccaagctggagatcaaacgaactgtagctgcaccatctgtcttcattctcccgcatctgaagacagcgtactgagcgggctggcaaggcgacagtagnnnnnnnn

SEQ ID NO: 256048 - DNA, 490 bp, Homo sapiens
  misc_feature: GYAE6OF01DZM7H.36.11.A11.1.454.CMB.1.raw
  modified_base (245)..(245): a, c, t, g, unknown or other
  misc_feature (245)..(245): n is a, c, g, or t
  modified_base (342)..(342): a, c, t, g, unknown or other
  misc_feature (342)..(342): n is a, c, g, or t
  modified_base (460)..(490): a, c, t, g, unknown or other
  misc_feature (460)..(490): n is a, c, g, or t
tcagtacgctgtctcacgaccggtgctcgatttagctacgactgcagggccagtcagagtgtttacagcacctacttagcctggtaccagcagaaacctggccaggctcccaggcctcctcatctatggtgcactccgaggtacgggccacgtgggccactcccgaggacctaggttcaggtggcgaggtgggtctgggacagtacttcactctcaccatcagcagacgtggacgctaggaattntttcggcgttagttattactggtacaacacgttatcggtaaccttctctacgttactacgttttcggaccggtaacggggacctaagcgttaggganacgtacaaacgactggcgctgcacattcgtcgtactcgactcccttacccgctaacgtcgtagaacgacacggtcgtacgtaggacgggccggtagttgacgacggacgtcagtacgnnnnnnnnnnnnnnnnnnnnnnnnnnnnnnn

SEQ ID NO: 256049 - DNA, 433 bp, Homo sapiens
  misc_feature: GYAE6OF01C1BFC.36.11.A11.1.454.CMB.1.raw
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
  modified_base (401)..(401): a, c, t, g, unknown or other
  misc_feature (401)..(401): n is a, c, g, or t
  modified_base (408)..(433): a, c, t, g, unknown or other
  misc_feature (408)..(433): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatgatacatccaacagggccactggcgtcccagacaggttcagtggcagtgggtctgggacagacttcactctcaccatcagcagcctggancctgaagatttcngctagtttatactgtcagcagcgtttacagttcggcctccgctcacgtttcggcggaggtccaaggtgagatacaaaacgactgtggctgcaccgatctgtcttcactccttcccgacatcgtagaaacgacaggtcgtaactggaacgcgggctagggaccaagggccganaataggnnnnnnnnnnnnnnnnnnnnnnnnnn

SEQ ID NO: 256050 - DNA, 385 bp, Homo sapiens
  misc_feature: GYAE6OF01EDVWA.36.11.A11.1.454.CMB.1.raw
  modified_base (294)..(294): a, c, t, g, unknown or other
  misc_feature (294)..(294): n is a, c, g, or t
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
  modified_base (379)..(385): a, c, t, g, unknown or other
  misc_feature (379)..(385): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagattttgccgtgtattactgtcaacactatggtacctctctgtacactttggccaggggaccaagctagganatacaaacgaactgtgctgcaccatctgtctcatcttcccgcntctgaanacagcgtactgagtcgggctggcaaggcacatagnnnnnnn

SEQ ID NO: 256051 - DNA, 435 bp, Homo sapiens
  misc_feature: GYAE6OF01BO14J.36.11.A11.1.454.CMB.1.raw
  modified_base (218)..(218): a, c, t, g, unknown or other
  misc_feature (218)..(218): n is a, c, g, or t
  modified_base (309)..(309): a, c, t, g, unknown or other
  misc_feature (309)..(309): n is a, c, g, or t
  modified_base (361)..(361): a, c, t, g, unknown or other
  misc_feature (361)..(361): n is a, c, g, or t
  modified_base (413)..(435): a, c, t, g, unknown or other
  misc_feature (413)..(435): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcaggtgggtctgggacagacttcactctcaccatcagcagactggacncctagaagtattttcgccgtgttattctgtacaactacttatcggtaccttctctgtactacgttttggccgaggggaccaaggcgtgganatacaaacgactgtggctgcacatctgtctcatcctcccgctatctagaacncacgtcgtacgtgacggcgggtactggacgaacgggccgtactacgtagctnnnnnnnnnnnnnnnnnnnnnnn

SEQ ID NO: 256052 - DNA, 615 bp, Homo sapiens
  misc_feature: GYAE6OF01BZ0QN.36.11.A11.1.454.CMB.1.raw
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (579)..(581): a, c, t, g, unknown or other
  misc_feature (579)..(581): n is a, c, g, or t
  modified_base (583)..(589): a, c, t, g, unknown or other
  misc_feature (583)..(589): n is a, c, g, or t
  modified_base (591)..(615): a, c, t, g, unknown or other
  misc_feature (591)..(615): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcaggtgggtctgggacagacttcactctcaccatcagcagactggacgctagaagtattttggccgttagttacttacgtgtaccaaacacttatacgggttaccttctcttacgtacttaccggtttttcggaccggtaacggggaaccgaaaggtcgttacgggaagtaactaaccgaaaaccggtaaacttgggtacgggacgttacggacctaaccctagttaccgttacggttacctttacctaaaccgtttcccctttacccccggcccttaacttacggttaacgaaacggtaacccgtaaggtacccggttaaaccgttacgggaacgggtacccgggggtacggtaccggggtaacgtaaacggggggtccaaccggtaagttaacggcagcgngngngnnngnnnnnnngnnnnnnnnnnnnnnnnnnnnnnnnn

SEQ ID NO: 256053 - DNA, 430 bp, Homo sapiens
  misc_feature: GYAE6OF01DFCEI.36.11.A11.1.454.CMB.1.raw
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (374)..(374): a, c, t, g, unknown or other
  misc_feature (374)..(374): n is a, c, g, or t
  modified_base (397)..(430): a, c, t, g, unknown or other
  misc_feature (397)..(430): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagtattttgccgtgtattactgtcaaacactatggtaccttctctgtacacttttggccaggggaccaagcgtggagatacaaacgaactgtaggctgcaccatctagtcttcatccttcccgcatcngaanacgagcgtactgacggcgggntcggacgaaggcgacagtaggannnnnnnnnnnnnnnnnnnnnnnnnnnnnnnnnn

SEQ ID NO: 256054 - DNA, 446 bp, Homo sapiens
  misc_feature: GYAE6OF01BSQ5W.36.11.A11.1.454.CMB.1.raw
  modified_base (383)..(383): a, c, t, g, unknown or other
  misc_feature (383)..(383): n is a, c, g, or t
  modified_base (424)..(446): a, c, t, g, unknown or other
  misc_feature (424)..(446): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacagttcagtggcaggtgggtctgggacagacttcactctcaccatcagcagactggagcctaggaagtattttgacttactttatttactgtacaacagcgtaaccaagtgggacggacggttccggaccaaggggaccaggtcgacgggttacaaacggtaactggtggctggcacctatctgtcttctacttccttcccgctatcgtagagacaggtccgtancggacggcgggcgtcgggacgaacgggcgtactaagtacgnnnnnnnnnnnnnnnnnnnnnnn

SEQ ID NO: 256055 - DNA, 546 bp, Homo sapiens
  misc_feature: GYAE6OF01DPPME.36.11.A11.1.454.CMB.1.raw
  modified_base (176)..(176): a, c, t, g, unknown or other
  misc_feature (176)..(176): n is a, c, g, or t
  modified_base (366)..(366): a, c, t, g, unknown or other
  misc_feature (366)..(366): n is a, c, g, or t
  modified_base (378)..(378): a, c, t, g, unknown or other
  misc_feature (378)..(378): n is a, c, g, or t
  modified_base (503)..(503): a, c, t, g, unknown or other
  misc_feature (503)..(503): n is a, c, g, or t
  modified_base (507)..(508): a, c, t, g, unknown or other
  misc_feature (507)..(508): n is a, c, g, or t
  modified_base (510)..(546): a, c, t, g, unknown or other
  misc_feature (510)..(546): n is a, c, g, or t
tcagtacgctgtctcacgaccggtgctcgatttagctacgactgcagggccagtcagagtgtttacagcacctacttagcctggtaccagcaagaaacctggccaggctcccaggcctcctcatctatggtgcatccaggtacgggccactggcactcccagacaggttcagtggnaggtggtctgggacagacttcactctacaccatcagacagacgtggagcctagagtattttcgcgttagtattaacgtgtaccaaactacttaagttaccggttaccctttacttctacggttaacttaccggttttcggaccggtaacggggaacaaggtcgtagaacgtaataacgaaacgtacgtgnggctgacaactntcttagtctacgtactcccgttaccccgctaacttcgaacgaacgtaacgtaggtacgtaaaccggttggaacgggacccggggtacggtacgggaccggtaaaacggggccgtaaagtaagtangacnnannnnnnnnnnnnnnnnnnnnnnnnnnnnnnnnnnnnn

SEQ ID NO: 256056 - DNA, 704 bp, Homo sapiens
  misc_feature: GYAE6OF01DH1S2.36.11.A11.1.454.CMB.1.raw
  modified_base (127)..(127): a, c, t, g, unknown or other
  misc_feature (127)..(127): n is a, c, g, or t
  modified_base (133)..(133): a, c, t, g, unknown or other
  misc_feature (133)..(133): n is a, c, g, or t
  modified_base (584)..(584): a, c, t, g, unknown or other
  misc_feature (584)..(584): n is a, c, g, or t
  modified_base (600)..(601): a, c, t, g, unknown or other
  misc_feature (600)..(601): n is a, c, g, or t
  modified_base (603)..(603): a, c, t, g, unknown or other
  misc_feature (603)..(603): n is a, c, g, or t
  modified_base (621)..(621): a, c, t, g, unknown or other
  misc_feature (621)..(621): n is a, c, g, or t
tcagtacgctgtctcacgaccggtgctcgatttagctacgactgcagggccagtcagagtgtttacgacgcaccgtacttagccgtaggtacccagcaagaaacctgccaggcctcccgagctcctnatctangtgcatcagtaggcactgcactacccagtacacgttcgagtcggcgtgtggtcgtaggacgagtacttccgacctcctccacctagtacgacgctagacgtggagtcctagtaagttagtttcgaccgttgtacttacgttacgtacgaaactacgtaacgttacggtacccttacgtaccgttacggttaccttacggttttccgacccggtaacgggtaaccctaaggcgtaggaacgtaacgtaaacgaaacgttacgtacggtacgtacgtacgtaccctaaccgtaccgttacgtacgtttccgttttacgaccgtttacccgttcccccgtaccgttaacggtttaccgtaacggaacgttccggtaaaccgtccgtttaaccgtacggacccggtacggtaccgtacggacgtacgggacgtacccggtaagtcgacgtacgtntactgatatctagtannanagtacgtagtacgtactntacgtacgtacgtagtacgtagtacgtacgtacgtagaagtacgtacgtacgacgtagtacgtagtacgactactcgtacgtc

SEQ ID NO: 256057 - DNA, 592 bp, Homo sapiens
  misc_feature: GYAE6OF01DPPKU.36.11.A11.1.454.CMB.1.raw
  modified_base (558)..(559): a, c, t, g, unknown or other
  misc_feature (558)..(559): n is a, c, g, or t
  modified_base (561)..(561): a, c, t, g, unknown or other
  misc_feature (561)..(561): n is a, c, g, or t
  modified_base (563)..(592): a, c, t, g, unknown or other
  misc_feature (563)..(592): n is a, c, g, or t
tcagtacgctgtctcacgaccggtgctcgatttagctacgactgcagggccagtcagagtgtttacagcacctactagcctggtaccagcagaaacctggccaggctcccaggcctcctcatctatgggtgcatccagtacgggccacgtggcactcccagactaggttcaggtggcgaggttgggtctgggaacagtaccttcactctaccaccatcagcagtacgtaggactccgtaggaagttagttttcggccgttagttattaccgttagtaaccaaactacttaacgtaccggttacccttccttcgttacgttaccgttacgttttcgggacccgggtaaggggacctaaacggcggtaggacgaagtaaccgaaacgtacggtcggtacggtctcgacctaacctacttcgttccttccttaccgtaccctttcccgttccccgtacctacgttaacgtacggaacgtaccggtaacggtccgttaaccgtgggaacgggtccggggtaccgtaagggacccgggaaacggtccggaacgtagttaggcnngngnnnnnnnnnnnnnnnnnnnnnnnnnnnnnn

SEQ ID NO: 256058 - DNA, 703 bp, Homo sapiens
  misc_feature: GYAE6OF01AODPL.36.11.A11.1.454.CMB.1.raw
  modified_base (659)..(659): a, c, t, g, unknown or other
  misc_feature (659)..(659): n is a, c, g, or t
  modified_base (662)..(663): a, c, t, g, unknown or other
  misc_feature (662)..(663): n is a, c, g, or t
  modified_base (665)..(666): a, c, t, g, unknown or other
  misc_feature (665)..(666): n is a, c, g, or t
  modified_base (668)..(670): a, c, t, g, unknown or other
  misc_feature (668)..(670): n is a, c, g, or t
  modified_base (672)..(695): a, c, t, g, unknown or other
  misc_feature (672)..(695): n is a, c, g, or t
  modified_base (697)..(703): a, c, t, g, unknown or other
  misc_feature (697)..(703): n is a, c, g, or t
tcagtacgctgtctcacgaccggtgctcgatttagctacgactgcagggccagtcagagtgtttacagcacctacttagcctggtaccagcagaaacctggccaggctcccaggcctcctcatctatggtgcactccgagggtacgggcccacgtggacctactaccccgagaccgtagggttcaggtggcgtagggtcgggtcgtagggacagtaccttcactctaccaaccatcgagcgaagtacgtggacctccgtagtaagttagttttcggaccgtttattaactttaccgttgtaacctaaaccgtaacttaacgttaccggttaacccttccttacgttacggttaacctttaccgtttttacggggacccgggaaacggggggtaaacccaaacgggtccgttaaggggaagtaaaccgttaaaccggtaaaaaacccgtaacggttcggttacgggaccctacggtacccgtaaaccttaacgttccgttcggtttacctttaccgtaacctttccccgttacccccggacctaatttccgttaacggaaacgtacggtaaccgggtaccgtttaacggacgggaaccggggtccggggtacggtacgggtaacccggtaaacggggtccggaaacctttaagtaggcgnganngnngnnnannnnnnnnnnnnnnnnnnnnnnnncnnnnnnn

SEQ ID NO: 256059 - DNA, 571 bp, Homo sapiens
  misc_feature: GYAE6OF01EYM8S.36.11.A11.1.454.CMB.1.raw
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
  modified_base (511)..(512): a, c, t, g, unknown or other
  misc_feature (511)..(512): n is a, c, g, or t
  modified_base (514)..(514): a, c, t, g, unknown or other
  misc_feature (514)..(514): n is a, c, g, or t
  modified_base (516)..(519): a, c, t, g, unknown or other
  misc_feature (516)..(519): n is a, c, g, or t
  modified_base (521)..(521): a, c, t, g, unknown or other
  misc_feature (521)..(521): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
  modified_base (532)..(532): a, c, t, g, unknown or other
  misc_feature (532)..(532): n is a, c, g, or t
  modified_base (534)..(534): a, c, t, g, unknown or other
  misc_feature (534)..(534): n is a, c, g, or t
  modified_base (536)..(538): a, c, t, g, unknown or other
  misc_feature (536)..(538): n is a, c, g, or t
  modified_base (540)..(540): a, c, t, g, unknown or other
  misc_feature (540)..(540): n is a, c, g, or t
  modified_base (542)..(544): a, c, t, g, unknown or other
  misc_feature (542)..(544): n is a, c, g, or t
  modified_base (546)..(547): a, c, t, g, unknown or other
  misc_feature (546)..(547): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (553)..(553): a, c, t, g, unknown or other
  misc_feature (553)..(553): n is a, c, g, or t
  modified_base (555)..(557): a, c, t, g, unknown or other
  misc_feature (555)..(557): n is a, c, g, or t
  modified_base (559)..(562): a, c, t, g, unknown or other
  misc_feature (559)..(562): n is a, c, g, or t
  modified_base (564)..(566): a, c, t, g, unknown or other
  misc_feature (564)..(566): n is a, c, g, or t
  modified_base (568)..(571): a, c, t, g, unknown or other
  misc_feature (568)..(571): n is a, c, g, or t
tcagtacgctgtctcacgaccggtgctcgatttagctacgactgcagggccagtcagagtgtttacagcacctacttagcctggtaccagcagaaacctggccaggctcccaggcctcctcatctatggtgcatccagtagggccactggcatccccagacaggttcagtggcaggtgggtctggggacagacttcactctccaccatcagcagactggancctgaagtntttttgccgtgtaattactgtacaaaccactatcggttacctctctagtaactacgtttttcggacctaagggggaccaaaggcgttaggggaagtacttaccaaaaccggtaaaccttggtacggacgttgacctaaccagttaccttggttaccctttactaacttccctttacccccggacctaacttaccgttagaaacggtaacacggtaccggttaacgtaggaacgggtccgggggtactacgggtaccgaaagggccgtacctaagtaacggnnanannnnananananagacnanannnanannnannanananannnannnnannnannnn

SEQ ID NO: 256060 - DNA, 588 bp, Homo sapiens
  misc_feature: GYAE6OF01AZ5ZS.36.11.A11.1.454.CMB.1.raw
  modified_base (549)..(550): a, c, t, g, unknown or other
  misc_feature (549)..(550): n is a, c, g, or t
  modified_base (553)..(555): a, c, t, g, unknown or other
  misc_feature (553)..(555): n is a, c, g, or t
  modified_base (557)..(557): a, c, t, g, unknown or other
  misc_feature (557)..(557): n is a, c, g, or t
  modified_base (559)..(588): a, c, t, g, unknown or other
  misc_feature (559)..(588): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcactccccagactaggttcaggtggctaggtgggtctgggacagacttcactctcaccatcagcagacgtggacgtcctaggaagttactttttcggccgttagttaactttacgtcgtacaaacctacttagttacggttacccttcgttaccttgttaaccttaccgtttttcgggaccccgtaacgggggtaacccaaaggccgttacgggaagtacttaaccgaaaacgtaacgttggtaggctcggaccacctacttccgtcgttccttacctcctttaccccggttcccccacctacgttaccgttaacgaaaccgtaccgacgggtaccgttacggcgggtaccgggccggggtccgtacgggacccggtaacgggcccgagtaaacgtggcnntannngngnnnnnnnnnnnnnnnnnnnnnnnnnnnnnn

SEQ ID NO: 256061 - DNA, 478 bp, Homo sapiens
  misc_feature: GYAE6OF01CFJDT.36.11.A11.1.454.CMB.1.raw
  modified_base (227)..(227): a, c, t, g, unknown or other
  misc_feature (227)..(227): n is a, c, g, or t
  modified_base (445)..(445): a, c, t, g, unknown or other
  misc_feature (445)..(445): n is a, c, g, or t
  modified_base (448)..(448): a, c, t, g, unknown or other
  misc_feature (448)..(448): n is a, c, g, or t
  modified_base (450)..(478): a, c, t, g, unknown or other
  misc_feature (450)..(478): n is a, c, g, or t
tcagtacgctgtctcacgaccggtgctcgatttagctacgactgcagggccagtcagagtgtttacagcacctacttagcctggtaccagcagaaacctggccaggctcccagctcctcatctatggtgcatccagtagggccactggcatcccagacaggttcagtggcaggtgggtctgggacagacttcactctccaccatcagcagactggacgcctgaagtntttttcggccgttgttacttactgtaccaaacactatcggtaccttcttctgtactacgttttcggccgaggggtaccaacgcgtggagtactacgaaacgactggtgctcgcacactctgttcctctacttccttccccgcctactccgtagaacgacaacgtccgtacgtcggacgggcggggtacgtcgggaccggaacgggcgcgtaagtagangtnannnnnnnnnnnnnnnnnnnnnnnnnnnnn

SEQ ID NO: 256062 - DNA, 604 bp, Homo sapiens
  misc_feature: GYAE6OF01EGTU1.36.11.A11.1.454.CMB.1.raw
  modified_base (576)..(604): a, c, t, g, unknown or other
  misc_feature (576)..(604): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccgagtagggccactggcactcccagacaggttcaggtggcgtaggtgggtctggggacagtaccttcactctaccaccatcacgcagacgtggacgtcctaggtaacgttagttttcggccgttagttacgttacttcgtacctaaactacgttaatcggttacccttcttacgttacgttaaccttaccggttttcgggaccccggtaacggggtaacccaaggtccgttagggaacgttaacgaacccgtaaaacgtaccgttaggtcggtacgttcgacccgtaacctactttacgttccgtttcctttacctaccgttaccccgtttcccccgtaccgttacgttaccgtaaggaaaaccgtcgtacggttaaccgtacgtacgggacgggaccggggtccgtacgggaaccgaacgggtacaccgtaaggtagcgannnnnnnnnnnnnnnnnnnnnnnnnnnnn

SEQ ID NO: 256063 - DNA, 487 bp, Homo sapiens
  misc_feature: GYAE6OF01BXBW9.36.11.A11.1.454.CMB.1.raw
  modified_base (229)..(229): a, c, t, g, unknown or other
  misc_feature (229)..(229): n is a, c, g, or t
  modified_base (464)..(464): a, c, t, g, unknown or other
  misc_feature (464)..(464): n is a, c, g, or t
  modified_base (466)..(467): a, c, t, g, unknown or other
  misc_feature (466)..(467): n is a, c, g, or t
  modified_base (469)..(487): a, c, t, g, unknown or other
  misc_feature (469)..(487): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccgagtacgggccacgtggcactccccagacaggttcaggtggcaggtgggtctgggacagtacttcactctcaaccatcacgacagtactggganccgtagaagtattttcggaccggttagtactttaactcgtacaactacttactcggttacctctcttcgttacttacgtttcggaccgaggggaaccaagtccgtaggaagacgtaacaaacggaacttgggaggctcggacctacacgttctcgttacttccgacttccccttcgcctatcgtagaacgactcgtacggtacgtggcgggtcggacgtggacgaggggcatagnanngnnnnnnnnnnnnnnnnnnn

SEQ ID NO: 256064 - DNA, 650 bp, Homo sapiens
  misc_feature: GYAE6OF01ATBMD.36.11.A11.1.454.CMB.1.raw
  modified_base (259)..(259): a, c, t, g, unknown or other
  misc_feature (259)..(259): n is a, c, g, or t
  modified_base (568)..(568): a, c, t, g, unknown or other
  misc_feature (568)..(568): n is a, c, g, or t
  modified_base (574)..(574): a, c, t, g, unknown or other
  misc_feature (574)..(574): n is a, c, g, or t
  modified_base (582)..(582): a, c, t, g, unknown or other
  misc_feature (582)..(582): n is a, c, g, or t
  modified_base (586)..(586): a, c, t, g, unknown or other
  misc_feature (586)..(586): n is a, c, g, or t
  modified_base (592)..(592): a, c, t, g, unknown or other
  misc_feature (592)..(592): n is a, c, g, or t
  modified_base (600)..(600): a, c, t, g, unknown or other
  misc_feature (600)..(600): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
  modified_base (620)..(620): a, c, t, g, unknown or other
  misc_feature (620)..(620): n is a, c, g, or t
  modified_base (622)..(622): a, c, t, g, unknown or other
  misc_feature (622)..(622): n is a, c, g, or t
  modified_base (643)..(643): a, c, t, g, unknown or other
  misc_feature (643)..(643): n is a, c, g, or t
  modified_base (645)..(645): a, c, t, g, unknown or other
  misc_feature (645)..(645): n is a, c, g, or t
  modified_base (648)..(648): a, c, t, g, unknown or other
  misc_feature (648)..(648): n is a, c, g, or t
tcagtacgctgtctcacgaccggtgctcgatttagctacgactgcagggccagtcagagtgtttacagcacctacttagcctggtaccagcagaaacctggccaggcctccaggctcctcatctatggtgcatccaggtacgggccaactcggcactccccagaccgtaggttcaggtcggctaggtcgggtcgtaggggacacggtaccttcaccttccgtacacactcaagccgagacgtggacgctaggaacgttntttcggaccgttagtatttccgtagtacaacgtactacgtcggtaccctctacgttgtaacttacgttttcggacccgaagggggtacccaaggacgtaggacgtaacgtaacgaaacggtacgtcggtcgtacgtcggtaccaccgttacttccgttacgttccgttactaccgtttcccgttacccccgcttaacggttccgtaaggtaaaccgtaacgtaacgtttaccggttaccgtacgggacgggtccgggtacggttaccggacggtaacggggtaccgacgtagaacgtcgactgcgtaancggtcnctcactcncgcncgatcncgtgctcncgtactagtcgngnacgcgnanagtcgtactagtcgtcgacgngntgnac

SEQ ID NO: 256065 - DNA, 381 bp, Homo sapiens
  misc_feature: GYAE6OF02F5C3B.36.11.A11.1.454.CMB.1.raw
  modified_base (377)..(381): a, c, t, g, unknown or other
  misc_feature (377)..(381): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagattttgccgtgtattactgtcaacactatggtacctctctgtacacttttggccaggggaccaagctggagatcaaacgaactgtggctgcacatctgtcttcatcttccgcatctgaagacagcgtactgagcgggctggcaaggcgcatagnnnnn

SEQ ID NO: 256066 - DNA, 385 bp, Homo sapiens
  misc_feature: GYAE6OF02F9O0F.36.11.A11.1.454.CMB.1.raw
  modified_base (380)..(385): a, c, t, g, unknown or other
  misc_feature (380)..(385): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagattttgccgtgtattactgtcaacactatggtacctctctgtacacttttggccaggggaccaagctggagatcaaacgaactgtggctgcaccatctgtcttcatcttcccgccatctgaagacagcgtactgagcgggctggcaaggcgcatagnnnnnn

SEQ ID NO: 256067 - DNA, 399 bp, Homo sapiens
  misc_feature: GYAE6OF02JJGD8.36.11.A11.1.454.CMB.1.raw
  modified_base (388)..(399): a, c, t, g, unknown or other
  misc_feature (388)..(399): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcgagtgggtcgtgggacagacttcactctcaccatcagcagactggagcctgaagatttgcgtgtattactgtcacactatggtacctctctgtacactttggtccagggtaccgaagcgtggagatacaaacgaactgtaggctgcaccatctgtcttctatcttccgccactctgaagacagacgtactagagcggcgtggcgaaggcgcagtagnnnnnnnnnnnn

SEQ ID NO: 256068 - DNA, 384 bp, Homo sapiens
  misc_feature: GYAE6OF02HC22A.36.11.A11.1.454.CMB.1.raw
  modified_base (379)..(384): a, c, t, g, unknown or other
  misc_feature (379)..(384): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagattttgccgtgtattactgtcaacactatggtacctctctgtacacttttggccaggggaccaagctggagatcaaacgaactgtggctgcaccatctgtcttcatcttccgccatctgaagacagcgtactgagcgggctggcaaggcgcatagnnnnnn

SEQ ID NO: 256069 - DNA, 387 bp, Homo sapiens
  misc_feature: GYAE6OF02INEJI.36.11.A11.1.454.CMB.1.raw
  modified_base (380)..(387): a, c, t, g, unknown or other
  misc_feature (380)..(387): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagattttgccgtgtattactgtcaacactatggtacctctctgtacacttttggccaggggaccaagctggagatcaaacgaactgtggctgcaccatctgtcttcatcttcccgccatctgaagacagcgtactgagcgggctggcaaggcgcatagnnnnnnnn

SEQ ID NO: 256070 - DNA, 431 bp, Homo sapiens
  misc_feature: GYAE6OF02JZYOF.36.11.A11.1.454.CMB.1.raw
  modified_base (225)..(225): a, c, t, g, unknown or other
  misc_feature (225)..(225): n is a, c, g, or t
  modified_base (360)..(360): a, c, t, g, unknown or other
  misc_feature (360)..(360): n is a, c, g, or t
  modified_base (379)..(379): a, c, t, g, unknown or other
  misc_feature (379)..(379): n is a, c, g, or t
  modified_base (399)..(431): a, c, t, g, unknown or other
  misc_feature (399)..(431): n is a, c, g, or t
tcagtacgctgtctcacgaccggtgctcgatttagctacgactgcgagggccagtcagagtgtttacagcacctacttagcctcggtaccagcagaaacctggccaggctcccaggctcctcatctatggtgcatccagtagggccactggcatcccagacaggttcagttggcaggtagggtctgggaccagactttcactcgtcaccgatcagcagactggancctgaagattttgccgtgtattactgtcaacactatggtacctctctgtacacttttggcctaggggaccaagctggagactcaaacgaactgtggctgcaccgatctgtcttcactcttcccgcctatctgaanacagcgtactgagcgggtntggacaaggtcgctatacgnnnnnnnnnnnnnnnnnnnnnnnnnnnnnnnnn

SEQ ID NO: 256071 - DNA, 385 bp, Homo sapiens
  misc_feature: GYAE6OF02I43FK.36.11.A11.1.454.CMB.1.raw
  modified_base (379)..(385): a, c, t, g, unknown or other
  misc_feature (379)..(385): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagattttgccgtgtattactgtcaacactatggtacctctctgtacacttttggccaggggaccaagctggagatcaaacgaactgtggctgcaccatctgtcttcatcttccgccatctgaagacagcgtactgagcgggctggcaaggcgcatagnnnnnnn

SEQ ID NO: 256072 - DNA, 387 bp, Homo sapiens
  misc_feature: GYAE6OF02G5WQ0.36.11.A11.1.454.CMB.1.raw
  modified_base (381)..(387): a, c, t, g, unknown or other
  misc_feature (381)..(387): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggcaactggcatcccagacaggttcagtggcagtgggtctgggacagacttcactctcaccatcagcagactggagcctgaagattttgccgtgtattactgtcaacactatggtacctctctgtacacttttggccaggggaccaagctggagatcaaacgaactgtggctgcaccatctgtcttcatcttcccgccatctgaagacagcgtactgagcgggctggcaagggcgcatagnnnnnnn

SEQ ID NO: 256073 - DNA, 387 bp, Homo sapiens
  misc_feature: GYAE6OF02GPWCK.36.11.A11.1.454.CMB.1.raw
  modified_base (382)..(387): a, c, t, g, unknown or other
  misc_feature (382)..(387): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagattttgccgtgtattactgtcaacactatggtacctctctgtacacttttggccaggggaccaagctggagatcaaacgaactgtggctgcaccatctgtcttcatcttcccgcctatctgaagacagcgtactgacgcgggctggcaaggcgcatagnnnnnn

SEQ ID NO: 256074 - DNA, 386 bp, Homo sapiens
  misc_feature: GYAE6OF02FS64G.36.11.A11.1.454.CMB.1.raw
  modified_base (380)..(386): a, c, t, g, unknown or other
  misc_feature (380)..(386): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagattttgccgtgtattactgtcaacagtacaatgactggcctctcactttcggcggagggaccaaggtggagatcaaacgaactgtggctgcaccatctgtcttcatcttcccgcatctgaagacagcgtactgagcgggctggcaagggcgcatagnnnnnnn

SEQ ID NO: 256075 - DNA, 385 bp, Homo sapiens
  misc_feature: GYAE6OF02GDTX9.36.11.A11.1.454.CMB.1.raw
  modified_base (379)..(385): a, c, t, g, unknown or other
  misc_feature (379)..(385): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagattttgccgtgtattactgtcaacactatggtacctctctgtacacttttggccaggggaccaagctggagatcaaacgaactgtggctgcaccatctgtcttcatcttcccgcatctgaagacagcgtactgagcgggctggcaaggcgcatagnnnnnnn

SEQ ID NO: 256076 - DNA, 386 bp, Homo sapiens
  misc_feature: GYAE6OF02FTY1E.36.11.A11.1.454.CMB.1.raw
  modified_base (379)..(386): a, c, t, g, unknown or other
  misc_feature (379)..(386): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagattttgccgtgtattactgtcaacactatggtacctctctgtacacttttggccaggggaccaagctggagatcaaacgaactgtggctgcaccatctgtcttcatcttcccgcatctgaagacagcgtactgagcgggctggcaaggcgcatagnnnnnnnn

SEQ ID NO: 256077 - DNA, 385 bp, Homo sapiens; identical to SEQ ID NO: 256071
  misc_feature: GYAE6OF02JH603.36.11.A11.1.454.CMB.1.raw
  modified_base (379)..(385): a, c, t, g, unknown or other
  misc_feature (379)..(385): n is a, c, g, or t

SEQ ID NO: 256078 - DNA, 387 bp, Homo sapiens
  misc_feature: GYAE6OF02GHU4I.36.11.A11.1.454.CMB.1.raw
  modified_base (381)..(387): a, c, t, g, unknown or other
  misc_feature (381)..(387): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagattttgccgtgtattactgtcaacagtacaatgactggcctctcactttcggcggagggaccaaggtggagatcaaacgaactgtggctgcaccatctgtcttcatcttcccgcctatctgaagacagcgtactgagcgggctggcaaggcgcatagnnnnnnn

SEQ ID NO: 256079 - DNA, 388 bp, Homo sapiens
  misc_feature: GYAE6OF02GPRBT.36.11.A11.1.454.CMB.1.raw
  modified_base (375)..(375): a, c, t, g, unknown or other
  misc_feature (375)..(375): n is a, c, g, or t
  modified_base (382)..(388): a, c, t, g, unknown or other
  misc_feature (382)..(388): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctagaagtattttgccgtgtattactgtcaacactatggtacctctctgtacacttttggccaggggaccaagctggagatcaaacgaactgtggctgcaccatctgtcttcatcttccgcatctgaacgacagcgtactgagcgggctggcaaggcncgatagnnnnnnn

SEQ ID NO: 256080 - DNA, 387 bp, Homo sapiens; identical to SEQ ID NO: 256069
  misc_feature: GYAE6OF02FP0VN.36.11.A11.1.454.CMB.1.raw
  modified_base (380)..(387): a, c, t, g, unknown or other
  misc_feature (380)..(387): n is a, c, g, or t

SEQ ID NO: 256081 - DNA, 638 bp, Homo sapiens
  misc_feature: GYAE6OF02IZHXR.36.11.A11.1.454.CMB.1.raw
  modified_base (176)..(176): a, c, t, g, unknown or other
  misc_feature (176)..(176): n is a, c, g, or t
  modified_base (524)..(524): a, c, t, g, unknown or other
  misc_feature (524)..(524): n is a, c, g, or t
  modified_base (527)..(527): a, c, t, g, unknown or other
  misc_feature (527)..(527): n is a, c, g, or t
  modified_base (531)..(531): a, c, t, g, unknown or other
  misc_feature (531)..(531): n is a, c, g, or t
  modified_base (547)..(547): a, c, t, g, unknown or other
  misc_feature (547)..(547): n is a, c, g, or t
tcagtacgctgtctcacgaccggtgctcgatttagctacgactgcagggtccgagtcagagtgtttacagcacctacgttagcctggtaccacgcacgaaacctggccaggctccccaggctcctcatctatggtgcatccagtaggccactggcatcccagacaggtcagcgcgngtggttcgtcgtacgagactactaccacctcaccactcacgacacgacgtacgtaggtacctaccgaacgtaagttttcgttccggtacgttacgttaacttacggttactaaccgaactaacgtacggttacccgtacgtccctcgttactactttcggttccgacgggtaccggtaacacgtcgaggacgtaacaaacgtaacgtgtgccgtcacgacctactagttccgtacgttcctagttacccttcccgtaccgacgttactacgtaacgaacgtctaccgtagtaccgtaggccgggtcgacgtacggaacggacgtcctaaagtatggctagtatcgtanacntacnctagactcgaccgtcnctcgtacacgtacgacgtacgtagtagacgacgaacgtacgtacgtcgtacgtacgtacgtactacgtcgtacttactacttactacctcc

SEQ ID NO: 256082 - DNA, 388 bp, Homo sapiens
  misc_feature: GYAE6OF02G9TFU.36.11.A11.1.454.CMB.1.raw
  modified_base (216)..(216): a, c, t, g, unknown or other
  misc_feature (216)..(216): n is a, c, g, or t
  modified_base (313)..(313): a, c, t, g, unknown or other
  misc_feature (313)..(313): n is a, c, g, or t
  modified_base (382)..(388): a, c, t, g, unknown or other
  misc_feature (382)..(388): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggancctgaagattttgccgttgtattactgtcaacactatggtacctctctgtactacttttggcctaggggaccaaggctggagatcaaacgactgtgntgcaccatctgtcttcactcttcccgctatctgaagacagcgtactgagcgggctggcaaggcacatgnnnnnnn

SEQ ID NO: 256083 - DNA, 531 bp, Homo sapiens
  misc_feature: GYAE6OF02H46K4.36.11.A11.1.454.CMB.1.raw
  modified_base (227)..(227): a, c, t, g, unknown or other
  misc_feature (227)..(227): n is a, c, g, or t
  modified_base (512)..(531): a, c, t, g, unknown or other
  misc_feature (512)..(531): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccaggtagggccactggcatcccagacaggttcagtggcaggtgggtctgggacagacttcactctcaccatcagcagactggagctagaagtnttttgccgttgtattactgtcaacactatcggtacctctctgtactacgtttttcggaccgacggggtacccgaaggccgtagggaagtaacttaaccgaaaaccggtaaacgttgtacgggtacgttcgaccaacctacttcgttcggttccctttactactttcccgtttaccccgaccttacgttccgtaacggaacgaaccgtaacggtaccggtttaccgtagggaacgggtccgggggtacgtacggggtacgaaacggggccgtaacgtaagttaggnnnnnnnnnnnnnnnnnnnn

SEQ ID NO: 256084 - DNA, 419 bp, Homo sapiens
  misc_feature: GYAE6OF02GXGXV.36.11.A11.1.454.CMB.1.raw
  modified_base (338)..(338): a, c, t, g, unknown or other
  misc_feature (338)..(338): n is a, c, g, or t
  modified_base (391)..(391): a, c, t, g, unknown or other
  misc_feature (391)..(391): n is a, c, g, or t
  modified_base (393)..(393): a, c, t, g, unknown or other
  misc_feature (393)..(393): n is a, c, g, or t
  modified_base (396)..(419): a, c, t, g, unknown or other
  misc_feature (396)..(419): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagtattttgccgtgtattactgtcaacactatggtacctctctgtactacttttggccaggggaccaagctggagatacaaacgaactgtgctgcacatctgtcttcactcttcccnctatctgaacgacagcgtactgagccgggtctggacaagggccgacagtaggnangcnnnnnnnnnnnnnnnnnnnnnnnn

SEQ ID NO: 256085 - DNA, 407 bp, Homo sapiens
  misc_feature: GYAE6OF02HQQJR.36.11.A11.1.454.CMB.1.raw
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
  modified_base (386)..(407): a, c, t, g, unknown or other
  misc_feature (386)..(407): n is a, c, g, or t
tcagtacgctgtctcacgaccggtgctcgatttagctacgactgcagggccagtcagagtgtttacagcacctacttagcctggtaccagcagaaacctggccaggctcccaggcctcctcatctatggtgcatccagtagggccactggcatcccagacaggttcagtggcagtgggtctgggacagacttcactctcaccatcagcagactggagcctagaagtattttgccgtgtattactgtcaacactatggtacctctctgtactcttttggcctaggggacccaagcctggagatacaaacgactgtgctgcaccatctgtctcatcttcccgctatcagaanacagcttactgngcgggctggacaaggcactatagnnnnnnnnnnnnnnnnnnnnnn

SEQ ID NO: 256086 - DNA, 501 bp, Homo sapiens
  misc_feature: GYAE6OF02GU6DL.36.11.A11.1.454.CMB.1.raw
  modified_base (465)..(501): a, c, t, g, unknown or other
  misc_feature (465)..(501): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagtattttgccgtgttattactgtacaacactatcggtacccctctcgtactactttcgttccgacgggacggaacgtcgtcgtaggactacgaaacgaacgtagtggcgtcgtcaccgactactcgtcttactactcctttcccgtcccgatttcctacggtaacgaacgtacgtaccgttaccgtaggtacgggacggggtccgtacgggtacggaacgggtacggacgtaacgtagcgagnnnnnnnnnnnnnnnnnnnnnnnnnnnnnnnnnnnnn

SEQ ID NO: 256087 - DNA, 465 bp, Homo sapiens
  misc_feature: GYAE6OF02HJVNM.36.11.A11.1.454.CMB.1.raw
  modified_base (216)..(216): a, c, t, g, unknown or other
  misc_feature (216)..(216): n is a, c, g, or t
  modified_base (269)..(269): a, c, t, g, unknown or other
  misc_feature (269)..(269): n is a, c, g, or t
  modified_base (280)..(280): a, c, t, g, unknown or other
  misc_feature (280)..(280): n is a, c, g, or t
  modified_base (302)..(302): a, c, t, g, unknown or other
  misc_feature (302)..(302): n is a, c, g, or t
  modified_base (334)..(334): a, c, t, g, unknown or other
  misc_feature (334)..(334): n is a, c, g, or t
  modified_base (347)..(347): a, c, t, g, unknown or other
  misc_feature (347)..(347): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
  modified_base (429)..(465): a, c, t, g, unknown or other
  misc_feature (429)..(465): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggancctagaagtattttgactagtttattactgtcaacagtacaatgactggcctntcacgttcggnggagggaccaaggtcggagtanacgaaacgtaactggtacggtctcgccaactntacgtgttcttcncttccttcccgctatctacgaacgtacagccgtatgggacgccgggcgtagggaccgagggacgaccaaggtacgtncangnnnnnnnnnnnnnnnnnnnnnnnnnnnnnnnnnnnnn

SEQ ID NO: 256088 - DNA, 475 bp, Homo sapiens
  misc_feature: GYAE6OF02FTE48.36.11.A11.1.454.CMB.1.raw
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
  modified_base (381)..(381): a, c, t, g, unknown or other
  misc_feature (381)..(381): n is a, c, g, or t
  modified_base (439)..(439): a, c, t, g, unknown or other
  misc_feature (439)..(439): n is a, c, g, or t
  modified_base (443)..(475): a, c, t, g, unknown or other
  misc_feature (443)..(475): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcacgacgtggagcctagaagtatttttcggcccgttgttaacttactgtacaaacctactagttcggtacccttctcttagtacttacgtttttggccgacggggaccaagcgtggagatacaaacgtactgngctncaccatctgttctctacttccttcccgcatctagaacncagcgtacgtcggacggcgggtcgtacggacgaaacgggtcgaccgtaagtacgcgangcannnnnnnnnnnnnnnnnnnnnnnnnnnnnnnnn

SEQ ID NO: 256089 - DNA, 530 bp, Homo sapiens
  misc_feature: GYAE6OF02IFNMB.36.11.A11.1.454.CMB.1.raw
  modified_base (491)..(491): a, c, t, g, unknown or other
  misc_feature (491)..(491): n is a, c, g, or t
  modified_base (495)..(530): a, c, t, g, unknown or other
  misc_feature (495)..(530): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggacgcctagaacgttattttcggccgttgttacttactgtaccaaactactactacggttacccttcttcttacgttaccttaccgtttttcgggaccgtaggggaacccaaggtccgttaggagtaactaccaaaacgtacgttggtacgctgacctacgtattccgtgttccttctacttcccgttccccgtcctaatttcgaagtaacgtacgacggtaccgttacgtacgggacgggtccggggtacgtcggacggaacggtcgacgtagtagnacgnnnnnnnnnnnnnnnnnnnnnnnnnnnnnnnnnnnn

SEQ ID NO: 256090 - DNA, 603 bp, Homo sapiens
  misc_feature: GYAE6OF02JBA5Z.36.11.A11.1.454.CMB.1.raw
  modified_base (205)..(205): a, c, t, g, unknown or other
  misc_feature (205)..(205): n is a, c, g, or t
  modified_base (210)..(210): a, c, t, g, unknown or other
  misc_feature (210)..(210): n is a, c, g, or t
  modified_base (525)..(525): a, c, t, g, unknown or other
  misc_feature (525)..(525): n is a, c, g, or t
  modified_base (555)..(555): a, c, t, g, unknown or other
  misc_feature (555)..(555): n is a, c, g, or t
  modified_base (561)..(561): a, c, t, g, unknown or other
  misc_feature (561)..(561): n is a, c, g, or t
  modified_base (563)..(564): a, c, t, g, unknown or other
  misc_feature (563)..(564): n is a, c, g, or t
  modified_base (566)..(566): a, c, t, g, unknown or other
  misc_feature (566)..(566): n is a, c, g, or t
  modified_base (568)..(568): a, c, t, g, unknown or other
  misc_feature (568)..(568): n is a, c, g, or t
  modified_base (570)..(574): a, c, t, g, unknown or other
  misc_feature (570)..(574): n is a, c, g, or t
  modified_base (576)..(578): a, c, t, g, unknown or other
  misc_feature (576)..(578): n is a, c, g, or t
  modified_base (580)..(585): a, c, t, g, unknown or other
  misc_feature (580)..(585): n is a, c, g, or t
  modified_base (587)..(603): a, c, t, g, unknown or other
  misc_feature (587)..(603): n is a, c, g, or t
tcagtacgctgtctcacgaccggtgctcgatttagctacgactgcagggccagtcagtgtgtttacagcacctacttagcctggtaccagcagaaacctggccaggctcccaggctcctcatctatggtgcatccaaggtacgggccacgtggcactcccagactaggttcaggtggctaggtgggtcgtggggacagtacttcncttcncaccatcgacgacagtacgtgggacgccgtagtaagtacttttcggccggttagttacttacgtggtaccaaacgcttaacgttcgggtaacccctttctccgtttagtaaccgtttcgttttacggggccggtaacgggggaacccaacggtcggttagggaaggtactaaccgaaaaaccgggtaccttgggtaacggtcctaggtaccctaaccgtataccgtttcgttccttaacctcttaccccggttccccgactacgtacgttaacgaaacgtacaacggttacgtaccggttcggacggtccggggngacggtaccgggaaagtccgactagtacgncgactnanncngncnnnnncnnngnnnnnncnnnnnnnnnnnnnnnnn

SEQ ID NO: 256091 - DNA, 457 bp, Homo sapiens
  misc_feature: GYAE6OF02HTVFO.36.11.A11.1.454.CMB.1.raw
  modified_base (344)..(344): a, c, t, g, unknown or other
  misc_feature (344)..(344): n is a, c, g, or t
  modified_base (366)..(366): a, c, t, g, unknown or other
  misc_feature (366)..(366): n is a, c, g, or t
  modified_base (391)..(391): a, c, t, g, unknown or other
  misc_feature (391)..(391): n is a, c, g, or t
  modified_base (397)..(397): a, c, t, g, unknown or other
  misc_feature (397)..(397): n is a, c, g, or t
  modified_base (407)..(407): a, c, t, g, unknown or other
  misc_feature (407)..(407): n is a, c, g, or t
  modified_base (429)..(457): a, c, t, g, unknown or other
  misc_feature (429)..(457): n is a, c, g, or t
tcagtacgctgtctcacgaccggtgctcgatttagctacgactgcagggccagtcagagtgttttacagcacctacttagcctggtaccagcagaaacctggccaggctcccaggctcctcatcctatggtgcatccagtagggccactggcatcccagacagggttcagtggcaggtgggtcgtgggacagtacttcactctcaccatcagcagacgtggagcctagaagtattttggactacttttattactgtacaactagctaaccgtaacgtgggccggtaacggttccggaccgaaaggggaccctaaggtcggaagggtaccaaaacggacgttggnggactgacaccatctgtactcnctcttcccgcatctagaacacacgngttacnggacggcggngtaggcgaaggtcgacaagtgnnnnnnnnnnnnnnnnnnnnnnnnnnnnn

SEQ ID NO: 256092 - DNA, 442 bp, Homo sapiens
  misc_feature: GYAE6OF02HIZBA.36.11.A11.1.454.CMB.1.raw
  modified_base (266)..(266): a, c, t, g, unknown or other
  misc_feature (266)..(266): n is a, c, g, or t
  modified_base (398)..(399): a, c, t, g, unknown or other
  misc_feature (398)..(399): n is a, c, g, or t
  modified_base (401)..(403): a, c, t, g, unknown or other
  misc_feature (401)..(403): n is a, c, g, or t
  modified_base (406)..(408): a, c, t, g, unknown or other
  misc_feature (406)..(408): n is a, c, g, or t
  modified_base (411)..(442): a, c, t, g, unknown or other
  misc_feature (411)..(442): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagtattttgccgtgtattactgtacaacactatggtacctctctntactacttttggcctaagggacccaagctggagatacaaaacgaactgtggctgcaaccatctgtcttcatcttcccgcatctagaagacagctactggacgcgggctggactaaagggccgacgtaagagnngnnngannncannnnnnnnnnnnnnnnnnnnnnnnnnnnnnnn

SEQ ID NO: 256093 - DNA, 500 bp, Homo sapiens
  misc_feature: GYAE6OF02GU4QJ.36.11.A11.1.454.CMB.1.raw
  modified_base (272)..(272): a, c, t, g, unknown or other
  misc_feature (272)..(272): n is a, c, g, or t
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
  modified_base (422)..(422): a, c, t, g, unknown or other
  misc_feature (422)..(422): n is a, c, g, or t
  modified_base (424)..(425): a, c, t, g, unknown or other
  misc_feature (424)..(425): n is a, c, g, or t
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
  modified_base (443)..(443): a, c, t, g, unknown or other
  misc_feature (443)..(443): n is a, c, g, or t
  modified_base (445)..(445): a, c, t, g, unknown or other
  misc_feature (445)..(445): n is a, c, g, or t
  modified_base (447)..(447): a, c, t, g, unknown or other
  misc_feature (447)..(447): n is a, c, g, or t
  modified_base (449)..(450): a, c, t, g, unknown or other
  misc_feature (449)..(450): n is a, c, g, or t
  modified_base (454)..(454): a, c, t, g, unknown or other
  misc_feature (454)..(454): n is a, c, g, or t
  modified_base (460)..(460): a, c, t, g, unknown or other
  misc_feature (460)..(460): n is a, c, g, or t
  modified_base (464)..(464): a, c, t, g, unknown or other
  misc_feature (464)..(464): n is a, c, g, or t
  modified_base (466)..(466): a, c, t, g, unknown or other
  misc_feature (466)..(466): n is a, c, g, or t
  modified_base (470)..(470): a, c, t, g, unknown or other
  misc_feature (470)..(470): n is a, c, g, or t
  modified_base (475)..(475): a, c, t, g, unknown or other
  misc_feature (475)..(475): n is a, c, g, or t
  modified_base (485)..(486): a, c, t, g, unknown or other
  misc_feature (485)..(486): n is a, c, g, or t
  modified_base (497)..(497): a, c, t, g, unknown or other
  misc_feature (497)..(497): n is a, c, g, or t
  modified_base (499)..(499): a, c, t, g, unknown or other
  misc_feature (499)..(499): n is a, c, g, or t
tcagtacgctgtctcacgaccggtgctcgatttagctacgactgcagggccagtcagagtgtttacagcacctacttagcctggtaccagcagaaacctggccaggctcccaggctcctcatctatggtgcatccagtagggccactggcatcccagacaggttcagtggcagtgggtctgggacagacttcactctcaccatcagcagactggacgcctagaagtattttgaccgttgtaattactgtacaaacactatggtacctctctntactacttttggccctaggggaccaagcgtggagatacgaaacgaactgtgctgcaccatctgtcttacatccttcccgctactctagaacgaactacgacgtactgacggcggggtctacggacgaacggccgacgaactagancangnannagtanacgntacanaganananannaganacaganacananaganactanatagtagtannagtagtacganana

SEQ ID NO: 256094 - DNA, 617 bp, Homo sapiens
  misc_feature: GYAE6OF02IYVKN.36.11.A11.1.454.CMB.1.raw
  modified_base (150)..(150): a, c, t, g, unknown or other
  misc_feature (150)..(150): n is a, c, g, or t
  modified_base (378)..(378): a, c, t, g, unknown or other
  misc_feature (378)..(378): n is a, c, g, or t
  modified_base (566)..(566): a, c, t, g, unknown or other
  misc_feature (566)..(566): n is a, c, g, or t
  modified_base (573)..(573): a, c, t, g, unknown or other
  misc_feature (573)..(573): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
  modified_base (591)..(597): a, c, t, g, unknown or other
  misc_feature (591)..(597): n is a, c, g, or t
  modified_base (599)..(602): a, c, t, g, unknown or other
  misc_feature (599)..(602): n is a, c, g, or t
  modified_base (604)..(610): a, c, t, g, unknown or other
  misc_feature (604)..(610): n is a, c, g, or t
  modified_base (612)..(617): a, c, t, g, unknown or other
  misc_feature (612)..(617): n is a, c, g, or t
tcagtacgctgtctcacgaccggtgctcgatttagctacgactgcagggccagtcagagtgtttacagcacctacttagcctggtaccagcagaaacctggccaggctcccagctcctcatctatggtgcatcaggtaggccactggacnctacccagactaggttcagtgactaggtcgggtctaggggaccaggtaccttacaccgtctacccacgactcgagcacggtacgtggaacgtccgtagtaagtagttttcggaccgtttagttacgtttaaccgttggtaacctaactaaccgttagttccggttaaccttccgtacgttacgtactttaacgtttgggaccctaaggggtaccaagggtctaagggnaacgtacaaacggtctggttcgcctacgtacacttacgtccttagtccgttactacttacccctccgtacccttagtaccctaaggggtaaccacggacggtttaccgttaacgacgggtcgggggtacctaccggtaggaaaccgggtcccggaacctagttaaagtccggattacggcgaattggntttacgngtacactcgattnancgnnnnnnnannnntnnnnnnnannnnnn

SEQ ID NO: 256095 - DNA, 487 bp, Homo sapiens
  misc_feature: GYAE6OF01AENAX.9.76.G10.1.454.CMB.1.raw
  modified_base (292)..(292): a, c, t, g, unknown or other
  misc_feature (292)..(292): n is a, c, g, or t
  modified_base (445)..(445): a, c, t, g, unknown or other
  misc_feature (445)..(445): n is a, c, g, or t
  modified_base (450)..(450): a, c, t, g, unknown or other
  misc_feature (450)..(450): n is a, c, g, or t
tcagtgatacgtctcacgaccggtgctcgatttagtcactcatacaggggtcagctgcgggtagagaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataatggtgtaaactggtatcagcagctcccgggaaagctcccaaactccncatctattatgatgatctgctgccctcaggggtctctgaccgattctctggctccaagtctggcacctcacgcctccctggccatcagtgggctccagtctgaggatgaggctgattattactggtggagcagtgggatgacagcctgaatgnttggntggttcggcgggtagggaccaagcgtgcccgtaccgg

SEQ ID NO: 256096 - DNA, 641 bp, Homo sapiens
  misc_feature: GYAE6OF01A42TO.9.76.G10.1.454.CMB.1.raw
tcagtgatacgtctcacgaccggtgctcgatttagtcactcatacaggggagctgcgggtagagaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataatggtagtaaactggtatcagcagcctccgggaagcctacccaaactcctcatctattatgatgatctagctcgccctcgacggggtctcgtcgaccgattcctcgtggcctaccgtacgtcgtcggcctaccgtctacgccctccccgtcggaccctagtccgtaacggtcgggccctcccgacggttccgtaggtacggagtagggtacggtcgttaggtatttaagttaccgtggttagggacgtacgtaggttggggacgtacgaaccgtacgtacccgtaggtaacgttcggtaccggttgggttacggtttcggggttaccggggacggggtaaccgggtaacccgtaacgggtaccggttacccgggtacccggttacccggttaaccgggg

SEQ ID NO: 256097 - DNA, 675 bp, Homo sapiens
  misc_feature: GYAE6OF01EW75U.9.76.G10.1.454.CMB.1.raw
  modified_base (235)..(235): a, c, t, g, unknown or other
  misc_feature (235)..(235): n is a, c, g, or t
tcagtgatacgtctcacgaccggtgctcgatttagtcactcatacaggggagctgcgggtagagaagacaggactcaggacaatctccagcatggcctggtcccctctcttcctcaccctcatcactcactgtgcagggtcctgggcccagtctgtgctgactcagccaccctcggtgtctggacgccccccaggcagagggtcaccatctcctgttctggaagcagctccaacntcggacataatggtataaactggtatcagcagcgtacccggaaggcctacccaaactcctctatcctattatgatgatctgtctcgccctcgtacggggtctctcggaccgtattccgtccgttcggccttaccgaagttcctcggcctaaccctcgacgtccctcccgttcgccacgttcgtacggtcgggtccctccgtacggttacgtacggtaagggtacgtagggtacggtcgttaggttactttagtttaccgtggtaggacgtacgaggttgggaattacggaacgtaggtacccgttaggaaacgttcgggttaccgtttaggggttacggtttcggggtttacccgggggacggggtaaaccgggggtaaaccccgggaacggttaccggttaccccggggttaaccccgtaccgggtttaaaccccgggg

SEQ ID NO: 256098 - DNA, 626 bp, Homo sapiens
  misc_feature: GYAE6OF01ACZHY.9.76.G10.1.454.CMB.1.raw
  modified_base (314)..(314): a, c, t, g, unknown or other
  misc_feature (314)..(314): n is a, c, g, or t
  modified_base (351)..(351): a, c, t, g, unknown or other
  misc_feature (351)..(351): n is a, c, g, or t
tcagtgatacgtctcacgaccggtgctcgatttagtcactcatacaggggtcagctgcgggtagagaagacaggactcaggacaatctccagcatggcctggtcccctctcttcctcaccctcatcactcactgtgcagggtcctgggcccagtctgtgctgactcagcccaccctcggtgtctggacgcccccaggcaggagggtcaccatctcctgttctggaagcagctccaacatcggacataatggtagtaaactggtatcagcagccgtacccggggaaagcctaccccaaactcctacatctattangatgatctgctcgccctgacgggtctcgtcgaccgtnttctcgtcggcctccgtagtctcggcctacctcgacgtccctccgtcggcctacgtcgaggtcgggtcctaccgtagtcgtaggacggtatggtacggtcttagtaagtttacgtttaacgtgggtacggtacgtacgtaagggttggggtattacgggaacctacgggtacccgtaagtaacggttcggttacggtttagggtacggttcggggttaccggggccgggtaaccggggtacctaacgggtcccgtacggtacccggttacccggg

SEQ ID NO: 256099 - DNA, 664 bp, Homo sapiens
  misc_feature: GYAE6OF01AQQ4D.9.76.G10.1.454.CMB.1.raw
tcagtgatacgtctcacgaccggtgctcgatttagtcactcatacaggggagctgcgggtagagaagacaggactcaggacaatctccagcatggcctggtcccctctcttcctcaccctcatcactcactgtgcagggtcctgggcccagtctgtgctgactcagccaccctcggtgtctggacgccccccaggcagaggtcaccatctcctgttctggaagcagctccaacatcggacataatggtagtaaactggtatcagcagccgtcccgggaaaggcctacccaaactcctcatctattatgatgatctgcctcgccctcgacggggtctctcgaccgtattcctcgtcggtcctaccgtaacgtccgtcggtacctacccttccgacgtccccttcccgtcggtccctacgtccgtaggtccgggtccttacccgacggttccgtaggtacgggtagtacggtacggtaccgttagttaacgtttagtttaaccgtgggttacgggtacgtaccgtaaggttcggggtaactacggaaccgtacggtaccgtaggtaaacgttcggtccggtttagggtaggttcgggttaccggggacgggtaaccggggaaccgttaacgggtaccgttaccggtacccggttccggtaaccggg

SEQ ID NO: 256100 - DNA, 714 bp, Homo sapiens
  misc_feature: GYAE6OF01BTAH6.9.76.G10.1.454.CMB.1.raw
tcagtgatacgtctcacgaccggtgctcgatttagtcactcatacaggggtcagctgcgggtagagaagacaggactcaggacaatctccagcatggcctggtcccctctcttcctcaccctcatcactcactgtgcagggtcctgggcccagtctgtgctgactcagccaccctcggtgtctggacgcccccaggcagagggtcaccatctcctgttctggaagcagctccaacatcggacataatggtagtaaactggtatcagcagccgtcccgggaaagcctacccaaactcctacatctattatgatgatctgctcgccctgacgggtctcgtcgaccgtatttcctcgtcggccttaccgtaaaggttccgtcgggaccctaccccgttccgaaccggtccccttacccccgttcgggacccctaacgttacccgtaacgggttccggggtacccttacccgtaacggttccgttagggaacgggtacgttcgggaacgggttccgttaaggttaacttttaacgtttaccggttagggttacggggtagtaccggtaaggttacggggtaatacggaaccgtacggtacccgttaaggtaacgttcggttacggtttagggtacgtttcggggtttaccggggaaccggggtaacggggtaacccgtaaagggtcccggttaccgggtaccccgggtttaacccggg

SEQ ID NO: 256101 - DNA, 597 bp, Homo sapiens
  misc_feature: GYAE6OF01ELY63.9.76.G10.1.454.CMB.1.raw
  modified_base (351)..(351): a, c, t, g, unknown or other
  misc_feature (351)..(351): n is a, c, g, or t
  modified_base (426)..(426): a, c, t, g, unknown or other
  misc_feature (426)..(426): n is a, c, g, or t
tcagtgatacgtctcacgaccggtgctcgatttagtcactcatacaggggagctgcgggtagagaagacaggactcaggacaatctccagcatggcctggtcccctctcttcctcaccctcatcactcactgtgcagggtcctgggcccagtctgtgctgactcagccaccctcggtgtctggacgcccccaggcagaggtcaccatctcctgttctggaagcagctaccaacatcggacataatggtagtaaacgtggtatcagcagccgtaccgggaaagcctacccaaactcctctactctattatacgatgtatcgtgctcgcccgtgacggggtctcgtgaccgtnttcgtcgtgcctacagtcgtcgcctacctcaccgtccctccgtcgacctagtcgtacggtcggctccgtagtcgnggtagacgtggagtcgttagtagtttaacttacgtaggtggtaagcgtaggtagggtataggacctagtccgtaggtaagttcggtacggtttaggacggtttcggggttaccggggacgggaaccgggtaaccacgggttacccgtaccgggttcccgtaccggtaccgg

SEQ ID NO: 256102 - DNA, 717 bp, Homo sapiens
  misc_feature: GYAE6OF01BOYE8.9.76.G10.1.454.CMB.1.raw
  modified_base (194)..(194): a, c, t, g, unknown or other
  misc_feature (194)..(194): n is a, c, g, or t
  modified_base (246)..(246): a, c, t, g, unknown or other
  misc_feature (246)..(246): n is a, c, g, or t
tcagtgatacgtctcacgaccggtgctcgatttagtcactcatacaggggagctgcgggtagagaagacaggactcaggacaatctccagcatggcctcggtcccctctcttcctcaccctcatcactcactgtgcacgggtcctgggcccagtctgtgctgactcacgcccacccgtcggtgtcgtcggaccnccccccgaggccaggacgggtccaccacttcctccgttgttacgtaggaacncacgcctaccaaacgagtaccggaactaagttaagttcgggtaagttaaacgtggtaacgtcgacgcgacggtaccggtacccggggaaagtcccctaccctaaactccgtactaacttcttaattatgtagtgtactcgtgcctcgcccggtagtaccgggtctcgtacgtacctcttcgtccgcgtcctaccgtagtccgtcggacccacgtcgtacccgtccctcccggcgtacctacgtcggtacggtaccggtccgttacgtacggtcgtagggtacgggtagtacgggtacgtgttaacgtttagttaacgttaggtgggtacggtaggtaccgttagggtggaaccgtcggaacggcgtacgtacgtaagggttcgtacgggttaggtacggttacggggtccgggaagggttaacccggtaccgtacgggttacctaaccgggttacccgtccgggtaaccgg

SEQ ID NO: 256103 - DNA, 594 bp, Homo sapiens
  misc_feature: GYAE6OF01BUOWQ.9.76.G10.1.454.CMB.1.raw
  modified_base (222)..(222): a, c, t, g, unknown or other
  misc_feature (222)..(222): n is a, c, g, or t
tcagtgatacgtctcacgaccggtgctcgatttagtcactcatacaggggtcagctgcgggtagagaagacaggactcaggacaatctccagcatggcctggtccctctcttcctcaccctcatcactcactgtgcagggtcctgggcccagtctgtgctgactcacgccaccctcggtgtctggacgccccaggcaggaggtcaccatctctgtctggaancagctccaacatcggacataagtggtagtaaactggtatcagcagccgtaccgggaaagcctacccaaactcctacatctattatgatgatctgctcgcctcgacgggtctacgtcgaccgtattccgtcgtcggtacctacgtaagtcgtacggaccacctcgaccgtcccttacccgcgtacctagtcgtaggtcggacctccgtagtcgtaggaggtagtacggacgtcgtagtactttacgttacgtggtacggagtacgtagtagggtatacggacgtacgtcgtaggtacgttcggtacgttaggtacgttcgggtacgggacgggtaacgggtaaccgaagtccggtacggtcccggttaaccgg

SEQ ID NO: 256104 - DNA, 756 bp, Homo sapiens
  misc_feature: GYAE6OF01BSO90.9.76.G10.1.454.CMB.1.raw
tcagtgatacgtctcacgaccggtgctcgatttagtcactcatacaggggtcagctgcgggtagagaagacaggactcaggacaatctccagcatggcctggtccctctcttcctcaccctcatcactcactgtgcgagggtcctcgggcccagtctgtcgctcgactcacgccctaccccgtcgggtcgtcgtgggaccgccccccgagggcgaggacgggtccaccacttccttccgttggtttcctagggtaacgccgacgtcctacccgaaactacgtacggaacctaattaacgttggtaacgttaaactgggtatccgagacgacgccggtaacccggggaactccctaaccccgaaccttcctactaacttaccttattaagtacgtacgttagtacgtcttacggtcgtcccgtcccggtccgggtacgggttccgtaccgttacggaacccgtttacgtttcccgtcgtccggtacccttaccggtaacgttccggtaccgtccctaccttaccgaccgtcccgtacccgtcggacctaccgtcgtagggtcccgtctacgtcgtctaggacgtgtcggtacgtcgttaagttgtttaacgttggtcggtagtagtcgttaacggggttaagcgtaaggcgtacgtaaggttacggtccggttagttcgggttacggttacggggtacccggggtaaagggcccggtaaacggtaccggttccgtaacccggggttcgtacccgggg

SEQ ID NO: 256105 - DNA, 820 bp, Homo sapiens
  misc_feature: GYAE6OF01EAG0T.9.76.G10.1.454.CMB.1.raw
tcagtgatacgtctcacgaccggtgctcgatttagtcactcatacaggggagctgcgggtagagaagacaggactcaggacaatctccagcatggcctggtcccctctcttcctcaccctcatcactcactgtgcacgggtcctgggcccagtctgtgctgactcagcccacccgtcggtgtcgtggaccgcccccaggcaggacggtccaccgtatcctccgttgttcgtggaacgcacgcctacaacgtagtacgaactataagtggtacgttaaacgtggtactcgagaccgtacggaccggtacccggaacgtccctaacccaacttccctactattcctaatacgtagactgtacttcgtcgccttccgtacccgtacggtacgggttcctacgtacggtacccgtactttccgtcgtccgtaccgttaacgtaacggttcgaccggaccttacccgtcgtacccgtccctttcccgacccggtacctacggttaccgggcgggttcccgtccgtaccgttggtaccggttaggaacgggttagtacgggtaacgggttccttttaaaggtttagttttaaccggtaccggttagggtaaggaccggtttaaacgttacggggttacggtaaccgtccggttaaacggcccggttaaacgtttagggtaaccccgtttcgggggtttaaggtttaggggaccgggtttttaacccgggggacccgggggggaaacgggaaacccccggtttaaggtaaaccccggggtccgggttttaaccccggttaaaccccgggtggttaaaccccccgggg

SEQ ID NO: 256106 - DNA, 858 bp, Homo sapiens
  misc_feature: GYAE6OF01DINCS.9.76.G10.1.454.CMB.1.raw
  modified_base (126)..(126): a, c, t, g, unknown or other
  misc_feature (126)..(126): n is a, c, g, or t
  modified_base (453)..(453): a, c, t, g, unknown or other
  misc_feature (453)..(453): n is a, c, g, or t
tcagtgatacgtctcacgaccggtgctcgatttagtcactcatacaggggtcagctgcgggtagagaaagacaggactcgaggacaatctccagcatcggcctcggtccctctcttcctcaccctnatcactcactgtgcgtacgggtcctcgggcccagttctggtcgtctcgacctcaccgccctacccgtggtgtctcgggaccgaccccgagggtacgcggtacgggtaccaaccgttacgtccttccgttcggttactagggaactccgacgccttaaccaaacgtcgtacggtaaactaagttaacggttacgggttaacgttaaacgttggtaacgttccgagaccggtaaccgaccggtaaccccgggaacgtcccttaacccccgtaaccttccgtaacttaacgttacttaacgtagaggtaacttacgtttcgccgttcccncgttcccggttaccgtacgggttcggttacctcgaaccggttacgttactttccggtacgtaccgtccaacgttacggcgttcctaaacctcccggtacgtcccgtacccggtacctccggtacctacggtaacgtccgggttacccgtcggaccggtttacggtccgtaacgggtaaggtacggttaacgggttacggttcttaaacgtttacgtaacgttaccgtaacccgtcctttaccggtacgttaacgttaacgacgtaacccggtaccggttacggtacgtaaacgggtaacgggtttgttagggggtaccgggtttaaccggggttccggggggaaaaccacgggttaacgtaccccggttacgggtaaccccgggttagacccgggttaaacccgg

SEQ ID NO: 256107 - DNA, 803 bp, Homo sapiens
  misc_feature: GYAE6OF01DI66H.9.76.G10.1.454.CMB.1.raw
  modified_base (137)..(137): a, c, t, g, unknown or other
  misc_feature (137)..(137): n is a, c, g, or t
  modified_base (144)..(144): a, c, t, g, unknown or other
  misc_feature (144)..(144): n is a, c, g, or t
  modified_base (233)..(233): a, c, t, g, unknown or other
  misc_feature (233)..(233): n is a, c, g, or t
  modified_base (349)..(349): a, c, t, g, unknown or other
  misc_feature (349)..(349): n is a, c, g, or t
  modified_base (431)..(431): a, c, t, g, unknown or other
  misc_feature (431)..(431): n is a, c, g, or t
  modified_base (519)..(519): a, c, t, g, unknown or other
  misc_feature (519)..(519): n is a, c, g, or t
tcagtgatacgtctcacgaccggtgctcgatttagtcactcatacaggggagctggcgggtagagaagacaggactcaggacaatctccagcatggcctggtccctctcttcctcacctcatcactcacgtgtgcgngggtccncgggaccctgtctgtcgctagactcgacgcccacccgttcgggtgttacgcgggaccgcccccgagggtacacgggtacggcccaaccncttcccttaccgtttggtttacgacggaacgccacgtacctacccgtaagacggttaccggaaactaagttaaaggttcgggtttaaaacgttaaccgtaggttaacctaccgaanaccggaccggtaacccgggtaaaccggggaactccccctaacccgtaaccttcctaacgtctttaacttagttacgtgtacncgttactcgtcgcccttaacggccgttggtcgggttctgtacccggtacgttcttccgtgtccgtacctacgtcgttaccgcgtaccnccttccgaccgtcccgtccgtaccgtaccgtacgtacggtcgggttccgccgttacggtcggtcgtagggtacgtaacggtggttacgtgtttaacgttattaccgtacggtcctacctacttacgtacgtacgtacacggtacctacgggtaccggtaaggtacgggttaaacgggtttcggtacccggggttcggggaaaccgggtacggggtaacccggaaacgggtttccgttaacccggtccggttaaacccgggtttccgtaaacggggaaccccggg

SEQ ID NO: 256108 - DNA, 496 bp, Homo sapiens
  misc_feature: GYAE6OF02HNJ56.9.76.G10.1.454.CMB.1.raw
  modified_base (350)..(350): a, c, t, g, unknown or other
  misc_feature (350)..(350): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
tcagtgatacgtctcacgaccggtgctcgatttagtcactcatacaggggagctgcgggtagagaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataatggtgtaaactggtatcagcagctccgggaaagctccaaactcctcatctattatgatgatctgctgccctcaggggtctcgtgaccgattctctggctccaagtcnggcacctcagcctccctggccatcagtggctcagtcngaggntgagctgattatactgtggagcagtgggatgactagcctgaattgcttagggattggttcggcggtacgggaccgaagtccgtacgtaccggtcccgtaacggg

SEQ ID NO: 256109 - DNA, 465 bp, Homo sapiens
  misc_feature: GYAE6OF02HMO6Q.9.76.G10.1.454.CMB.1.raw
  modified_base (318)..(318): a, c, t, g, unknown or other
  misc_feature (318)..(318): n is a, c, g, or t
  modified_base (430)..(430): a, c, t, g, unknown or other
  misc_feature (430)..(430): n is a, c, g, or t
  modified_base (448)..(448): a, c, t, g, unknown or other
  misc_feature (448)..(448): n is a, c, g, or t
tcagtgatacgtctcacgaccggtgctcgatttagtcactcatacaggggtcagctgcgggtagagaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataatggtgtaaactggtatcagcagctccgggaaagctcccaaactcctcatctattatgatgatctgctgccctnagggtctctgaccgattctctggctccaagtctggcacctcacgccctcctggccatcagtcgggctccgagtctgagatgagctgattattactgtgagcagtggatgacngctgatgcttgatgtcgnggaggacagctgcgtcg

SEQ ID NO: 256110 - DNA, 640 bp, Homo sapiens
  misc_feature: GYAE6OF02JLQ0O.9.76.G10.1.454.CMB.1.raw
  modified_base (310)..(310): a, c, t, g, unknown or other
  misc_feature (310)..(310): n is a, c, g, or t
tcagtgatacgtctcacgaccggtgctcgatttagtcactcatacaggggtcagctgcgggtagagaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatcctcctgttctggaacgcagctccaacagtccggacataatggtagtaaactggtatcagcagcctcccgggaaagcctaccgaaactcctcatctattangatgatctgctgccctgacgggttctcgtcgaccgtatttctcgtgggcctaccgtaaggttctcggtaccaaccgtcgacggtcccttcccgtggacccctaagttccgtagttcggggcccttccgtacgttccgtacgggtaaggtagttacggacgggtcgtaacggttacgtttaaacgttacccggtttgggtacgggtacgtccggtaaggttcggggattacggaaccgtacgtacccgtaggtaacgtcggtacgtttagggtacgttcggtttacggggaccgggtaggacccgtaaggtcgttacggtacccgttacgg

SEQ ID NO: 256111 - DNA, 558 bp, Homo sapiens
  misc_feature: GYAE6OF02FPWTF.9.76.G10.1.454.CMB.1.raw
  modified_base (303)..(303): a, c, t, g, unknown or other
  misc_feature (303)..(303): n is a, c, g, or t
tcagtgatacgtctcacgaccggtgctcgatttagtcactcatacaggggagctgcgggtagagaagacaggactcaggacaatctccagcatggcctggtcccctctcttcctcaccctcatcactcactgtgcagggtcctgggcccagtctgtgctgactcagccaccctcggtatctggagcccccaggcagagggtcaccatctcctgttctggaagcagctccaacatcggacataatggtgtaaactggtatcagcagctcccgggaaaggcctacccaaactcctcatctattangatgatctgctgccctgacggggttctctgaccgtattctctggctccaagttctggccacctcacgccctccctggccatccgaggtcgggcctccagtcgtgaggatggaggctgtatttattacgtggttggagcgagttggggatggaccgagtcctagaagtggtcgtttgggtacgttgggtttccgggacggggtaacggggtaacccgaagggtccgttacgggtaccccgttacccggttaacggg

SEQ ID NO: 256112 - DNA, 524 bp, Homo sapiens
  misc_feature: GYAE6OF02IMUXD.9.76.G10.1.454.CMB.1.raw
tcagtgatacgtctcacgaccggtgctcgatttagtcactcatacaggggagctgcgggtagagaagacaggactcaggacaatctccagcatggcctggtcccctctcttcctcaccctcatcactcactgtgcagggtcctgggcccagtctgtgctgactcagccaccctcggtgtctggagcccccaggccagagggtcaccatctcctgttctggaagcagctccaacatcggacataatggtagtaaactggtatcagcagctcccgggaaaggcctacccaaactcctcatctattatgatgatctgctgccctcgaggggtctctgaccgattctcgtggctccaagtctggccaccctcacgccctccctggcccactccacgttcgggccttcgacgggtctggacggtagttggaggtctgtattattactgcctacttcctatcgaacagcagcctgagtagtgtaggtagttcgggcgagggaccaagccgtggacccgtccgtaggtacg

SEQ ID NO: 256113 - DNA, 571 bp, Homo sapiens
  misc_feature: GYAE6OF02GA2RZ.9.76.G10.1.454.CMB.1.raw
tcagtgatacgtctcacgaccggtgctcgatttagtcactcatacaggggtcagctgcgggtagagaagacaggactcaggacaatctccagcatggcctggtcccctctcttcctcaccctcatcactcactgtgcagggtcctgggcccagtctgtgctgactcagccaccctcggtgtctggacgcccccaggcagagggtcaccatctcctgttctggaagcagctccaacatcggacataatggtagtaaactggtatcagcagcctacccgggaaagcctacccaaactcctacatctattatgatgatctgctgccctcgacgggtctcgtgacccgtatttccgtcgtcggccttaccgaagttcctcggacccaccgtcacgtccctcccgtggcctatcgagtcgggcctccagtcgtgacgatggagtctagtattattacgtgtggagtcgtagtgggataggacctagcctaggaacgttggtacgttgggtagttcgggtttcgggaccgggtaagggaaccccgtaaggtcccggttacggtaccccggttaccgg

SEQ ID NO: 256114 - DNA, 581 bp, Homo sapiens
  misc_feature: GYAE6OF02HS85G.9.76.G10.1.454.CMB.1.raw
  modified_base (424)..(424): a, c, t, g, unknown or other
  misc_feature (424)..(424): n is a, c, g, or t
tcagtgatacgtctcacgaccggtgctcgatttagtcactcatacaggggagctgcgggtagagaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataatggtgtaaactggtatcagcagctacccgggaaaggcctacccaaactcctcatctattatgatgatctgctcgccctcgaggggttctcgtcgaccgtattcctctggcctccgaagttcctcggcctacctcgacgccctcccgtcggccatcaggtcgggtctccgagtctggaggtntggagctgtatttattacgttggtaggagcgtagtgggtattacggaacgtaggtacctaggtaacgttcggtcgtttgggtaagttcgggttaccggggaccgggtacgggtacccgaaaggtcccgtaacgggtaccccggttacgttaaccggg

SEQ ID NO: 256115 - DNA, 525 bp, Homo sapiens
  misc_feature: GYAE6OF02IDDNB.9.76.G10.1.454.CMB.1.raw
tcagtgatacgtctcacgaccggtgctcgatttagtcactcatacaggggagctgcgggtagagaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctcaacatcggacataatggtgtaaactggtatcagcagcgtacccgggaaggcctacccgaaacctcctcatctattatgatgatctgctgccctcgagggggtctcgtcgaccgattcctctggcctccaagtcctggccacccttcacgtcctcccgtcggccatcaggtcgggctccgacgtctggacggtatggagtctagtatttattagtgtggagcgagtggatgacagctagaatgcgttggtacttggttcggacggacggaccagtccggtcgaccggttacgtacggg

SEQ ID NO: 256116 - DNA, 502 bp, Homo sapiens
  misc_feature: GYAE6OF02I8QDN.9.76.G10.1.454.CMB.1.raw
  modified_base (339)..(339): a, c, t, g, unknown or other
  misc_feature (339)..(339): n is a, c, g, or t
  modified_base (356)..(356): a, c, t, g, unknown or other
  misc_feature (356)..(356): n is a, c, g, or t
  modified_base (420)..(420): a, c, t, g, unknown or other
  misc_feature (420)..(420): n is a, c, g, or t
  modified_base (439)..(439): a, c, t, g, unknown or other
  misc_feature (439)..(439): n is a, c, g, or t
  modified_base (452)..(452): a, c, t, g, unknown or other
  misc_feature (452)..(452): n is a, c, g, or t
tcagtgatacgtctcacgaccggtgctcgatttagtcactcatacaggggagctgcgggtagagaagacaggactcaggacaatctccagcatggcctggtcccctctcttcctcaccctcatcactcactgtgcagggtcctgggcccagtctgtgctgactcagccaccctcggtgtctggacgcccccaggcagagggtcaccatctcctgttctggaagcagctccaacatcggacataaatggtagtaaactggtatcagcagctaccgggaaggcctcccaaactcctcatctatatgatgatctgctcgcctgagggtctctgaccgattcntcggctaccaagtccgnggccacctcaccgtcctcccgtgccatcagtggctcagtctgagatgaggctatattattacgngtgagcagtggaatgaacngcctagaactggnttggatggtacgggcggaacgggacaagtcgtacgtaccggtcgtaacgg

SEQ ID NO: 256117 - DNA, 568 bp, Homo sapiens
  misc_feature: GYAE6OF02G8YUF.9.76.G10.1.454.CMB.1.raw
tcagtgatacgtctcacgaccggtgctcgatttagtcactcatacaggggtcagctgcgggtagagaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataatggtgtaaactggtatcagcagctcccgggaaaggctaccccaaactcctcatctattatgatgatctgctcgccctgacgggtctcgtgaccgtatttctcgtggcctaccaacgttcgtggccaaccttcacgccctcccgtggcccagtccacgttcgggcctttcgacggctaggaggacgtaggacggcttaggtaactttacgttaacgtcgaccctaccgttaccctaagttacgacagaccagtcctaggaagtaaggtgttaggtacgttcggacgggacggtaccaaggtccgtacggtacccgtcgtaacgg

SEQ ID NO: 256118 - DNA, 584 bp, Homo sapiens
  misc_feature: GYAE6OF02HW7R5.9.76.G10.1.454.CMB.1.raw
  modified_base (226)..(226): a, c, t, g, unknown or other
  misc_feature (226)..(226): n is a, c, g, or t
  modified_base (306)..(306): a, c, t, g, unknown or other
  misc_feature (306)..(306): n is a, c, g, or t
  modified_base (310)..(310): a, c, t, g, unknown or other
  misc_feature (310)..(310): n is a, c, g, or t
tcagtgatacgtctcacgaccggtgctcgatttagtcactcatacaggggtcagctgcgggtagagaagacaggactcaggacaatctccagcatggcctggtcccctctcttcctcaccctcatcactcactgtgcagggtcctgggcccagtctgtgctgactcagccaccctcggtgtctggacgcccccaggcaggagggtcaccatctcctgttctggaancagctccaacatcggacataatggtagtaaactggtatcagcagctaccgggaagctacccaaactcctcattctattangatnatctgctcgccctcgacgggttctcgtgaccgtatttcgtctcggcctaccgaagttctggccaccgtcacgtcccgtcccgtgccactcgagtcgggctaccgagtccgtgagtacgtggacgtctgtatttacgttaccgtggtaggtacgtacgtagttcggggtaatcggtactacggtaccgtagtaacgtcgtaccggttagggtacgttcgggttacggggacgggtacgggtaacccgaacggtccggtacggtacccggtaccgg

SEQ ID NO: 256119 - DNA, 575 bp, Homo sapiens
  misc_feature: GYAE6OF02HXPGO.9.76.G10.1.454.CMB.1.raw
  modified_base (349)..(349): a, c, t, g, unknown or other
  misc_feature (349)..(349): n is a, c, g, or t
tcagtgatacgtctcacgaccggtgctcgatttagtcactcatacaggggtcagctgcgggtagagaagacaggactcaggacaatctccagcatggcctggtccctctcttcctcaccctcatcactcactgtgcagggtcctgggcccagtctgtgctgactcagccaccctcggtgtctggacgcccccaggcagagggtcaccatctcctgttctggaagcagctccaacatcggacataatggtagtaaactggtatcagcagccgtacccgggaaaggcctaccccaaacttcctacatactattatgatgatctgctcgcctcgacggtctcgtcgaccgtnttcgtcgtcggcctacgtagtcgtcggcctacctcacgtccctccgtcggccctatcgacggtcggcctcgagtcgtaggagtagtggagtctagttaacttacttagtggtaggacgtacgtagtgggatcgaacgacgtaccgtagtacgtggtaccgttggtaacgttcgggttacgggacgggtacgggtaacctaagggtccgtaccggaccggttaccgg

SEQ ID NO: 256120 - DNA, 694 bp, Homo sapiens
  misc_feature: GYAE6OF02HNGWD.9.76.G10.1.454.CMB.1.raw
tcagtgatacgtctcacgaccggtgctcgatttagtcactcatacaggggtcagctgcgggtagagaagacaggactcaggacaatctccagcatggcctggtccctctcttcctcaccctcatcactcactgtgcagggtcctgggccagtctgtgctgactcagccaccctcggtgtctggacgccccaggccagagggtcaccatcctcctgcactggagcagctcaacatcggaatcgctatgttagtacactggtaccagcagccttcgaaggaaccacgtacccccaaaccctcactaccttaatacgggttaaataacggttaacgtccgggtacccctacggacgggggttcccctacggaacccgtactttaccgtcgttacgacgttaccgtaaacggttccttagggcctaacccttcgaacccgtccccgttacccgtacggtaccctaacgttccgtaaccggttccgggacctttcgacgggtccttaggacggtagtcggagggtcttacgtaacttacgttacctcgacctaaccgttccgtatacggtaacacgtccgactccgtagacggtacgttaggtacgggttacggttaccggggacgggtaaccgggtaacccgtaaggacccgttaccggaccccggtttaacggtacggtaccgaacccggtacccgg

SEQ ID NO: 256121 - DNA, 702 bp, Homo sapiens
  misc_feature: GYAE6OF02G652W.9.76.G10.1.454.CMB.1.raw
  modified_base (189)..(189): a, c, t, g, unknown or other
  misc_feature (189)..(189): n is a, c, g, or t
  modified_base (226)..(226): a, c, t, g, unknown or other
  misc_feature (226)..(226): n is a, c, g, or t
tcagtgatacgtctcacgaccggtgctcgatttagtcactcatacaggggtcagctgcgggtagagaagacaggactcaggacaatctccagcatggcctggtcccctctcttcctcaccctcatcactcactgtgcagggtcctgggcccagtctgtgctgactcagcccacccgtggtgtctggacncccccaggcaggaggtcaccatctcctgttctggaancagcctaccaactgtacggacaataagtcggtagtaaacgttggtactcaggcacggaccgtacccggggaagccctaacccgaaactcctactacttcttattatgagtacgtacttctgtcctccgtcccgtggtacgggtcctcgtacgtaccgtactttcctcgtcgtcctaccgtaacgtcgtcggtaccctaccgtcgaccgtccccgtcccgtcgtaccacgttccggtacgggttccgggtacctaccggtcgttaccggtaggtaacgggtactcgggacgttcgtttaacgttacgtttacgttaccgggagggttacgggtaacgtacggttaggttaacgggtacttacgggaccgtaccggtcgttaacggtacgtcggttaacggttaggttacggttacggggtaccgggacgggtaaccggtaccgtacgggtcccgttaccgggtacccgttaccgggg

SEQ ID NO: 256122 - DNA, 872 bp, Homo sapiens
  misc_feature: GYAE6OF02IJCQD.9.76.G10.1.454.CMB.1.raw
  modified_base (244)..(244): a, c, t, g, unknown or other
  misc_feature (244)..(244): n is a, c, g, or t
tcagtgatacgtctcacgaccggtgctcgatttagtcactcatacagggggtcagctgcgggtagagaagacaggactcaggacaatctccagcatggcctggtcccctctcttcctcaccctcatcactcactgtgcgagggtcctcgggcccagtctgtcgctgactcacgcccacccgttcggtcgtcgtggacgcccccgaggcaggacgggtcaccactcctcttcgttcgtaggaacnccgacgcctaccaaacacgtaccggaactaagttaaacgttagggttacgttaaaaacgttggttaactacgaggccacggtacccgggtaacccgggaaaacggtccctaaaccccctaaaaccgttcccttaacgtaccttactttaactttacgtagtacgtacgtacttcgttacgtccgttaccggtcccgttacgggtacgggttcctacgtaccggtaccgttacttccgtcgttaccgtacccgttacgtaccgttaccgtccggacccttacccgtaccgtacccgttcccgtacccgtaccggtaccctacctaacgggtcgggtacccgtccgttaccggtaccgtttccgggtaaaggtaccggttaacggtccgggttaaccggttacgttaaacgggttttacgtttaaacggtttaccgggttcggggttaacgaacgggttaccggttaagggttacgggtactaacgggtaaccggtcggttaacccgggttagtaaccggtttcgggttaccggttagggttaacccgggtttcgggtacggggggtaaccggttaccgggtaacccggttacgggttaacccgtacccgggtttacccggtaacccggg

SEQ ID NO: 256123 - DNA, 580 bp, Homo sapiens
  misc_feature: GYAE6OF02GOF8A.9.76.G10.1.454.CMB.1.raw
  modified_base (332)..(332): a, c, t, g, unknown or other
  misc_feature (332)..(332): n is a, c, g, or t
  modified_base (343)..(343): a, c, t, g, unknown or other
  misc_feature (343)..(343): n is a, c, g, or t
tcagtgatacgtctcacgaccggtgctcgatttagtcactcatacaggggtcagctgcgggtagagaagacaggactcaggacaatctccagcatggcctggtcccctctcttcctcaccctcatcactcactgtgcagggtcctgggcccagtctgttctgacgcagccgccctcagtgtctggggccccagggcagagggtcaccatctcgtgcactggaagtagctccaacatcggggcacggttatgatgtacactggtaccaacaacttccaggaaccagacccccaaagtcatcattatgacaacatgaagcgcctgacgggtccngaccgtattcncggctccaagtctcggacacactcacgtccctccctgcccaatcaacgtcgggcctaccgacggctaggaggattaggaggtcctagtacttagtttactgcccaggttccgtagtagacgacgacacggtcctaggaacgtagttggttaggttacggttccgggacgggtaacgggaccctaaggtcgtacgggtaaccggttcccgttacgggaccacggtaccccggtaacgg

SEQ ID NO: 256124 - DNA, 768 bp, Homo sapiens
  misc_feature: GYAE6OF02GP8UN.9.76.G10.1.454.CMB.1.raw
tcagtgatacgtctcacgaccggtgctcgatttagtcactcatacagggggtcagctgcgggtagagaagacaggactcaggacaatctccagcatggcctggtcccctcctcttcctcaccctcatcactcactgtgcgacgggtcctgggcccagtctgtgctgactcagccaccctggtgtctggacgcccccaggcaggacggtcaccgatctcctagttctggaagcagcctacaacagtcggactaataacgtggtaagtaaacgtggtactacagtcacgtccgtacccgggaaaggtccctacccaaacgtcctacatacttaatagtcagtgtacttcgtgtcctacgtacccgtcgtacgggtcctacgtaccgaccgttcgttacgttccgcggtacctaacccgtaaggttcccgtacggcctaacccgtaccgtaccggtcccctccggtaccggtaacgacgtacggtaccggtaccgggtcctaacccggtacgttacgtaacgggtaacgggttagtacgggtacggtcgttaaacggttacttttaaacggttaccggtttagggtaccggggttaagtaccggttaaaggggttcgggtaacgtaacggggtaacctaccggttaccgtaaggttaaccgtttaccgggttacgtttacgggggtaccgtttcggggttaaccggggaaccggggttaaccggaacccggttaacggggttcccgtaccggggtaccccctttaccgggg

SEQ ID NO: 256125 - DNA, 731 bp, Homo sapiens
  misc_feature: GYAE6OF02HXSJQ.9.76.G10.1.454.CMB.1.raw
  modified_base (187)..(187): a, c, t, g, unknown or other
  misc_feature (187)..(187): n is a, c, g, or t
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
  modified_base (295)..(295): a, c, t, g, unknown or other
  misc_feature (295)..(295): n is a, c, g, or t
  modified_base (304)..(304): a, c, t, g, unknown or other
  misc_feature (304)..(304): n is a, c, g, or t
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
  modified_base (529)..(529): a, c, t, g, unknown or other
  misc_feature (529)..(529): n is a, c, g, or t
  modified_base (536)..(536): a, c, t, g, unknown or other
  misc_feature (536)..(536): n is a, c, g, or t
tcagtgatacgtctcacgaccggtgctcgatttagtcactcatacaggggtcagctgcgggtagagaagacaggactcaggacaatctccagcatggcctggtcccctcttccttcctcaccctcatcactcactgtgcgagggtcctcgggcccagtctgtgtctgactcacgcccaccgtcggtntccgtcggaccnccccgnggcgtaggacggtccacctatccgtcttggttacgtagagcncgtctaccaanctacggaatattaacgtggtaacgttaagtcggtacncgacgtacncggtaaccgggtacccggaacgtaccctacccgtaacctcgactactcttattgagtagtntacgtntacgccgtaccgcgtttacggcggttcctacgacgttcctctcgtccggtacgtacccgtagtaccggtcgtcccgtaccgtaccgtcccgaacccggttccctaccggtacccggtacctacggtcggtaccgtccggtccctaggtcgttaaccgnggtacgnggtaacgcgttagtaccttgttaaccgtgtttagggacgtagtacgtagggttaggacgtaccggtagtccggttacgtaacggtcgttacgggtacgtttaacggggttcggtaccgggggttacccgggaaccggttaaccggggtaaccgtaccccgggtttacggtccccggttaccgggtaaaccccggg

SEQ ID NO: 256126 - DNA, 695 bp, Homo sapiens
  misc_feature: GYAE6OF02IU94U.9.76.G10.1.454.CMB.1.raw
tcagtgatacgtctcacgaccggtgctcgatttagtcactcatacaggggagctgcgggtagagaagacaggactcaggacaatctccagcatggcctggtcccctctcttcctcaccctcatcactcactgtgcgagggtcctgggcccagtctgtgctgactcacgcccacccgtcggtgtcgtcggaccgcccccgaggcaggacgggtccacctattcctccgttggttccgtaggaacgcgtacgcctaccaacacgtcggacaattaagtggtaagtaacgtggtatcagcacggtccgaccgggaacgccctaacccaaacctccgtatacttacttattagtacgtagtcgtacttcgtacgccgttccggtcccgtacggtaccggggtttcctccggtaaccgaaccgtttcttaccgtttccgtacggtccctaacgtacgttccgtacgtaccctaccttccgacccgtcccgtacccgtcggtacctacgtcgtcggtcggtcctccgtagtcgaggtaacggtagcggtatcgtagttacttagttacggttggtacggagtacgtagggtaggtagtacggtacgacgtagtacgtgtaggtcggttaggtacggtttacgggaccgggtagggaccggttaccggtcgttaccggtaaccggtacccgtaggtaaccgg

SEQ ID NO: 256127 - DNA, 694 bp, Homo sapiens
  misc_feature: GYAE6OF02JEBHD.9.76.G10.1.454.CMB.1.raw
tcagtgatacgtctcacgaccggtgctcgatttagtcactcatacaggggagctgcgggtagagaagacaggactcaggacaatctccagcatggcctggtcccctctcttcctcaccctcatcactcactgtgcagggtcctgggcccagtctgtgctgactcacgcccaccctcggtgtcgtggaccgcccccgaggcaggacgggtccaccatcctcctgttcgtacggacgcacgcctaccaactagtcggaactaagtaacgttggtacgtaaacttggtactactaggacacggaccgtaacccggggaaacgtccctaacccgaacttcctacctattaccgttaatacgttgagtgtactccgtcgcctccgtccgtcggtacggtctcgtacgtacgtcttcgtcgtcgtactactagtccgtacggtcctccgtcaccgtcccgtccgtaccgcaacgtccggtacgtccgtctaccgcgtcgagtaacgtgtacgcggtacttagtactttaacgtcggtacggtacggacggtactacggggtagtccgtagaaccgttagtaccgttagccgtttacgggttcggtttagggttaacggttccgggggtaaccgggttaacggggaacccggtactaaccggggttacccgttaccggggtaccccttagggttaacccgg

SEQ ID NO: 256128 - DNA, 626 bp, Homo sapiens
  misc_feature: GYAE6OF01C71TO.25.73.G07.1.454.CMB.1.raw
  modified_base (130)..(130): a, c, t, g, unknown or other
  misc_feature (130)..(130): n is a, c, g, or t
  modified_base (137)..(137): a, c, t, g, unknown or other
  misc_feature (137)..(137): n is a, c, g, or t
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (245)..(245): a, c, t, g, unknown or other
  misc_feature (245)..(245): n is a, c, g, or t
  modified_base (272)..(272): a, c, t, g, unknown or other
  misc_feature (272)..(272): n is a, c, g, or t
  modified_base (280)..(280): a, c, t, g, unknown or other
  misc_feature (280)..(280): n is a, c, g, or t
  modified_base (313)..(313): a, c, t, g, unknown or other
  misc_feature (313)..(313): n is a, c, g, or t
tcagactgtacagtcacgaccggtgctcgatttagctctacgctcaggggtccaaacagagcttcagcaagcatagtgggaatctgcaccatgccctgggctctgctcctcctgaccctcctcactgacngtctagngtcggactgggccaagggcgacggactaggactcagccgccctggtgtccaaggcgtgagacagaccgccacactcacctgcacngggaccgcncctttgtggcacgntggattgcttggatacagcatcaaccngggccccnccctaccaacgtcgcggacgacggacgaacagngacgcgcctcgagtacttcgagagagtacttcgccgacactactaacgtacacgaacaactactacgtccgtcgtacgtacgtacctacgttacgtacgtacctaccgacgaccgtacggacggacggacggtacgtacgtaacgttagttagttacgtacggtaacgggttacgggtacgtaccggtaccgtacgttacgttaggtttacgggttacggttacgggtacgggtacgggacgacgtacgtacggtaccggtccggtacggtacggaccggtaccgacggtaccgtcccgtcccgtccggtccg

SEQ ID NO: 256129 - DNA, 672 bp, Homo sapiens
  misc_feature: GYAE6OF01BZBV1.25.73.G07.1.454.CMB.1.raw
tcagactgtacagtcacgaccggtgctcgatttagctctacgctcaggggtccaaacagagcttcagcaagcatagtgggaatctgcaccatgccctgggctctgctcctcctgaccctcctcactcactctgaagtgtcagtggtccaggcagggctgactcagccgccctggtgtccaaggacgtgagacagaccgccacactcacctgcacgtgggaccgcgtcctttggtggcaacgctggaattgcttggatacagtcatcaccgaggcccgccctaccaaacgtcgtcggcggaggcggaacaagtgagccggccgtcgaggtatttcagagagtacttctccgcaacgttctaaagtcgaagaccaaactacgtaccgccttcgacctacggtaaccctaagtttacccgtacgggaaccctacccgtacggtacccttagggaacgggaaccggtacgggtaccttagggaacctttaagtttacgtttggttaacgtaggggttacgggaaccgtacggtaacccgtcttagttgggtttagggttacgttcggggaccgggtaacgggaaccgtaacggtccgttacggtaccccggttccgggttcgggtacaacccgggtacccgaacggccgtacccggccccccggtcggttaccccg

SEQ ID NO: 256130 - DNA, 611 bp, Homo sapiens
  misc_feature: GYAE6OF01E1U0Y.25.73.G07.1.454.CMB.1.raw
  modified_base (200)..(200): a, c, t, g, unknown or other
  misc_feature (200)..(200): n is a, c, g, or t
  modified_base (284)..(284): a, c, t, g, unknown or other
  misc_feature (284)..(284): n is a, c, g, or t
tcagactgtacagtcacgaccggtgctcgatttagctctacgctcaggggtccaaacagagcttcagcaagcatagtgggaatctgcaccatgccctgggctctgctcctcctgaccctcctcactcactctgaagtgtcagtggtccaggcagggctgactcagccgccctggtgtaccaaggacgtgagacagacccnccacactcacctgccacgtcggggaccggcgtcctttggtcggcaacgtctggaattgcttggatacagcatcaccgaggcccnccctcccaaactcggtggcgaggcggaacaagtgagccggcctacacggttattacagagagattctccgcatctaagtcaagaaccaacatcgtcctcgctacgacctattaccgtggtacctaccgacgcctaggaacgggtacgacggtctagacttattacgttgtaacgtagggttacgggaactaccggtacccgtagtttacgttcggtttagggtacgttccgggacgggtaccggaccgtaaggtccgtaggacccggttccggcgggtaccacggtacccgtaacggtcccgtacccggtcccccgtcggtaccccg

SEQ ID NO: 256131 - DNA, 633 bp, Homo sapiens
  misc_feature: GYAE6OF01BCV5Y.25.73.G07.1.454.CMB.1.raw
  modified_base (280)..(280): a, c, t, g, unknown or other
  misc_feature (280)..(280): n is a, c, g, or t
  modified_base (339)..(339): a, c, t, g, unknown or other
  misc_feature (339)..(339): n is a, c, g, or t
tcagactgtacagtcacgaccggtgctcgatttagctctacgctcaggggtccaaacagagcttcagcaagcatagtgggaatctgcaccatgccctgggctctgctcctcctgaccctcctcactcactctgaagtgtcagtggtccaggcagggctgactcagcccgccctcggtgtccaaggacgtgagacagaccgccacactcacctgcacgtgggaccggcgcctttggtggaccaacgctggaattgcttggatacagcatcaccgaggcccnccctccaactcgtggcgaggcggaacatgagcgcctcgagtattcgagagagtacttcnccgcatctaagtcagacaactatccgctcgcctcgacctaattacctacgggtacccttacccgacgtacccgtggacgggaccgtacgggccgtaggtaccttaatttacgtttacggtacgtaagggtttcgggacgtaccggtacccgtacttagttacgggtttacggggttacgttccggggtacgggtacgggtaacccgtaaggtccgttaggtacccggtccggttacgggtccgaaccggtacccgaacgggtcccgttccgggtccccccgttcgggtaccccg

SEQ ID NO: 256132 - DNA, 747 bp, Homo sapiens
  misc_feature: GYAE6OF01DM6WP.25.73.G07.1.454.CMB.1.raw
tcagactgtacagtcacgaccggtgctcgatttagctctacgctcaggggtccaaacagagcttcagcaagcatagtgggaatctgcaccatgccctgggctctgctcctcctgaccctctcactcactctgagtgtcagtcggtccgaggcgtagggctgacctcgacgcccgtcccgtgggtcgtaccgaagggcgtggacgacgacggacccgccactacctccaccgtgacacggtcggggaccgtcgttccgtttggtcggacaacggtcgtaggtaacgttggcgttaggactacgacgctactccgaccggaccgggccctacccctaaccgtaacgtcgggtcggacggacggacgaaacgtagtacgggaccgtccggtacccgtacgtaaggttacgtttacgaaggtagtacggtcttaccgaccgtactacgtaacgtaacgtacaacgaactaaacgtcgtcccgtccgtacgtcgtaaccgtaccttacgttaccgtacggtacccttacggaccgggtacgtaaggaacgggaccgtaggtaccgtaagttaacctttaggtttacgttacgttaacgggtacgggttacggaaccgtaccggttacccgtagtttacggtttacgggtttacgggtacggttcggggacggttaacgggactaacggtcgtcggaccgtcggtacgggctcccgggtaccgtacggtcccaccccggtccgtcggtacccg

SEQ ID NO: 256133 - DNA, 919 bp, Homo sapiens
  misc_feature: GYAE6OF01DF4NL.25.73.G07.1.454.CMB.1.raw
  modified_base (315)..(315): a, c, t, g, unknown or other
  misc_feature (315)..(315): n is a, c, g, or t
tcagactgtacagtcacgaccggtgctcgatttagctctacgctcgaggggtccaaacagagcttcagcaagcagtagtgggaatctgcaccatgccctgggctcttcgccttcctcctcgacccctcctcactcactcgtagaagttgtcgacgttcggtaccgaggcacgggtctcgactcacggcccgtcccgttagggtacgtaccgaaagggtcgtacggacgtaccgacggaccccgaccaacgtaccctccacccgtgaccgtacggtaccggggacccgtcgttcgttttcggtaggaccgtaacgngtaggtagttcgtcgttaggactacgacgtactactaccgtaaccgccgggcccccacccttaaccccgtaaacgttcgggtccggacggacgggtaaccgaacgaacgttcgggaacgtccgggtaccctagtaacgggttactttaacggacggtaacggtacgttaaccgttccggtaaccccggtataacgttaaccgtaacggttaccgaacgtaaactaaacccgtaacgttcccgtacccgttccggtaaccgttaccggtaaccccttaacggttaaccgttaaccgggtaaccccttcgaaacggtccgttacggacggtaacggtacggtaaccgtacggttaaccgtttaagttcgtttaaggttaacggtaacggggtttcgggaaaccgttccgggttaaccgttccgggtttaagttttacggggttttcggttaacgggttaccccggggaacggggttaacccgggtaccgtaaagggttccccgttaaacgggttccccggttaccggggtaaccgttaccccggaaaccggttacccggtaacccgtccgggttaaccccgtccccggttacccggggttaaaccc

SEQ ID NO: 256134 - DNA, 823 bp, Homo sapiens
  misc_feature: GYAE6OF01E5Z33.25.73.G07.1.454.CMB.1.raw
tcagactgtacagtcacgaccggtgctcgatttagctctacgctcaggggtccaaacagagcttcagcaagcatagtgggaatctgcaccatgccctgggctctcgctccctcctcgaccctcctcactcactctgaagtgtcgagtggtccagggcacgggctgactccgacgcccgcccgtacggtcgtaccgaagggacgtagaacggaccacggacccgccaccaccgtccaccgtgaccgacggtccggggaccccggtcgttccgttttcgggtcggaccgtaaaccggtcgtaggtaagtttacggtcgtttaggaactacgacgcctaaccgtaccgaccccggacgggtacccccgtacccccgtaaccccgtaaaaccggtccggtacgggacccgggaaacgggacccgggaaaacgaaacggtccgggaaccggtccccgggtccccgtaacggtaacggtttacgtttacgaacggtaacggtaacgtacgtttccctaccggacttaacgttaaccgtaacgtaccgaacctaaaccaacgtcccgtccgtaccgtccgtaccgtaccggaaccttacgttaccgtaccgtaacccgtccgacggtaccgtacggaacgggacgcggtacgtacgtacgttattacgtagtacggtacgggttacgacgtacgtaccgttacgttagtttacgggttcgggttaccggtcgggacggtacggaacgtaggtcccgtacggtacccggtcggtccgggtacgaccccggtaccgacccggtacccgccccggtcccgtccggttaccccg

SEQ ID NO: 256135 - DNA, 752 bp, Homo sapiens
  misc_feature: GYAE6OF01BLRI9.25.73.G07.1.454.CMB.1.raw
  modified_base (137)..(137): a, c, t, g, unknown or other
  misc_feature (137)..(137): n is a, c, g, or t
  modified_base (200)..(200): a, c, t, g, unknown or other
  misc_feature (200)..(200): n is a, c, g, or t
tcagactgtacagtcacgaccggtgctcgatttagctctacgctcaggggtccaaacagagcttcagcaagcatagtgggaatctgcaccatgccctgggctctgctcctcctgaccctcctcactcactctgagtntcagtggtccaggcagggctgactcacgccgtccctggtgtccaaggtactgagacacgaccnccacacctcaccgtgccacgtcggggaccgtcgtcctttggtacggaccacgtctggtaattcgcgttaggactacacgtactactaccgaccgaccgggtccccgtcccctacccctaaccgtcggtcggaccggaaggaccggaactaagtacggacggcccggtcccgtacgtacggttacttacgaggtacgtaacgtacttaccgtcccgtagtacgttacctaacggtcaacgaacctaacaccgtccgtacccgtcgtacctacgtaaccctagtttaccgcggtaactccgtaccgtaccgtacgggacggacggtaaggtcgttaacgtaaccgttagtttacgttacggtaacggttacgggttacggtaaccgtaccggttaccgttacgtttacgggtttacgggttacggggttacgttacccggggtaaccgggacggggtaacccgacggtcgtaccgggttacccgttcccgggtacgggtacccgaccgggtacccggtacccggaccgttccccggccccgttaacggtccccg

SEQ ID NO: 256136 - DNA, 731 bp, Homo sapiens
  misc_feature: GYAE6OF01BSUPG.25.73.G07.1.454.CMB.1.raw
tcagactgtacagtcacgaccggtgctcgatttagctctacgctcagggtccaaacagagcttcagcaagcatagtgggaatctgcaccatgccctgggctctgctcctcctgaccctcctcactcactctagaagtgtcagtcggtccaggcgagggctgactcacgcccgaccctggtgtaccgaaggacgtgacgacagacccgctacactccaccgtgacacggtgggacccgcgtaccttttggtcggaccaacggtcgtggtaatttcggaccgtttggaataccgtacgacactaccgtacccggacggggtcccccaccccgtacccgaaacgtcggtcggacggacggacggaacaagtcggacgccggtcctacgagttacttacgagagacgtatccgtccgctacgtacgacgtagacaactacgtacgtccgtccgtcgtcgtaccgtacccgtactacccgtacctcgtaaccgtcgtacggacggacgtcggtactacgtacttattacgtagtcggtaggttcgggactacggtacccgttagttacggtttggttacgggttacggtaccgggtacggggtaacccggtaacggtaggtcccggttacccggggtccctttacccggggtcggtaaccccgggtacggtaaacccccggtccggttaccccggtacccgtttacccccccgggtcgttaacccgtttaccccgg

SEQ ID NO: 256137 - DNA, 657 bp, Homo sapiens
  misc_feature: GYAE6OF01AVLAB.25.73.G07.1.454.CMB.1.raw
tcagactgtacagtcacgaccggtgctcgatttagctctacgctcaggggtccaaacagagcttcagcaagcatagtgggaatctgcaccatgccctgggctctgctcctcctgaccctcctcactcactctgaagtgtcagtggtccaggcagggctgactcagcccgccctcggtgtccaaggcgtgagacagacccgccacactcacctgccacgtgggacccggcgtcctttggtcggcaacgctggattgcgttggatacgagcatccaccgacgggcccgccctacccaacgtcggtacggcgacggacggaacacgtggacgccggaccctagaggttacttcgagagagtacttcgccgactactctaacgtctaacgaactaacacgtccggtcctcgacgtacgaccctacgttacgtacggtacccttccgaagtccgtagggacggtacgacggtcgtacgtaacttagttacgttagtaacgtaggggttacgggaccgtaacgttacccggtagttacggtttagggtttagggttaacgggttcgggaccgggtaagggtacccgtaaggtccgtacggtacccggttcggtacgggtccacgggtacccgaacgtccgtaccccgtcccggtccggtaccc

SEQ ID NO: 256138 - DNA, 499 bp, Homo sapiens
  misc_feature: GYAE6OF02GQJUT.25.73.G07.1.454.CMB.1.raw
tcagactgtacagtcacgaccggtgctcgatttagctctacgctcaggggtccaaacagagcttcagcaagcatagtgggaatctgcaccatgccctgggctctgctcctcctgaccctcctcactcactctgaagtgtcagtggtccaggcagggctgactcagccgccctcggtgtccaaggacgtgagacagaccgccacactcacctgcactgggaccgcgcctttgtggcaacgctggaattgcttggatacagcatcaccagggccgccctcccaaactcgtggcgaggcggaacatgagcggcctcaggtatttcagagagattctccgcatctaagtcagacaacatcgcctcgctgaccattactggactccagcctgaggacgaggctgactattatgtactaggttggacagtacccgctattgttggtattcggcggaggacaggctgaccgtccgtggtcacgcccgaggcctcgccccgtggtcc

SEQ ID NO: 256139 - DNA, 872 bp, Homo sapiens
  misc_feature: GYAE6OF02H4A08.25.73.G07.1.454.CMB.1.raw
  modified_base (133)..(133): a, c, t, g, unknown or other
  misc_feature (133)..(133): n is a, c, g, or t
tcagactgtacagtcacgaccggtgctcgatttagctctacgctctaggggttccgaaacagagcgttcaggcaacgcactagtgggaattcctggctaccattgccctgggctctgctcctctgaccctctnactcactctgaagttggtcagtggtccaggctagggtctgtacttacgacgcccgcccgttcggtgtaccgaaggccgtagacgacgaggacccgccacggacgtcctaccgtgcacgtggggacccgcgtccttttggtcggacctacgtccgttgggtaattcgacgtttcggacttaccggaagtccaagtttcctaccgaagggggtccccgtacccttacccccgtaaaaggttccggttagggccggaacgggccgggtaaaccgtaaacggtcggaacggccccggtacccccgttagggaacggggtttaccttttaccggaaaggggtacggtacggttaacttttccggttacccgtagtttaacggttacgtttaaacggttccgtaaacggaaccaaacgtacgttacccggtaccccgttcggaccgttacccggtaacccgtaaacgttttaacccgggtaccgggtaaacccttacccgaaggttaccccggttacggacgggtaaaccggacgggttacccttacggtaacccgtttaagtttacgttacgttaaccggtaggggtttacggtaaccgtaccgtaacccgtagttacgttcgggtttaggtaccgtttcgggacggtacgggtaacccgagggtcctaccgggtaccgtaccgttacgggtacctaacggtcccgtaaggtcccgttaccgttcccccgttacggttaacccg

SEQ ID NO: 256140 - DNA, 527 bp, Homo sapiens
  misc_feature: GYAE6OF02G9NYE.25.73.G07.1.454.CMB.1.raw
tcagactgtacagtcacgaccggtgctcgatttagctctacgctcaggggtccaaacagagcttcagcaagcatagtgggaatctgcaccatgccctgggctctgctcctcctgaccctcctcactcactctgaagtgtcagtggtccaggcagggctgactcagccgccctggtgtccaagggacgtgagacagaccgccacactcacctgcactggggaccgcgcctttgtggcaacgctggaattgcttggatacagcatcaccaggccgccctcccaaactcgtggcgaggcggaacatgagcggccctcaggtattcagagagattctccgcatctaagtcagacaacatcgcctcgctcgacctattactcggactccagcctggacggacgagctgactattatgtacgaggttaggactacgtacccgcttagttgtttggtagttcgggaggtacgggactaggcgtacggaccgtccgtgggtcacggcccgaaggcctcggccccgtcggtacccg

SEQ ID NO: 256141 - DNA, 555 bp, Homo sapiens
  misc_feature: GYAE6OF02HLGIH.25.73.G07.1.454.CMB.1.raw
tcagactgtacagtcacgaccggtgctcgatttagctctacgctcaggggtccaaacagagcttcagcaagcatagtgggaatctgcaccatgccctgggctctgctcctcctgaccctcctcactcactctgaagtgtcagtggtccaggcagggctgactcagccgccctcggtgtccaagggacgtgagacagaccgccacactcacctgcacgtgggaccgcgcctttgtggcaacgctggaattgcttggatacagcatcaccaggcccgccctcccaaactcgtggcgaggcggaacaatgagcggccctcaggtattcagagagattctccgcactctaaagtcaagacaacatccgcctcgctcgacctattactggacctccagcctggacggacgaggctgacctattattgtacgtaggttgggactacgtacccgtcgttacgttggtttggtagtttcgggcggtacgggtaccgaaggtcgtacgtaccggtccgtcgggtaccacggacccgaagggcctccggtcccccgtcggtcccg

SEQ ID NO: 256142 - DNA, 658 bp, Homo sapiens
  misc_feature: GYAE6OF02I57L1.25.73.G07.1.454.CMB.1.raw
  modified_base (316)..(316): a, c, t, g, unknown or other
  misc_feature (316)..(316): n is a, c, g, or t
  modified_base (337)..(337): a, c, t, g, unknown or other
  misc_feature (337)..(337): n is a, c, g, or t
tcagactgtacagtcacgaccggtgctcgatttagctctacgctcaggggtccaaacagagcttcagcaagcatagtgggaatctgcaccatgccctgggctctgctcctcctgaccctcctcactcactctgaagtgtcagtggtccaggcagggctgactcagcccgccctcggtgtccaaggacgtgagacagaccgccacactcacctgcacgtgggaccgcgtcctttgtggcaacgctggaattgcttggatacagcatcaccagggcccgccctacccaactcgtggcgaggcgaacaatgagcgcctnaggtattcagagagtattccncgactatactaagtcagtacaacactccgacctcgctacgaacctaacgttacccggaccttcccgacgtaccctaggaacggaaccggacgggtaccttacggtaacctttaagtttaacgtttacggtaaccggttaaggggttaccgggaaccgtaaccggttacccgtacgttaaacgtttgggttttaacgggttacgttccgggacgggaacggtaccgtaacggtccgtcgggacccgttccggtacggggttaccgaacggtacccggaacggttcccggtacccggtcccccggttccggtaccgttacccg

SEQ ID NO: 256143 - DNA, 789 bp, Homo sapiens
  misc_feature: GYAE6OF02JZGAL.25.73.G07.1.454.CMB.1.raw
tcagactgtacagtcacgaccggtgctcgatttagctctacgctcaggggtccaaacagagcttcagcaagcatagtgggaatctgcaccatgccctgggctctgctcctcctgaccctcctcactcactctgaagtgtcagtggtccaggcagggctgactcagccgccctcggtgtccaaggacgtgagacagaccgccacactcacctgcacgtgggaccggcgtcctttggttggccaacgcgtggaattgcgttggatacgagcatcaccgacgggcccgcccctacccaacgtcgtacgggccgacgggacggaaccaagtaggacgccggcccgtaccgtagggttactttccgaaggtagtacgtacgtttacgtccgactaatccgtaaacgtcctaaggaacctaacgaacgtccggtacccttacggtccgtaacgtaacccgtaacttttaccgtacgggtaaccttcccgaacggtcccgttacggaacggggacggtaacgggtacttacgggttaaacctttaagtttacgttaacggttaaccgggttagggggtttaaccgggaaccggtaaccgggtttacccggttaacgttttacgggttttacgggttttacgggtttacccgggttaccgggggtacccgggtaacgggttaaccgtaccggttaaccgggtacccggttaccgggttacccgggtacgtacccggtaccgggtacccgtaaccgggttccccgtacccccggtccccgggtaccgtttaaccccgg

SEQ ID NO: 256144 - DNA, 634 bp, Homo sapiens
  misc_feature: GYAE6OF02IIIAR.25.73.G07.1.454.CMB.1.raw
tcagactgtacagtcacgaccggtgctcgatttagctctacgctcaggggtccaaacagagcttcagcaagcatagtgggaatctgcaccatgccctgggctctgctcctcctgaccctcctcactcactctgaagtgtcagtggtccaggcagggctgactcagccgcctcggtgtccaaggacgtgagacagaccgccacactcacctgcacgtggggaccgcgtcctttggtgcaacgcgtggaattgcttggatacagcatccaccgagggcccgccctacccgaaactcggtcggcggaacgggccgaaacagtcggacgcggcccctagagggttacttcgaggtagacgtacttccgacggctagtacgtaaagtccaagtaacaaacgtcgtaccgccttacgtacgtacgtaacctacgttaccgtacggtacctaccgacgtccgtaggacggtacggacggtacgtagtaacttagttagtacgttacgtacggttacggacgtacgtaccgtacttagttcggttaggtcgttacgggacggtacggaccgtaggtcgtacggtaccggtcggtacggtacgacggtaccgtacggtccgtaccgtaccccgttggtacccg

SEQ ID NO: 256145 - DNA, 880 bp, Homo sapiens
  misc_feature: GYAE6OF02JLGRX.25.73.G07.1.454.CMB.1.raw
  modified_base (198)..(198): a, c, t, g, unknown or other
  misc_feature (198)..(198): n is a, c, g, or t
tcagactgtacagtcacgaccggtgctcgatttagctctacgctcagggtccaaacagagcttcagaaagcatagtgggaatctgcaccatgccctgggctctgctcctcctgaccctcctcactcactctgaagtcgtcagtggtccaggcagggctggactcagcccgtccctcggtgtaccaaggcgtgacgacngaccgctacgactcacctgcactgggaccgcgcctttgtcggcaacgtcgtggaacttgcgttggactacgagcattccaaccgagggccccgaccctaccccgaaacgtccggtacggccgacggacggtaaccgaaacgtggaaccgtccggaccccgtacgtacggggtaactttaccgaacggaacggtaacgaccgttttacctacccgggacttaaacggttcccgttaaaacgggttccaaacgtaaccggtaaaaccaccgtttaccccggggacccctttaccgggacccttaaccgggttaaacccctaacggttttaaaccccgttaccggggtaaacccttaccccgtaacgggttaccccgttaacggggaaccggggtacccggtaaccggggtaccgtttaccggtaaaccgtttaacgttttaaacgtttacgggtaaccggttaacggggttttaccggggtaacccgtaacgggtttaacccccgtagtttaacggtttacgggttttcggggtttaaacgttcggggtaaccgggtacggggtacccgtaaacggtccggttaacgggtaccccggtttacggtaccggggttaccgtaacccgggtaccccggtaagggaccccgttccggtaaccccccggtcggttacccgttaacccgg

SEQ ID NO: 256146 - DNA, 676 bp, Homo sapiens
  misc_feature: GYAE6OF02FO7J4.25.73.G07.1.454.CMB.1.raw
tcagactgtacagtcacgaccggtgctcgatttagctctacgctcaggggtccaaacagagcttcagaaagcatagtgggaatctgcaccatgccctgggctctgctcctcctgaccctcctcactcactctgaagtgtcagtggtccaggcagggctgactcagcccgccctcggtgtacccaagggacgtgacgacaggacccgccacactccacctgccacgtcggggacccggcgtccgttttggtcggaccaacgcgtaggtaattgccgtttggattacagtcatcaccgagggcccgccccgtacccaaacgtccggtaggcgacgggcggaacaagtacggacggccggccctacgacggttactttaccgagacggagtacttccgtaccgtcagttaccgttaagtcaagaaccaaacgtactaccgtccctcggtctacgtaaccctatttaccacggtacctccgacgtccttacggacggacggacggtactacggtaacttagtttacttacggtaacgtaggttacgggaacctaccggtacccgtagttacgtttgggtttaggtacgttcgggacggtacggtaccgacgtcgttacggtacccgtcggtacggtccgaccggtaccgacggtccgtcccgaccccgttcgctaccccg

SEQ ID NO: 256147 - DNA, 641 bp, Homo sapiens
  misc_feature: GYAE6OF02F14W6.25.73.G07.1.454.CMB.1.raw
  modified_base (180)..(180): a, c, t, g, unknown or other
  misc_feature (180)..(180): n is a, c, g, or t
  modified_base (287)..(287): a, c, t, g, unknown or other
  misc_feature (287)..(287): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
tcagactgtacagtcacgaccggtgctcgatttagctctacgctcaggggtccaaacagagcttcagcaagcatagtgggaatctgcaccatgccctgggctctgctcctcctgaccctcctcactcactctgaagtgtcaggtggtccaggcagggctgactcagcccgccctcgggtntccgaaggcgtgagacaggaccgccacactccacctgccactcggggacccggctccttttgtcggcaacgctggaattgcttggatacagcatcaccgacgggccnccctacccaaacgtcggtcggcgacggccggaacaatggacgccggccctgacggttattcagagagattccnccgnatctaagtccagacaacactccgctacgctacgacctattacgtggaaccttccgaacggccctagacgggaccgagggtctacgtaaccttagtttagttacggttacgtaacggggttacggacgtaacggttacccggtacgtttagttcggttttagggttacgttacggggaccgggtacggggtaccaacgggtccgtttacggacccggttcgttccggggtaccacggtacccggaacgggtccctcccggtacccccggttggtaccc

SEQ ID NO: 256148 - DNA, 672 bp, Homo sapiens
  misc_feature: GYAE6OF02H3CHR.25.73.G07.1.454.CMB.1.raw
  modified_base (418)..(418): a, c, t, g, unknown or other
  misc_feature (418)..(418): n is a, c, g, or t
tcagactgtacagtcacgaccggtgctcgatttagctctacgctcaggggtccaaacagagcttcagcaagcatagtgggaatctgcaccatgccctgggctctgctcctcctcgaccctcctcactcactctagaagtgtcagtggtccaggcaggctgactcacgccgcctcggtcgtaccgaaggcgtgacgacacgaccgtccacactcacctgcacggtcggggaccgtcgtccttttggtcggaccaacgtcgttaggtaatttcgtaccgttaggaacttacgacgaccacgtaccgacccgtaccggggcccctaccctaccccgtaaacgtcggtacgggacgacgggacgaacaggtcgacgtccggcctagacgttacttcgaagacgtacgtactttccgaccgtntacttacgtaagtcgaaacgtaacaactctaccgtacctcgtactaccgtacttacttacgcgtacctcgacgcgtacggacggtacgacggtactacgtacttagttactgtacgttaggtacggtacgtacgtacccgtgttacgttggtttacggtacgttcgggtacggtacggaaccgtacggtcgtaccggtaccgtcggtacggtcgacggtacccgaggtcccgtaccggtcccgtcggttacccg

SEQ ID NO: 256149 - DNA, 587 bp, Homo sapiens
  misc_feature: GYAE6OF01A9G50.22.24.C02.1.454.CMB.1.raw
tcagacatacgcgtcacgaccggtgctcgatttagtacagatcgttagggaaagggtctccgaaggcttcaacagtcctgtcccaggtgcagctacaacagtgggcgcagggactgttgaagccttcggagaccctgtccctcacctgcgctgtctatggtgggtctttcagtgattactactggagctggatccgccagcccccagggatgggcctgggagtggattggggaaatcgatcatactggaagcagcaagaccaacccgtccctcaagaatcgagtcactatgtcagtagacacgtcccggagccagttctccctgaacctgaagtctatgaccgcgcggacacggctgtttatacgtgtcgccggactaaccgtgccgcgtgccttgccccaacgaccctcgggccgacgggaaccctggtccaccgtctcctcacgccctccaccaacgggcccactccggtccttcccccgtcggcccaccctccctccaacgacgccaccgtcgtcggggccaccgacgccggcccgtcgggcctcgcccgtcggtcgaacggacctaccgttcccgcggtaccg

SEQ ID NO: 256150 - DNA, 718 bp, Homo sapiens
  misc_feature: GYAE6OF01DUAX7.22.24.C02.1.454.CMB.1.raw
tcagacatacgcgtcacgaccggtgctcgatttagtacagatcgttagggaaagggtctccgaaggcttcaacagtcctgtcccaggtgcagctacaacagtgggcgcaggactgttgaagccttcggagaccctgtccctcacctgcgctgtctatggtgggtctttcagtgattactactggagctggatccgccagcccccagggatgggcctggagtggagttggggaaatcgatcatacgtggaagcagcaagaccaaacccgtccctcaaagaatcgagtcactctgtcagtagacacgtcccggagccagttcctccctgaacctgaagtctatcgaccgccgcggaccacggcttgtttaactacgtgtcgaccggtactaaccgtcgccgtacgtcgccttcgaccccgaacgtacccgtcggggaccgaacgggtacccgtcggtaccgtacccgtccgtcctaccgaccgtaccctaccccgaaccgaaccggacccccgtaacgttcccggttacccgttccccccgtccggtacccctaccccgttccccgtacccgtaaaccggaccgtacccgaccccgttccggtaccgggggacccaccggtaaccggccccgggtaccccggttacgggtcccgtccggtacccggtcgggtaacccggtaacgggtaacccttaccgttaccccgaccggttacccggg

SEQ ID NO: 256151 - DNA, 592 bp, Homo sapiens
  misc_feature: GYAE6OF01C4CIP.22.24.C02.1.454.CMB.1.raw
tcagacatacgcgtcacgaccggtgctcgatttagtacagatcgttagggaaagggtctccgaaggcttcaacagtcctgtcccaggtgcagctacaacagtgggcgcaggactgttgaagccttcggagaccctgtccctcacctgcgctgtctatggtgggtctttcagtgattactactggagctggatccgccagcccccagggatgggcctggagtggattggggaaatcgatcatactggaagcagcaagaccaacccgtccctcaagaatcgagtcactctgtcagtagacacgtcccgagccagttctccctgaacctgaagtctatcgaccgccgcggacacggctgtttattactgtcgccggactaaccggtgccgcgtgcccttgccccaaacgcccgtggggccgacgggaaccctcggtccaccgtcctcctcacgccctccaccgacgggcccacgtccgtccttccccctcggccctaccctccctccacgacgccaccgtcgcggggccacgacgccggcccgtcgggccgtcgcccgtcggtaccgaacggtaccttaccttcccgacgtaccg

SEQ ID NO: 256152 - DNA, 594 bp, Homo sapiens
  misc_feature: GYAE6OF01AKV29.22.24.C02.1.454.CMB.1.raw
  modified_base (308)..(308): a, c, t, g, unknown or other
  misc_feature (308)..(308): n is a, c, g, or t
tcagacatacgcgtcacgaccggtgctcgatttagtacagatcgttagggaaagggtctccgaaggcttcaacagtcctgtcccaggtgcagctacaacagtgggcgcaggactgttgaagccttcggagaccctgtccctcacctgcgctgtctatggtgggtctttcagtgattactactggagctggatccgccagcccccagggatgggcctggagtggattggggaaatcgatcatactggaagcagcaagaccaacccgtccctcaagaatcgagtcactctgtcagtagacacgtccgganccagttctccctgaacctgaacgtcatgaccgccgcggacacggctgtttatacgtgtcgccggactaaccgtgcccgcgtgccttgacccaagcccgtgggccacgggaccctggtccaccgtcctcctcacgcctcccaccgaacgggcccactccggtcccttcccccgtcggtcccacccctcccgtacccaacgaccgctacccgtcgtcggggaccaccgacggcccggcccgtcgggccgtcgccgtcggtaccgaacggacctacgttcccgcgtccg

SEQ ID NO: 256153 - DNA, 624 bp, Homo sapiens
  misc_feature: GYAE6OF01B078T.22.24.C02.1.454.CMB.1.raw
  modified_base (301)..(301): a, c, t, g, unknown or other
  misc_feature (301)..(301): n is a, c, g, or t
  modified_base (531)..(531): a, c, t, g, unknown or other
  misc_feature (531)..(531): n is a, c, g, or t
  modified_base (534)..(534): a, c, t, g, unknown or other
  misc_feature (534)..(534): n is a, c, g, or t
  modified_base (573)..(573): a, c, t, g, unknown or other
  misc_feature (573)..(573): n is a, c, g, or t
tcagacatacgcgtcacgaccggtgctcgatttagtacagatcgttagggaaagggtctccgaaggcttcaacagtcctgtcccaggtgcagctacaacagtgggcgcaggactgttgaagccttcggagaccctgtccctcacctgcgctgtctatggtgggtctttcagtgattactactggagctggatccgccagcccccagggactgggcctggagtggattggggaaatcgatcatactggaagcagcaacgaccaacccgtccctacaagaactcgagtccactctgtcagtanacacgtcccggagcctagtcctaccctgaaccctgaacgtctatcgaccgcgcggacacggctgttactactgtcgcggtactaaccgtgccgtcgtcgccttcgacccaacgcccgtcgggaccgacgggtaaccctggtaccgaccgtcctcccgtcaccgtccctcccaccgtaccggccctacgtcccgtcctcccccgtacgtccctacccctcctccacgtacnccnccgtcgcgggtcaccgtacggccggtacccgcgggtccncggcccgttcggtaccgtaacggtaccctaaccgttcccgacgttacccgg

SEQ ID NO: 256154 - DNA, 769 bp, Homo sapiens
  misc_feature: GYAE6OF01B2RD4.22.24.C02.1.454.CMB.1.raw
tcagacatacgcgtcacgaccggtgctcgatttagtacagatcgttagggaaagggtctccgaaggcttcaacagtcctgtcccaggtgcagctacaacagtgggcgcaggactgttgaagccttcggagaccctgtccctcacctgcgctgtctatggtggtctttcagtgattactactggagctggactccgccacggcccccagggagtcgggccgtggagtggagttaggggaaactcgatcgaatacgtaggaagcgagacaaacgaacccaaccccgtccctacgaaagaactcgacgtcaactcgtagtacgaagtacgacctaccggtccggacgtacctacgttcctaccgtacgaaccgtagaacgtctactcgaccggtccgaccggaccgtccgtacgttacgtttacgttacgtcgtaccggtaccggtaaccgtaccggtcgtccggtccgtcgtcccgttaccgaaccccgaaacggtcccggtacggggaccctaaccggggtacccgtcgggtaaccaaccccgggttccttacccgtaccgacccgtacccgacccaaaccggacccggtaccctaccggttcccggtcccccctttccccggacggttaccccctacccccgttacccgtacccgaaaggtccccgtaccgaaccccgtccggggtacggaccacccggtaccgggcccggtcccgcgggtccctccggacccgttggaaccgacggtacccttcgacccgttcggacg

SEQ ID NO: 256155 - DNA, 656 bp, Homo sapiens
  misc_feature: GYAE6OF01B1MTY.22.24.C02.1.454.CMB.1.raw
tcagacatacgcgtcacgaccggtgctcgatttagtacagatcgttagggaaagggtctccgaaggcttcaacagtcctgtcccaggtgcagctacaacagtgggcgcaggactgttgaagccttcggagaccctgtccctcacctgcgctgtctatggtgggtctttcagtgattactactggagctggatccgccacgcccccagggatgggcctggagtggattggggaaatcgatcatactggaagcagcaaagacccaacccgtccctacaagaatcgagtcactctgtcagtagacacgtcccggagcctagttcctcctgaacctgaacgtctatcgaccgcgcggaccacggctgtttatacgtgtcgccggactaaccgtcgccggtcgtcgtccgttcgaccccaaacgcccgtcgggaccgacgggaaccctcggtccgacccgtctcccgtcacgtccctacccgaccgaaccgggcccacgtccggtacccttcccccgtcgccctaccctccctaccgtaacgcgtacccaccgtccggtcggggacccacggccggcccgggtaccccgtcgggggtccctacgggccccgttacgggtaccgaacgggtaccctaaccgtttccccggaccggtacccgg

SEQ ID NO: 256156 - DNA, 641 bp, Homo sapiens
  misc_feature: GYAE6OF01E3JG0.22.24.C02.1.454.CMB.1.raw
  modified_base (342)..(342): a, c, t, g, unknown or other
  misc_feature (342)..(342): n is a, c, g, or t
  modified_base (463)..(463): a, c, t, g, unknown or other
  misc_feature (463)..(463): n is a, c, g, or t
  modified_base (473)..(473): a, c, t, g, unknown or other
  misc_feature (473)..(473): n is a, c, g, or t
  modified_base (475)..(475): a, c, t, g, unknown or other
  misc_feature (475)..(475): n is a, c, g, or t
  modified_base (524)..(524): a, c, t, g, unknown or other
  misc_feature (524)..(524): n is a, c, g, or t
tcagacatacgcgtcacgaccggtgctcgatttagtacagatcgttagggaaagggtctccgaaggcttcaacagtcctgtcccaggtgcagctacaacagtggggcgcaggactgttgaagccttcggagaccctgtccctcacctgcgctgtctatggtgggtctttcagtgattactactggagctggactccgccacgccccccgaggggatcggggcctgggaggtggagttgggggaaatcgatcatacgtggaagcagtaacgaccaaccccgtcctacgaagaactcgagtcactctgtcagtacgacaccggtcccggacgcctacgtttccnccctcgaacctgtaacgtctatcgacccgcgcggacacggtcttagtttagtctgtcgaccgtactacgtcgccgcgtcgtcctcgacccaacgccgtcgggccgacgggaccctcggccnccgtcctccncncgcctccgaccgaccggtcccacgttcccgtcccttccccgcgtacccncccctcctaccgacgaccgtccacccgtcggcgggccaccggacggtcccggcccgtgggcctcgggcccgttcggtaccgaaacggtacccttacccgtcccacggttccgtacgg

SEQ ID NO: 256157 - DNA, 924 bp, Homo sapiens
  misc_feature: GYAE6OF01BW601.22.24.C02.1.454.CMB.1.raw
tcagacatacgcgtcacgaccggtgctcgatttagtacagatcgttagggaaagggtctccgaaggcttcaacagtcctgtcccaggtgcagctacaacaggtgggcgcaggactgttgaagccttcggagaccctgtccctcacctgcgctgtctatggtgggttctttcgagtgattactacgtggagcgtggactcccgccgaccgcccccgagggagtcggggcctggaggtggagttaggggaaatcgatacgatacgaggaagccagacaacgacccaacccgtcctacgaagactcgacgtctactctagtacagtacgacctaccggtccgacgacctacgttccctccgtacgaacctagaacgtactacgtaccggaacccggccggaccgggaaccgtaccggttacgtttacgtttaacgttacgttcgggaccggtaacccggtaacgttaacccggtccgggcccgtaccgggttaccggtacccgtttaaccccggaacccccggtaaacccggtaccccgggtacccgggggtaacccccgggtaacccggggtaaacccccggttccggttacccccggtaaccccgtaccccggtttaccccgtaccggaccccggtttaccccgaaacccccgggaaccccgtaaccccgggtaaccccgttacggtttaccccccggttccccgtttccccccgtaacccgggtttcccccaaccccccggtttaccccgttacccggaaaccggtaaccccggtacccgtaaccccgggttcccggggaaccggggacccaccggggacccggggtcccccgggtcccggtacggggtccccttaccgggtacccgggtacccggtaacggtaacccgggtaacctttacccggttacccggtaccggttacg

SEQ ID NO: 256158 - DNA, 743 bp, Homo sapiens
  misc_feature: GYAE6OF01B8DEL.22.24.C02.1.454.CMB.1.raw
tcagacatacgcgtcacgaccggtgctcgatttagtacagatcgttagggaaagggtctccgaaggcttcaacagtcctgtcccaggtgcagctacaacagtgggcgcaggactgttgaagccttcggagaccctgtccctcacctgcgctgtctatggtgggtctttcagtgtattactactggagctggatcccgccacgcccccagggagtcgggcccttgggacgtgggagttggggaaatccgatcatacgtaggaacgcagacaaacgacccaacccggtccctcaaagaactcgagtccactcgtgtcacggtagaccgaccggttcccggagtccctagttccctcccgtaggaacctgaacgttcctaacgtccgacccgtcccggacggaccgtacggtccttagtttacgtaccgttcggtacggacccggtaacttacccggtcgacccgtacggttccgccgtttaccgacccgaaacgtacccgtacgggaccgacggtacccgtcggtaccgaccgtcctaccgtccacgtacctaccccaccgacgggtcccctacgtcccggttcccgtaccccgtccgccccgtaccccgttcccgtacccgtacgaccgtccctaaccgtccggtccggggccctaccgacccgggcccggtccccgtcgggtcccgtcggtacccgtaccggttaccgaaccggtcccgttacccgttcccgtacgtacccgg

SEQ ID NO: 256159 - DNA, 629 bp, Homo sapiens
  misc_feature: GYAE6OF01B7P35.22.24.C02.1.454.CMB.1.raw
  modified_base (371)..(371): a, c, t, g, unknown or other
  misc_feature (371)..(371): n is a, c, g, or t
tcagacatacgcgtcacgaccggtgctcgatttagtacagatcgttagggaaagggtctccgaaggcttcaacagtcctgtcccaggtgcagctacaacagtggggcgcaggactgttgaagccttcggagaccctgtccctcacctgcgctgtctatggtgggtctttcagtgattactactggagctggatccgccagcccccagggatgggcctggagtggattggggaaatcgatcatactggaagcagcaagaccaacccgtccctacaagaatcgagtcactctgtcagtagacacgtccggacgccagttcctccgagaacctgaagtctaatcgaccgccgcgacacggctagttactactgnccgactaaccgtgccgcgtctccttcgaccccaagtcccgtcgggaccgaacggaacccgtcggtaccacccgtctccctcgacgtccctaccacccgaacgggccctaacgtcccggttcccttccccccgtacggaccctaccccttcccgttaccgaacgacgtaccacccgtcggcggggtccaaccggacggccggccccgtagggtcctcggtcctcggtacgaaacggtaccgttaccttcccgacgtacg

SEQ ID NO: 256160 - DNA, 760 bp, Homo sapiens
  misc_feature: GYAE6OF01DULDZ.22.24.C02.1.454.CMB.1.raw
tcagacatacgcgtcacgaccggtgctcgatttagtacagatcgttagggaaagggtctccgaaggcttcaacagtcctgtcccaggtgcagctacaacagtgggcgcaggactgttgaagccttcggagaccctgtccctcacctgcgctgtctatggtgggtctttcagtgattactactggagctggatccgccagcccccagggatcgggcctggacgtggagttggggaaatcgagtcatactggaagcgagcaagaccaacccgtccctcaagaatcgagtcactctgtcagtagacacggtcccggagaccctacggttcctcccgtaggtaaccctggtaaacgttcgtaaatcggaccccgtccgacgggaacctaccggccgttagttttaacgttacgttcggtaccgtaccggaaccgttaaacccggcgtaaccggcccgttaggtcccttacggtaacccccaacgaccccggtacggggaccccgaacggggtaaacccccgttcgggttaccgtaccccggttccgtaccccgttccgtacgtcccccgtaccgaaccccgaaccgggtaccccaacgtcccgggttcccttaccccccggttcgacccgtacccgtcccgtacccgtaaccgacgtcccacccgttccggtcgggtacccgcgaaccggtccgggtacccgtcgggtcctacgtcccggttacggtccgtaaacggaaccgtttacccgttccgcccgtacgg

SEQ ID NO: 256161 - DNA, 591 bp, Homo sapiens
  misc_feature: GYAE6OF02HTLDD.22.24.C02.1.454.CMB.1.raw
tcagacatacgcgtcacgaccggtgctcgatttagtacagatcgttagggaaagggtctccgaaggcttcaacagtcctgtcccaggtgcagctacaacagtggggcgcaggactgttgaagccttcggagaccctgtccctcacctgcgctgtctatggtggtctttcagtgattactacttgagctggatccgccagcccccagggatgggcctggagtggattggggaaatcgatcatactggaagcagcaagaccaacccgtcctcaagaatcgagtcactctgtcagtagacacgtcccggagccagttctcctgaacctgaagtctatgaccgccgcggacacggctgtttatactgtgccggactaaccgtgccgcgtgccttgaccccaaagacccgtggggccacgggaaccctggtccaccgtctcctcacgccctccaccaacgggcccactccggtccttcccccgtcggcccaccctcctcccaacgacgccacctccgtcggggccacgacggccggcccgtcggggccctcggcccgtcgggtccgaaacgggtacctaccgttcccgacggtccg

SEQ ID NO: 256162 - DNA, 570 bp, Homo sapiens
  misc_feature: GYAE6OF02IKOVD.22.24.C02.1.454.CMB.1.raw
  modified_base (315)..(315): a, c, t, g, unknown or other
  misc_feature (315)..(315): n is a, c, g, or t
  modified_base (426)..(426): a, c, t, g, unknown or other
  misc_feature (426)..(426): n is a, c, g, or t
  modified_base (467)..(467): a, c, t, g, unknown or other
  misc_feature (467)..(467): n is a, c, g, or t
tcagacatacgcgtcacgaccggtgctcgatttagtacagatcgttagggaaagggtctccgaaggcttcaacagtcctgtcccaggtgcagctacaacagtggggcgcaggactgttgaagccttcggagaccctgtccctcacctgcgctgtctatggtgggtctttcagtgattactactggagctggatccgccagccccagggatgggcctggagtggattggggaaatcgatcatactggaagcagcaagaccaacccgtcctcaagaatcgagtcactctgtcagtagacacgtcccgagccagttcnccctgaacctgaagtctatgaccgcgcggacacggctgtttatactgtgccggataaccgtgccgctgccttgccccaaagccctggggccagggaaccctggtcacgtcnccgtcagcctccacaaacgggcccatccggtcttcccccgnggccaccctcctcccaagacgcaccctcgtcggggctacgacggcggccctggggcctgcccgttcgggtccaaaggacccttaaccttcccgaaccggtcgg

SEQ ID NO: 256163 - DNA, 607 bp, Homo sapiens
  misc_feature: GYAE6OF02JMC34.22.24.C02.1.454.CMB.1.raw
  modified_base (317)..(317): a, c, t, g, unknown or other
  misc_feature (317)..(317): n is a, c, g, or t
tcagacatacgcgtcacgaccggtgctcgatttagtacagatcgttagggaaagggtctccgaaggcttcaacagtcctgtcccaggtgcagctacaacagtggggcgcaggactgttgaagccttcggagaccctgtccctcacctgcgctgtctatggtgggtctttcagtgattactactggagctggatccgccagcccccagggatgggcctggagtggattggggaaatcgatcatactggaagcagcaagaccaaccgtcctcaagaatcgagtcactctgtcagtagacacgtcccggagcccagttcnccctgaacctgaagtctatgaccgcgcggacacggctgtttatactgtgcgactaaccgtgccgcgtgccttgaccccaagacccgtggggcccagggaaccctggtccaccgtctcctcacgcctccaccgaacgggcccagtccggtcttcccccgtacggcccaccccgttccctacccgtaacgaccgccaacccgtccgtacggggcctaccgacggccggccctacggggcctacggcccgtcggttaccgaacggtacccgttaccgtcccgtacggtaccgg

SEQ ID NO: 256164 - DNA, 597 bp, Homo sapiens
  misc_feature: GYAE6OF02FTMUG.22.24.C02.1.454.CMB.1.raw
  modified_base (513)..(513): a, c, t, g, unknown or other
  misc_feature (513)..(513): n is a, c, g, or t
tcagacatacgcgtcacgaccggtgctcgatttagtacagatcgttagggaaagggtctccgaaggcttcaacagtcctgtcccaggtgcagctacaacagtggggcgcaggactgttgaagccttcggagaccctgtccctcacctgcgctgtctatggtgggtctttcagtgattactactggagctggatccgccagcccccagggatgggcctggagtggattggggaaatcggatcatactggaagcagcaagaccaacccgtccctcaagaatcgagtcactctgtcagtagacacgtcccggagccagttctccctgaacctgaagtctatcgaccgcgcggacacggctgtttattactgtgccggactaaccgtgccgcgtgccttcgccccaaacgacccgtggggccgacgggaaccctggtccgacccgtctcctcacgcctccaccaacgggcccacgtccggtccttcccccgtcggccacccctcctcccgaacgacnccacctccgtcggggcaccgacggccgcccgtcgggcctcggcccgtcggtccgaacggtacctaccgttcccgaccgtacccg

SEQ ID NO: 256165 - DNA, 755 bp, Homo sapiens
  misc_feature: GYAE6OF02I8FVI.22.24.C02.1.454.CMB.1.raw
tcagacatacgcgtcacgaccggtgctcgatttagtacagatcgttagggaaagggtctccgaaggcttcaacagtcctgtcccaggtgcagctacaacagtggggcgcagggactgttgaagccttcggagaccctgtccctcacctgcgctgtctatggtgggtctttcagtgattactactggagctggatccgccagccccagggatgggcctggagtggagttggggaaatcgatcatactggaagcagcaagaccaacccgtcctacaagaatcgagtcactctgtcagtagacacgtcccggagccagtctcccgtacgacctgaagtctagtcgacccggccgaccggacaccggcttacggtttacttacgtgtacgaccggtactaaccggtcgcccgtacggtcgtcccgtttcggaccccgtaaacggaccccggtcggggaccccgaacggggtaaccccgttcgggtaccctacccgggttcctacccctacgtaccgaccctccccaaccggtaaccgggcccctacggtcccggttccccgtttcccccgtaccgggtacccctaccccgttaccccgtacccaaacgggtcccgaacccgtacccgtcccggttaccgggggaccctacggtacccgggcccgggtaccccggttcggggtcccgttcgggtaccccgttacggggtacccgtaaccgggtacccgtttaaccccgttacccggtaccgttacccggg

SEQ ID NO: 256166 - DNA, 624 bp, Homo sapiens
  misc_feature: GYAE6OF02I0F5D.22.24.C02.1.454.CMB.1.raw
  modified_base (272)..(272): a, c, t, g, unknown or other
  misc_feature (272)..(272): n is a, c, g, or t
  modified_base (310)..(310): a, c, t, g, unknown or other
  misc_feature (310)..(310): n is a, c, g, or t
  modified_base (322)..(322): a, c, t, g, unknown or other
  misc_feature (322)..(322): n is a, c, g, or t
tcagacatacgcgtcacgaccggtgctcgatttagtacagatcgttagggaaagggtctccgaaggcttcaacagtcctgtcccaggtgcagctacaacagtggggcgcaggactgttgaagccttcggagaccctgtccctcacctgcgctgtctatggtgggtctttcagtgattactactggagctggatccgccagcccccagggactgggcctggagtggagttggggaaatcgatcatactggaagcagcaagacccaaccgtccnaagaatcgagtcactctgtcagtagacacgtcccgganccagttcctccngaacctgaagtctatgaccgcgcggacacggctagtttacttactgtcgccggtactaaccgcgaccgtcgtgtaccttcgacccgaaacgacccgtcgggaccgtacgggaacccgtggtcctaccgtcctccgtcacgcctaccaccgaaccggccctacgtccgtccttcccctcgacccaccctcctaccaacgtaccgtaccgtcgtcggggccacgacggccggtaccgtcgggtccgtcggtcccgttacgggtacctaacgggtaccctaccgttacccgacggtccgttaacg

SEQ ID NO: 256167 - DNA, 759 bp, Homo sapiens
  misc_feature: GYAE6OF02FT7T3.22.24.C02.1.454.CMB.1.raw
  modified_base (304)..(304): a, c, t, g, unknown or other
  misc_feature (304)..(304): n is a, c, g, or t
  modified_base (318)..(318): a, c, t, g, unknown or other
  misc_feature (318)..(318): n is a, c, g, or t
tcagacatacgcgtcacgaccggtgctcgatttagtacagatcgttagggaaagggtctccgaaggcttcaacagtcctgtcccaggtgcagctacaacagtggggcgcaggactgttgaagccttcggagaccctgtccctcacctgcgctgtctatggtgggtctttcagtgattactactggagctggatccgccagcccccagggatgggcctggagtggagttggggaaatcgatcatactggaagcagcaaggacccaaccccgtccctacaacgaactcgagtcactctgtcagtanacaccgtcccggancccagttcctccctcggaacctgaacgttctagtcgaccgccgcgacgcggcttacgtttatcgtcggtcgtccggactaccggtcgccgtcggtcgtcccttcgaccccgtaaccgacccggtccggggacccgtaacggggaccccgtcgggtacccgtacccgtccgtccctccgaccgtcccgttacccgaacccggtacccgggtaccccgtaccgttccccggttacccgtttccccccgtacggcccccgtacccccgtttaccccgaccgtaaaccgccgtacccgaacccgttcccgggacccgggggtacccaacggtccccgggtccccggtcccgggtaccgggggtcccctacccgggtacccggttaccggggttacccggtaaaccggttaccccgttaaccccggtttccgaccccggttaccgg

SEQ ID NO: 256168 - DNA, 720 bp, Homo sapiens
  misc_feature: GYAE6OF02GN113.22.24.C02.1.454.CMB.1.raw
  modified_base (401)..(401): a, c, t, g, unknown or other
  misc_feature (401)..(401): n is a, c, g, or t
tcagacatacgcgtcacgaccggtgctcgatttagtacagatcgttagggaaagggtctccgaaggcttcaacagtcctgtcccaggtgcagctacaacagtggggcgcaggactgttgaagccttcggagaccctgtccctcacctgcgctgtctatggtgggtctttcagtgattactactggagctggatccgccagcccccagggatgggcctggagtggattggggaaatcgatcatactggaagcaagcaagaccaacccgtccctccaaagaatcgagtcactctgtcagtagacacggtcccggagccctaagttcctcccgtagaacctgaagtctaatcgaccgtccgcggaccacggctgtttaattactgtggccggtactaaccggtnccggcgtcgcccttgaacccccaaacgaccccgtacggggccgaaccgggtaacccgtggtacccgaccggtacctcccgtacgacgcccgtacccgaacccgtaacgggccccacgttcccggtccgttaccccccgttacgggacccctaccccgttaccctacccgtaacggaccgtaccgacccgttaccggtaccgggggtacccaaccgcgggtaaccccgggccccggttacggggcccgttacggtaccccggttagggtacccgtaaaccgggtacccgttaacccgtttacccggacccggttaaccgg

SEQ ID NO: 256169 - DNA, 830 bp, Homo sapiens
  misc_feature: GYAE6OF02FFT7Q.22.24.C02.1.454.CMB.1.raw
tcagacatacgcgtcacgaccggtgctcgatttagtacagatcgttagggaagggtctccgaaggcttcaacagtcctgtcccaggtgcagctacacagtgggcgcaggactgttgaagtccttcggagaccctgtccctcgacctgcgctgtctagtggtgggttcttacagtgacttactacgtggagtctaggactcccgccaccgccccgagggacgtcgggccgtgggagtggacgttagggaactcgtatcagtacgaggaacgcgacgaccgaaccgaacccgaaccccgtcctacgaacgtaacgtccgacgtcctactcgtacgtacgaggtacaccggtaccggtccgtacgtaccgttacgttcccgtaaccgtacgtaaccgtacggtaaccgttaccgtacggtcccggaccccggtcggtaccggtaccgtaccggtttcgtttacgttacctacggttcgacccggtaacccggtaacgtaccggtccgtcccggtcggtccgtacccgtaccgaacccggtacgttacccgggacgggtacccgtaacccgggtacccgttccggtcccgtacccgtcctacccgcggtaaccccgtcccgtaaccccgaacccgggttacccgacccgttaccggtcccccggtttaccccgtttacccgcccgggtaaccccttcccgaaaccgtccccggtaaacgcccgtacccgtccggtaccggtacgggcccacggtacccggggtcccgcccggtacggtcaccggttaacggtacccgtacgtaaccggttccacccggtttaccgaccgttcgg

SEQ ID NO: 256170 - DNA, 841 bp, Homo sapiens
  misc_feature: GYAE6OF02ILHN5.22.24.C02.1.454.CMB.1.raw
tcagacatacgcgtcacgaccggtgctcgatttagtacagatcgttagggaaagggtctccgaaggcttcaacagtcctgtcccaggtgcagctacaacagtggggcgcaggactgttgaagccttcggagaccctgtccctcacctgcgctgtctatggtgggtctttcagtgattactactggagctggataccgccagcccccagggagtcgggccctaggaggtggagttaggggaaatcgatcatactgggaagcagacaacgaccaacccggtcctacaagatacgagtaccacttctagtctagtacggaacacggtaccccggacgtccgtagttccctcccgtcgaaccgtcgtaacgttcagttcggaaccccggccggaccggaaccgtacggtccttagtttttacgtacgtttcggtacggccgttaaccgtaacccgtagtcccggcgttaccggtcttacccggtaaccccgaacgtaccccggtcgggtaacccggaacccggggtacccgttaccggttacccgtaacccggttcccgtaccccgttccggtaaccgtccccgttaaccccgacccgggtaaccccgggtaccccgttaccgtaccccgggtttaccccgttacccccgggttaccgtaccccccgtacccccgttacccgttaaccccgaccgtaaccgtccccgtaaccccgtccgggttacccggggaccgttacccggacccggtcccggtacccggtacccgggtcccggtacccgtcccggtccggttaaccggtacccggtaacccgtttacccgttacccggtccgttaacccggg

SEQ ID NO: 256171 - DNA, 769 bp, Homo sapiens
  misc_feature: GYAE6OF02G785Q.22.24.C02.1.454.CMB.1.raw
tcagacatacgcgtcacgaccggtgctcgatttagtacagatcgttagggaaagggtctccgaaggcttcaacagtcctgtcccaggtgcagctacaacagtggggcgcaggactgttgaagccttcggagaccctgtccctcacctgcgctgtctatggtgggtctttcagtgattactactggagctggatcccgcacgcccccagggatgggcctggaggtcggagttagggaaatcgatcatacgtggaagcagacaacgacccaacccgtccctacaagactcgacgtcacgtctgtacagtacgacgtaccgtcccggacgcctacgttccctacccgtacgaacctggaacgttaccgtacgtccggaacccggcccgacgggacaccggtcttaggttttaactacgttggtcggtaccggtaaccgttaaccggtcgcccggtcggtccgtcccgtttacccggaccccgaaaccggtaccccggtacgggggaacccgaaccggggtaaaccccgtttcgggtacccgtaacccggttccctcccgtaccgtaccggtccccgtacccgtaccccgaaaccgggtcccctaaccgttcccggttccccgttaccccgtaccggtaccctacccccgttcccgtaccgtaaccgccgtacccgtacccgtccggtaccgggaccgaccgtccggtcccggtcccgtcgggccttccgcggtacggtacaaccgggtaccctaccggtccgtaacgtccgg

SEQ ID NO: 256172 - DNA, 293 bp, Homo sapiens
  misc_feature: GYAE6OF01D0WQ0.31.81.H04.1.454.CMB.1.raw
  modified_base (289)..(293): a, c, t, g, unknown or other
  misc_feature (289)..(293): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgaactgtggctgcaccatctgtcttcatcttcccgcatctgaacgtctactgctgagcgggctggcaaggcgcatagnnnnn

SEQ ID NO: 256173 - DNA, 294 bp, Homo sapiens
  misc_feature: GYAE6OF01EQ95A.31.81.H04.1.454.CMB.1.raw
  modified_base (290)..(294): a, c, t, g, unknown or other
  misc_feature (290)..(294): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgaactgtggctgcaccatctgtcttcatcttcccgccatctgaacgtctactgctgagcgggctggcaaggcgcatagnnnnn

SEQ ID NO: 256174 - DNA, 294 bp, Homo sapiens
  misc_feature: GYAE6OF01CB64X.31.81.H04.1.454.CMB.1.raw
  modified_base (289)..(294): a, c, t, g, unknown or other
  misc_feature (289)..(294): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgaactgtggctgcaccatctgtcttcatcttcccgcatctgaacgtctactgctgagcgggctggcaaggcgcatagnnnnnn

SEQ ID NO: 256175 - DNA, 296 bp, Homo sapiens
  misc_feature: GYAE6OF01ENUR2.31.81.H04.1.454.CMB.1.raw
  modified_base (292)..(296): a, c, t, g, unknown or other
  misc_feature (292)..(296): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatactttctttcgtcactttcggcggagggaccaaggtggagatcaaacgaactgtggctgcaccatctgtcttcatcttcccgccatctgaacgtctactgctgagcgggctgggcaaggcgcatagnnnnn

SEQ ID NO: 256176 - DNA, 292 bp, Homo sapiens
  misc_feature: GYAE6OF01CFHOS.31.81.H04.1.454.CMB.1.raw
  modified_base (287)..(292): a, c, t, g, unknown or other
  misc_feature (287)..(292): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgaactgtggctgcaccatctgtcttcatctccgcatctgaacgtctactgctgagcgggctggcaaggcgcatagnnnnnn

SEQ ID NO: 256177 - DNA, 358 bp, Homo sapiens
  misc_feature: GYAE6OF01A49RY.31.81.H04.1.454.CMB.1.raw
  modified_base (293)..(293): a, c, t, g, unknown or other
  misc_feature (293)..(293): n is a, c, g, or t
  modified_base (298)..(301): a, c, t, g, unknown or other
  misc_feature (298)..(301): n is a, c, g, or t
  modified_base (303)..(303): a, c, t, g, unknown or other
  misc_feature (303)..(303): n is a, c, g, or t
  modified_base (305)..(306): a, c, t, g, unknown or other
  misc_feature (305)..(306): n is a, c, g, or t
  modified_base (308)..(358): a, c, t, g, unknown or other
  misc_feature (308)..(358): n is a, c, g, or t
tcagcagtagacgtcacgaccggtgctcgatttagtagtgtagattcgcgggcgatccggggttcctaaccgattcattggcagcgggtctgggaccgatttcactctcgaccatcagcagccctgcaggctgaagatgtggtcagtttattaactgtcagtcaacattactacttctttcgtcactttcggcggagggaccaaggtggagatcaaacgactgtggctgcaccatctgtcttcatcttcccgcatcctgaaccgtctactgctgacgcgggctggccaaggcnatagnnnngncnncnnnnnnnnnnnnnnnnnnnnnnnnnnnnnnnnnnnnnnnnnnnnnnnnnnn

SEQ ID NO: 256178 - DNA, 294 bp, Homo sapiens
  misc_feature: GYAE6OF01EIS6C.31.81.H04.1.454.CMB.1.raw
  modified_base (288)..(294): a, c, t, g, unknown or other
  misc_feature (288)..(294): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgactgtggctgcaccatctgtcttcatcttcccgcatctgaacgtctactgctgagcgggctggcaaggcgcatagnnnnnnn

SEQ ID NO: 256179 - DNA, 293 bp, Homo sapiens
  misc_feature: GYAE6OF01BWWBB.31.81.H04.1.454.CMB.1.raw
  modified_base (288)..(293): a, c, t, g, unknown or other
  misc_feature (288)..(293): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgaactgtggctgcaccatctgtcttcatcttcccgcatctgaacgtctactgctgagcggctggcaaggcgcatagnnnnnn

SEQ ID NO: 256180 - DNA, 293 bp, Homo sapiens; identical to SEQ ID NO: 256172
  misc_feature: GYAE6OF01BT0HN.31.81.H04.1.454.CMB.1.raw
  modified_base (289)..(293): a, c, t, g, unknown or other
  misc_feature (289)..(293): n is a, c, g, or t

SEQ ID NO: 256181 - DNA, 294 bp, Homo sapiens; identical to SEQ ID NO: 256173
  misc_feature: GYAE6OF01DNEO1.31.81.H04.1.454.CMB.1.raw
  modified_base (290)..(294): a, c, t, g, unknown or other
  misc_feature (290)..(294): n is a, c, g, or t

SEQ ID NO: 256182 - DNA, 292 bp, Homo sapiens
  misc_feature: GYAE6OF01DU4QU.31.81.H04.1.454.CMB.1.raw
  modified_base (278)..(278): a, c, t, g, unknown or other
  misc_feature (278)..(278): n is a, c, g, or t
  modified_base (284)..(292): a, c, t, g, unknown or other
  misc_feature (284)..(292): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgactgtggctgcaccatctgtcttcatctccgcatctgaacgtctactgctgagcggctggcaggcncatagnnnnnnnnn

SEQ ID NO: 256183 - DNA, 318 bp, Homo sapiens
  misc_feature: GYAE6OF01D6QAF.31.81.H04.1.454.CMB.1.raw
  modified_base (300)..(318): a, c, t, g, unknown or other
  misc_feature (300)..(318): n is a, c, g, or t
tcagcagtagacgtcacgaccggtgctcgatttagtagtgtagattcgcgggcgatccggggttcctaaccggattcattggcagcgggtctgggacccgatttcactctcaccatcagcagcctgcaggctgaagatgtggcagtttattactgtcagtcaactatttaatacttctttcgtcactttcggcggagggaccaaggtggagatcgaaacgactgtggctggcaccatctgtcttcatcttcccgccatcttgaacgtctactgctgagcgggctggcaaggcgcataggnnnnnnnnnnnnnnnnnnn

SEQ ID NO: 256184 - DNA, 294 bp, Homo sapiens; identical to SEQ ID NO: 256174
  misc_feature: GYAE6OF01AVIUD.31.81.H04.1.454.CMB.1.raw
  modified_base (289)..(294): a, c, t, g, unknown or other
  misc_feature (289)..(294): n is a, c, g, or t

SEQ ID NO: 256185 - DNA, 294 bp, Homo sapiens; identical to SEQ ID NO: 256173
  misc_feature: GYAE6OF01E20DF.31.81.H04.1.454.CMB.1.raw
  modified_base (290)..(294): a, c, t, g, unknown or other
  misc_feature (290)..(294): n is a, c, g, or t

SEQ ID NO: 256186 - DNA, 297 bp, Homo sapiens
  misc_feature: GYAE6OF01EMCJ7.31.81.H04.1.454.CMB.1.raw
  modified_base (290)..(297): a, c, t, g, unknown or other
  misc_feature (290)..(297): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgaactgtggctgcaccatctgtcttcatcttcccgccatctgaacgtctactgctgagcgggctggcaaggcgcatagnnnnnnnn

SEQ ID NO: 256187 - DNA, 289 bp, Homo sapiens
  misc_feature: GYAE6OF01AOJ6Q.31.81.H04.1.454.CMB.1.raw
  modified_base (273)..(273): a, c, t, g, unknown or other
  misc_feature (273)..(273): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgaactgtggctgcaccatctgtcttcatcttcccgccatctgaacgtctactgctgagcggntggcaaggcncatagn

SEQ ID NO: 256188 - DNA, 419 bp, Homo sapiens
  misc_feature: GYAE6OF01A7YC6.31.81.H04.1.454.CMB.1.raw
  modified_base (248)..(248): a, c, t, g, unknown or other
  misc_feature (248)..(248): n is a, c, g, or t
  modified_base (372)..(372): a, c, t, g, unknown or other
  misc_feature (372)..(372): n is a, c, g, or t
  modified_base (375)..(377): a, c, t, g, unknown or other
  misc_feature (375)..(377): n is a, c, g, or t
  modified_base (379)..(419): a, c, t, g, unknown or other
  misc_feature (379)..(419): n is a, c, g, or t
tcagcagtagacgtcacgaccggtgctcgatttagtagtgtagattcgcggggcatccggggttcctaacccgattcattggcagcgggtctggggacccgatttcactctcacccatcagcacgccgtcgcgagggctgaagatggtggctagttttattactgtcagcaacattatacttctttcgtctacttcggcgggacgggaccgaagggtggagatacaaacgaacgtggtggcgtcgccncctaaaaaaaaaactcgtcgttcttctacttccttcccgacctactcgtacgtaaccgttaccttaccttcgccgtgacggtacgggtcgtggtaccggacgggccggacgtaacgacggtagncgnnngnnnnnnnnnnnnnnnnnnnnnnnnnnnnnnnnnnnnnnnnn

SEQ ID NO: 256189 - DNA, 295 bp, Homo sapiens
  misc_feature: GYAE6OF01B93BP.31.81.H04.1.454.CMB.1.raw
  modified_base (287)..(295): a, c, t, g, unknown or other
  misc_feature (287)..(295): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgactgtggctgcaccatctgtcttcatcttcccgcatctgaacgtctactgctgagcggctggcaaggcgcatagnnnnnnnnn

SEQ ID NO: 256190 - DNA, 291 bp, Homo sapiens
  misc_feature: GYAE6OF01D9YS7.31.81.H04.1.454.CMB.1.raw
  modified_base (285)..(291): a, c, t, g, unknown or other
  misc_feature (285)..(291): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcgagggaccaaggtggagatcaaacgaactgtggctgcaccatctgtctcatcttccgcatctgaacgtctactgctgagcggctggcaaggcgcatagnnnnnnn

SEQ ID NO: 256191 - DNA, 296 bp, Homo sapiens
  misc_feature: GYAE6OF01B6ENP.31.81.H04.1.454.CMB.1.raw
  modified_base (289)..(296): a, c, t, g, unknown or other
  misc_feature (289)..(296): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgaactgtggctgcaccatctgtcttcatcttcccgcatctgaacgtctactgctgagcgggctggcaaggcgcatagnnnnnnnn

SEQ ID NO: 256192 - DNA, 292 bp, Homo sapiens
  misc_feature: GYAE6OF01D0FR3.31.81.H04.1.454.CMB.1.raw
  modified_base (288)..(292): a, c, t, g, unknown or other
  misc_feature (288)..(292): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggaggaccaaggtggagatacaaacgaactgtggctgcaccatctgtcttcatccttccgcatctgaacgtctactgctgagcggctggcaaggcgcatagnnnnn

SEQ ID NO: 256193 - DNA, 297 bp, Homo sapiens
  misc_feature: GYAE6OF01EIATW.31.81.H04.1.454.CMB.1.raw
  modified_base (290)..(297): a, c, t, g, unknown or other
  misc_feature (290)..(297): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaaacgaactgtggctgcacatctgtcttcatcttcccgcatctgaacgtctactgctgagcgggctggcaaggcgacatagnnnnnnnn

SEQ ID NO: 256194 - DNA, 297 bp, Homo sapiens
  misc_feature: GYAE6OF01AS16W.31.81.H04.1.454.CMB.1.raw
  modified_base (283)..(283): a, c, t, g, unknown or other
  misc_feature (283)..(283): n is a, c, g, or t
  modified_base (289)..(297): a, c, t, g, unknown or other
  misc_feature (289)..(297): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgactgtggctgcaccatctgtcttcatccttcccgcatctgaacgtctactgctgacgcggctggcaaggcncatagnnnnnnnnn

SEQ ID NO: 256195 - DNA, 306 bp, Homo sapiens
  misc_feature: GYAE6OF01DD59B.31.81.H04.1.454.CMB.1.raw
  modified_base (296)..(306): a, c, t, g, unknown or other
  misc_feature (296)..(306): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatacaaacgaactgtggctgcaccatctgtcttacattcctcccgcatcctgaaccgtctactgcctggagcggctggctaaggcgcatagnnnnnnnnnnn

SEQ ID NO: 256196 - DNA, 434 bp, Homo sapiens
  misc_feature: GYAE6OF01D5O7Z.31.81.H04.1.454.CMB.1.raw
  modified_base (135)..(135): a, c, t, g, unknown or other
  misc_feature (135)..(135): n is a, c, g, or t
  modified_base (138)..(138): a, c, t, g, unknown or other
  misc_feature (138)..(138): n is a, c, g, or t
  modified_base (151)..(151): a, c, t, g, unknown or other
  misc_feature (151)..(151): n is a, c, g, or t
  modified_base (163)..(163): a, c, t, g, unknown or other
  misc_feature (163)..(163): n is a, c, g, or t
  modified_base (212)..(212): a, c, t, g, unknown or other
  misc_feature (212)..(212): n is a, c, g, or t
  modified_base (267)..(267): a, c, t, g, unknown or other
  misc_feature (267)..(267): n is a, c, g, or t
  modified_base (329)..(329): a, c, t, g, unknown or other
  misc_feature (329)..(329): n is a, c, g, or t
  modified_base (357)..(357): a, c, t, g, unknown or other
  misc_feature (357)..(357): n is a, c, g, or t
  modified_base (371)..(371): a, c, t, g, unknown or other
  misc_feature (371)..(371): n is a, c, g, or t
  modified_base (374)..(434): a, c, t, g, unknown or other
  misc_feature (374)..(434): n is a, c, g, or t
tcagcagtagacgtcacgaccggtgctcgatttagtagtgtagattcgcgggcatcccggggttcctaaccgattcattggcagcgggtctgggaccgatttcactctcaccatcagcagcctgcaggctgaagntgnggcagtttatacngtcagcaaactnttatctttctttcgcacgtttcgggacgggaagggaccaagggtggaanacgtaaaccgaaacggtactggtggccttgacacccgtattccgttggtcctttnacttcccgttccccgctaattccgtagaaacccgttctaacgtgacgtaggacggccggggntacgggaccgaagggccctactagaggntccagcagcgttanccnnnnnnnnnnnnnnnnnnnnnnnnnnnnnnnnnnnnnnnnnnnnnnnnnnnnnnnnnnnnn

SEQ ID NO: 256197 - DNA, 299 bp, Homo sapiens
  misc_feature: GYAE6OF01ENBA8.31.81.H04.1.454.CMB.1.raw
  modified_base (290)..(299): a, c, t, g, unknown or other
  misc_feature (290)..(299): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagttttattactgtcagcaacattatactttctttcgtctactttcggcggagggaccaaggtggagatcaaacgaactgtggctgcaccatctgtcttcatctcccgcatctgaacgtctactgctgagcggctggcaaggcgcatagnnnnnnnnnn

SEQ ID NO: 256198 - DNA, 393 bp, Homo sapiens
  misc_feature: GYAE6OF01B5SXX.31.81.H04.1.454.CMB.1.raw
  modified_base (366)..(393): a, c, t, g, unknown or other
  misc_feature (366)..(393): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggctagtttatactgtcagacaacattatacttcgtttccgtctacgtttcgggacggacgggtaccgaagggtggaagactaacgaaacgtaacgtggtcggctgaccaccgtattcgtcgttccttactacttcccgtttaccccgctacgttccgttacggaaaccttccgttaactcgcttggaacgggtcggggaccttagggaccaagggtcgcttaagagcnnnnnnnnnnnnnnnnnnnnnnnnnnnn

SEQ ID NO: 256199 - DNA, 302 bp, Homo sapiens
  misc_feature: GYAE6OF01CAR4C.31.81.H04.1.454.CMB.1.raw
  modified_base (275)..(275): a, c, t, g, unknown or other
  misc_feature (275)..(275): n is a, c, g, or t
  modified_base (291)..(302): a, c, t, g, unknown or other
  misc_feature (291)..(302): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggctagttttatactgtcagcaacattatactttctttcgtctacgtttcggcggagggaccaaggtggagatacaaacgactgtggctgacaccatctgtctcatcctccgcatctgaacgtctactgctgagcggntggcaaggcgcagtgnnnnnnnnnnnn

SEQ ID NO: 256200 - DNA, 475 bp, Homo sapiens
  misc_feature: GYAE6OF01DEW98.31.81.H04.1.454.CMB.1.raw
  modified_base (133)..(133): a, c, t, g, unknown or other
  misc_feature (133)..(133): n is a, c, g, or t
  modified_base (251)..(251): a, c, t, g, unknown or other
  misc_feature (251)..(251): n is a, c, g, or t
  modified_base (366)..(366): a, c, t, g, unknown or other
  misc_feature (366)..(366): n is a, c, g, or t
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (407)..(407): a, c, t, g, unknown or other
  misc_feature (407)..(407): n is a, c, g, or t
  modified_base (412)..(475): a, c, t, g, unknown or other
  misc_feature (412)..(475): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaanatgtggctagtttattactgtcagacaactattaattctttactttcgtcttaccgtttccgggacgggtaacggaaccgtaagggtcggaagtactaaccgaaaacgtaacgttggngggtcctcggaccctacctaattccgttggtttccctttacgtaaacccttcccttccccggaactacttcgtacgtaaccgttctaaccgtgtcgtaggaccgggcgggtaacngggaccaacgggtactactaggtaggcncnggtcncagncntgacnnnnnnnnnnnnnnnnnnnnnnnnnnnnnnnnnnnnnnnnnnnnnnnnnnnnnnnnnnnnnnnn

SEQ ID NO: 256201 - DNA, 299 bp, Homo sapiens
  misc_feature: GYAE6OF02G8KLT.31.81.H04.1.454.CMB.1.raw
  modified_base (290)..(299): a, c, t, g, unknown or other
  misc_feature (290)..(299): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgaactgtggctgcaccatctgtcttcatcttcccgccatctgaacgtctactgctgagcgggctggcaaggcgcatagnnnnnnnnnn

SEQ ID NO: 256202 - DNA, 294 bp, Homo sapiens
  misc_feature: GYAE6OF02JAZ6G.31.81.H04.1.454.CMB.1.raw
  modified_base (284)..(284): a, c, t, g, unknown or other
  misc_feature (284)..(284): n is a, c, g, or t
  modified_base (290)..(294): a, c, t, g, unknown or other
  misc_feature (290)..(294): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgaactgtggctgcaccatctgtcttcatcttcccgccatctgaacgtctactgctgagcgggctggcaaggcncatagnnnnn

SEQ ID NO: 256203 - DNA, 352 bp, Homo sapiens
  misc_feature: GYAE6OF02FW36T.31.81.H04.1.454.CMB.1.raw
  modified_base (307)..(309): a, c, t, g, unknown or other
  misc_feature (307)..(309): n is a, c, g, or t
  modified_base (311)..(352): a, c, t, g, unknown or other
  misc_feature (311)..(352): n is a, c, g, or t
tcagcagtagacgtcacgaccggtgctcgatttagtagtgtagattcgcggggcatccggggttcctaaccgattcattggcagcgggtctgggaccgatttcactcgtcaccatcagcagcctgcaggctgaagatgtggcagtttatactgtctagctaacattataaccgttctttcgtcacttttcggcggagggcccaaggttggagatcaaacggaacttggtggctgcgaccatctgtcttcatcttcccgccatctgaacgtctactgactgaagcgggctgggcaaggcgcagtagcnnngnnnnnnnnnnnnnnnnnnnnnnnnnnnnnnnnnnnnnnnnnn

SEQ ID NO: 256204 - DNA, 295 bp, Homo sapiens
  misc_feature: GYAE6OF02F6PKR.31.81.H04.1.454.CMB.1.raw
  modified_base (290)..(295): a, c, t, g, unknown or other
  misc_feature (290)..(295): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgaactgtggctgcaccatctgtcttcatcttcccgccatctgaacgtctactgctgagcgggctggcaaggcgcatagnnnnnn

SEQ ID NO: 256205 - DNA, 293 bp, Homo sapiens
  misc_feature: GYAE6OF02IGC6A.31.81.H04.1.454.CMB.1.raw
  modified_base (289)..(293): a, c, t, g, unknown or other
  misc_feature (289)..(293): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggaggaccaaggtggagatcaaacgaactgtggctgcaccatctgtcttcatcttcccgccatctgaacgtctactgctgagcgggctggcaaggcgcatagnnnnn

SEQ ID NO: 256206 - DNA, 299 bp, Homo sapiens
  misc_feature: GYAE6OF02G3U2K.31.81.H04.1.454.CMB.1.raw
  modified_base (288)..(299): a, c, t, g, unknown or other
  misc_feature (288)..(299): n is a, c, g, or t
tcagcagtagacgtcacgaccggtgctcgatttagtagtgtagattcgcgggcagtccggggttcctaaccgattcattggcagcgggtctgggaccgatttcactctcaccatcagcagcctgcaggctgaagatgtggcagtttattactgtcagcaacattatacttctttcgtcactttcggcgagggccaaggtggagatcaaacgactgtggctgcaccatctgtcttcatcttcccgcatctgaacgtctaactgctgagcgggctggcaaggcgcatagnnnnnnnnnnnn

SEQ ID NO: 256207 - DNA, 295 bp, Homo sapiens
  misc_feature: GYAE6OF02G69XW.31.81.H04.1.454.CMB.1.raw
  modified_base (289)..(295): a, c, t, g, unknown or other
  misc_feature (289)..(295): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgaactgtggctgcaccatctgtcttcatcttcccgcatctgaacgtctactgctgagcgggctggcaaggcgcatagnnnnnnn

SEQ ID NO: 256208 - DNA, 293 bp, Homo sapiens
  misc_feature: GYAE6OF02F1PNL.31.81.H04.1.454.CMB.1.raw
  modified_base (290)..(293): a, c, t, g, unknown or other
  misc_feature (290)..(293): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgaactgtggctgcaccatctgtcttcatcttcccgccatctgaacgtctactgctgagcgggctggcaaggcgcatagnnnn

SEQ ID NO: 256209 - DNA, 298 bp, Homo sapiens
  misc_feature: GYAE6OF02FKOVS.31.81.H04.1.454.CMB.1.raw
  modified_base (291)..(298): a, c, t, g, unknown or other
  misc_feature (291)..(298): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgaactgtggctgcaccatctgtcttcatcttcccgccatctgaacgtctactgctgagcgggctgggcaaggcgcatagnnnnnnnn

SEQ ID NO: 256210 - DNA, 295 bp, Homo sapiens
  misc_feature: GYAE6OF02HJYKJ.31.81.H04.1.454.CMB.1.raw
  modified_base (288)..(295): a, c, t, g, unknown or other
  misc_feature (288)..(295): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgaactgtggctgcaccatctgtcttcatcttcccgcatctgaacgtctactgctgagcggctggcaaggcgcatagnnnnnnnn

SEQ ID NO: 256211 - DNA, 294 bp, Homo sapiens
  misc_feature: GYAE6OF02JTTYK.31.81.H04.1.454.CMB.1.raw
  modified_base (280)..(280): a, c, t, g, unknown or other
  misc_feature (280)..(280): n is a, c, g, or t
  modified_base (285)..(294): a, c, t, g, unknown or other
  misc_feature (285)..(294): n is a, c, g, or t
tcagcagtagacgtcacgaccggtgctcgatttagtagtgtagattcgcgggcatccgggttcctaaccgattcattggcagcgggtctgggaccgatttcactctcaccatcagcagcctgcaggctgaagatgtggcagtttatactgtcagcaacattatacttctttcgtcactttcggcggtagggaccaaggtggagatcaaacgactgtggctagcaccatctgtcttcatcttccgcatctgaacgtctactgctgagcggctggcaaggcncatgnnnnnnnnnn

SEQ ID NO: 256212 - DNA, 297 bp, Homo sapiens; identical to SEQ ID NO: 256186
  misc_feature: GYAE6OF02HZ92S.31.81.H04.1.454.CMB.1.raw
  modified_base (290)..(297): a, c, t, g, unknown or other
  misc_feature (290)..(297): n is a, c, g, or t

SEQ ID NO: 256213 - DNA, 300 bp, Homo sapiens
  misc_feature: GYAE6OF02HUPUI.31.81.H04.1.454.CMB.1.raw
  modified_base (291)..(300): a, c, t, g, unknown or other
  misc_feature (291)..(300): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcacttttcggcggagggaccaaggtggagatcaaacgaactgtggctgcaccatctgtcttcatcttcccgccatctgaacgtctactgctgagcgggctggcaaggcgcatagnnnnnnnnnn

SEQ ID NO: 256214 - DNA, 301 bp, Homo sapiens
  misc_feature: GYAE6OF02JTZ0Z.31.81.H04.1.454.CMB.1.raw
  modified_base (289)..(301): a, c, t, g, unknown or other
  misc_feature (289)..(301): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagttttattactgtcagcaacattatacttctttcgtcactttcggcggagggaccaaggtgagatcaaacgactgtggctgcaccatctgtcttcatcttcccgcatctgaacgtctactgctgagcgggctggcaaggcgcagtagnnnnnnnnnnnnn

SEQ ID NO: 256215 - DNA, 296 bp, Homo sapiens
  misc_feature: GYAE6OF02ITEB8.31.81.H04.1.454.CMB.1.raw
  modified_base (287)..(296): a, c, t, g, unknown or other
  misc_feature (287)..(296): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcgagggaccaaggtggagatcaaacgaactgtggctgcaccatctgtcttcatcttccgccatctgaacgtctactgctgagcggctggcaaggcgcatagnnnnnnnnnn

SEQ ID NO: 256216 - DNA, 294 bp, Homo sapiens; identical to SEQ ID NO: 256174
  misc_feature: GYAE6OF02HMKJF.31.81.H04.1.454.CMB.1.raw
  modified_base (289)..(294): a, c, t, g, unknown or other
  misc_feature (289)..(294): n is a, c, g, or t

SEQ ID NO: 256217 - DNA, 662 bp, Homo sapiens
  misc_feature: GYAE6OF02GGCLW.31.81.H04.1.454.CMB.1.raw
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
  modified_base (451)..(451): a, c, t, g, unknown or other
  misc_feature (451)..(451): n is a, c, g, or t
  modified_base (458)..(458): a, c, t, g, unknown or other
  misc_feature (458)..(458): n is a, c, g, or t
  modified_base (461)..(461): a, c, t, g, unknown or other
  misc_feature (461)..(461): n is a, c, g, or t
  modified_base (485)..(485): a, c, t, g, unknown or other
  misc_feature (485)..(485): n is a, c, g, or t
  modified_base (493)..(493): a, c, t, g, unknown or other
  misc_feature (493)..(493): n is a, c, g, or t
  modified_base (506)..(506): a, c, t, g, unknown or other
  misc_feature (506)..(506): n is a, c, g, or t
tcagcagtagacgtcacgaccggtgctcgatttagtagtgtagattcgcgggcagtccgggttcctaaccgattcagttggcagcgggtctgggaccgatttcactctcaccatcagcagcctgcaggctgaagatgtggcagtttatactgtcagccaacgattatacgttctttcgtcgaactttcgggcggacgggacccaagggtcggaagagtaccaaaaacggaaccttggtcggacttaggcctaacccgaattccgtcgtacctttacgaaagttccctttacccccgcctaacgtttccgtacggaaaaccgttcccttaaacgtacggaccgttacggaacggccccggggggtaccttaggggaccaaaacggggtccccgtaccgttaaaggttaggctacgtcgaccggtgtaccggccaagccttncgngcgtacgngcgttanganagagtgtactacgtacgtacacgnacacgacncgtcgcgagacgngagagtagtgtcgagtagtagtactagtagacgtagtagtatagtacgtcgtactcgtcgttacgtacggtacgacgtacgagtagacgacgtaacgtacgtacggtacgacgtcgtacgacgtacgtacgtacgtacgttcgtaccgtactaccg

SEQ ID NO: 256218 - DNA, 295 bp, Homo sapiens
  misc_feature: GYAE6OF02G7GHG.31.81.H04.1.454.CMB.1.raw
  modified_base (291)..(295): a, c, t, g, unknown or other
  misc_feature (291)..(295): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaaacgaactgtggctgcaccatctgtcttcatcttcccgcatctgaacgtctactgctgagcgggctgggcaaggcgcatagnnnnn

SEQ ID NO: 256219 - DNA, 291 bp, Homo sapiens
  misc_feature: GYAE6OF02F264Q.31.81.H04.1.454.CMB.1.raw
  modified_base (290)..(291): a, c, t, g, unknown or other
  misc_feature (290)..(291): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgaactgtggctgcaccatctgtcttcatcttcccgccatctgaacgtctactgctgagcgggctggcaaggcgcatagnn

SEQ ID NO: 256220 - DNA, 293 bp, Homo sapiens
  misc_feature: GYAE6OF02GJFD7.31.81.H04.1.454.CMB.1.raw
  modified_base (288)..(293): a, c, t, g, unknown or other
  misc_feature (288)..(293): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgactgtggctgcaccatctgtcttcatcttcccgcatctgaacgtctactgctgagcgggctggcaaggcgcatagnnnnnn

SEQ ID NO: 256221 - DNA, 548 bp, Homo sapiens
  misc_feature: GYAE6OF02HM054.31.81.H04.1.454.CMB.1.raw
  modified_base (292)..(292): a, c, t, g, unknown or other
  misc_feature (292)..(292): n is a, c, g, or t
  modified_base (310)..(311): a, c, t, g, unknown or other
  misc_feature (310)..(311): n is a, c, g, or t
  modified_base (313)..(313): a, c, t, g, unknown or other
  misc_feature (313)..(313): n is a, c, g, or t
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
  modified_base (325)..(325): a, c, t, g, unknown or other
  misc_feature (325)..(325): n is a, c, g, or t
  modified_base (327)..(327): a, c, t, g, unknown or other
  misc_feature (327)..(327): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
  modified_base (351)..(351): a, c, t, g, unknown or other
  misc_feature (351)..(351): n is a, c, g, or t
  modified_base (354)..(354): a, c, t, g, unknown or other
  misc_feature (354)..(354): n is a, c, g, or t
  modified_base (356)..(356): a, c, t, g, unknown or other
  misc_feature (356)..(356): n is a, c, g, or t
  modified_base (359)..(359): a, c, t, g, unknown or other
  misc_feature (359)..(359): n is a, c, g, or t
  modified_base (362)..(362): a, c, t, g, unknown or other
  misc_feature (362)..(362): n is a, c, g, or t
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagttatgtggcagtttattactgtcagcaacatttatactttctttcgtctacttttcgggcggagggaccaaaggtcggaagataccaaaacggtaactggtggctagccaccatctgtcttcatcttccgctatctgaacgttctactgctgacgcggntggactaaggcacatagnncngncgtancgatnangtcagtcaangctnatgactcgtntancntanagngctaacgcgtacgcgtcagtcgcgtcgtaancgtacgtcgntaagtctgactagcgtactcgtgtcctaagtacgtcgtagacgtacgtacgtacggtcgacgttacggtagtcccgttaacggtctcgtaacggttcctacggttagttaaccgtacgttaacgtccgtacgttaccgtagtccg

SEQ ID NO: 256222 - DNA, 295 bp, Homo sapiens
  misc_feature: GYAE6OF02HOWBP.31.81.H04.1.454.CMB.1.raw
  modified_base (280)..(280): a, c, t, g, unknown or other
  misc_feature (280)..(280): n is a, c, g, or t
  modified_base (286)..(295): a, c, t, g, unknown or other
  misc_feature (286)..(295): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgactgtgctgcaccatctgtcttcatcttcccgcatctgaacgtctactgctgagcggctggcaaggcncatagnnnnnnnnnn

SEQ ID NO: 256223 - DNA, 310 bp, Homo sapiens
  misc_feature: GYAE6OF02FH1QY.31.81.H04.1.454.CMB.1.raw
  modified_base (235)..(235): a, c, t, g, unknown or other
  misc_feature (235)..(235): n is a, c, g, or t
  modified_base (287)..(287): a, c, t, g, unknown or other
  misc_feature (287)..(287): n is a, c, g, or t
  modified_base (294)..(310): a, c, t, g, unknown or other
  misc_feature (294)..(310): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgcactttcggcggagggaccaaggtggagatcaaacgactgtggctgcaccatctgtcttnattccttccccgctatctgaacgtctactgctgacgcgggctaggcaaggcncgatagnnnnnnnnnnnnnnnnn

SEQ ID NO: 256224 - DNA, 306 bp, Homo sapiens
  misc_feature: GYAE6OF02GUPSJ.31.81.H04.1.454.CMB.1.raw
  modified_base (297)..(306): a, c, t, g, unknown or other
  misc_feature (297)..(306): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaaacgaactgtggctgcaccatctgtcttcatcttcccgcatctgaacgtctaactgctgaaggcgggctggcaaaggcgtacaatagnnnnnnnnnn

SEQ ID NO: 256225 - DNA, 303 bp, Homo sapiens
  misc_feature: GYAE6OF02GADJ8.31.81.H04.1.454.CMB.1.raw
  modified_base (286)..(286): a, c, t, g, unknown or other
  misc_feature (286)..(286): n is a, c, g, or t
  modified_base (289)..(303): a, c, t, g, unknown or other
  misc_feature (289)..(303): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggagggaccaaggtggagatcaaacgaactgtgctgcacatctgtcttcatctcccgccatctgaacgtctactgctgagcggctggcaaggcgcatagnagnnnnnnnnnnnnnnn

SEQ ID NO: 256226 - DNA, 304 bp, Homo sapiens
  misc_feature: GYAE6OF02FRLV3.31.81.H04.1.454.CMB.1.raw
  modified_base (287)..(287): a, c, t, g, unknown or other
  misc_feature (287)..(287): n is a, c, g, or t
  modified_base (293)..(304): a, c, t, g, unknown or other
  misc_feature (293)..(304): n is a, c, g, or t
tcagcagtagacgtcacgaccggtgctcgatttagtagtgtagattcgcgggcatccggggttcctaaccgattcattggcagcgggtctgggaccgatttcactctcaccatcagcagcctgcaggctgaagatgtggcagtttattactgtcagcaacattatacttctttcgtcactttcggcggaggaccaaggtgagatacaaacgaactgtggctgcaccatctgtacttcatcttcccgcaatcctagaaccgtctactgctgaggcggctggcaaggcncaatgnnnnnnnnnnnn

SEQ ID NO: 256227 - DNA, 156 bp, Homo sapiens
  misc_feature: GYAE6OF01C0085.34.31.C09.1.454.CMB.1.raw
  modified_base (156)..(156): a, c, t, g, unknown or other
  misc_feature (156)..(156): n is a, c, g, or t
tcagtacacgtgatcacgaccggtgctcgatttagacgtctcatcaaggaaggaagggaccaaggtggagatcaaacgaactgtggctgcaccatctgtcttcatcttcccgccatctgaatcacgtgtactgagcgggctggcaaggcgcatagn

SEQ ID NO: 256228 - DNA, 157 bp, Homo sapiens
  misc_feature: GYAE6OF01CJGOR.34.31.C09.1.454.CMB.1.raw
  modified_base (156)..(157): a, c, t, g, unknown or other
  misc_feature (156)..(157): n is a, c, g, or t
tcagtacacgtgatcacgaccggtgctcgatttagacgtctcatcaaggaaggaagggaccaaggtggagatcaaacgaactgtggctgcaccatctgtcttcatcttcccgccatctgaatcacgtgtactgagcgggctggcaaggcgcatagnn

SEQ ID NO: 256229 - DNA, 156 bp, Homo sapiens; identical to SEQ ID NO: 256227
  misc_feature: GYAE6OF01AE9BQ.34.31.C09.1.454.CMB.1.raw
  modified_base (156)..(156): a, c, t, g, unknown or other
  misc_feature (156)..(156): n is a, c, g, or t

SEQ ID NO: 256230 - DNA, 450 bp, Homo sapiens
  misc_feature: GYAE6OF01D98PN.34.31.C09.1.454.CMB.1.raw
  modified_base (306)..(306): a, c, t, g, unknown or other
  misc_feature (306)..(306): n is a, c, g, or t
  modified_base (345)..(345): a, c, t, g, unknown or other
  misc_feature (345)..(345): n is a, c, g, or t
  modified_base (437)..(450): a, c, t, g, unknown or other
  misc_feature (437)..(450): n is a, c, g, or t
tcagtacacgtgatcacgaccggtgctcgatttagacgtctcatcaaggaaggaaggggctggagtgggtctcaactattagtggtggtggtggtagcacatactacgcagactccgtgaagggccggttcaccatctccagagacaattccaagaacacgctgtttctgcaagtgaacagcctgagagccgaggacacggccgtatactactgtgcgaaagatgtgcaacgggttactagtggttcggggagtcaaccccgcttttgatatctggggccaagggacactggtcaccgtctcttcngcctccaccaggccatcgtctccctgcaccctcctcagncacctcgtggggcacacgcgaccctgggctcgccgtggcaaggactacgttccatcacgtgtactggacggcggctggcgaaggcgcatagnnnnnnnnnnnnnn

SEQ ID NO: 256231 - DNA, 158 bp, Homo sapiens
  misc_feature: GYAE6OF01BALKK.34.31.C09.1.454.CMB.1.raw
  modified_base (156)..(158): a, c, t, g, unknown or other
  misc_feature (156)..(158): n is a, c, g, or t
tcagtacacgtgatcacgaccggtgctcgatttagacgtctcatcaaggaaggaagggaccaaggtggagatcaaacgaactgtggctgcaccatctgtcttcatcttcccgccatctgaatcacgtgtactgagcgggctggcaaggcgcatagnnn

SEQ ID NO: 256232 - DNA, 158 bp, Homo sapiens; identical to SEQ ID NO: 256231
  misc_feature: GYAE6OF01B0KDK.34.31.C09.1.454.CMB.1.raw
  modified_base (156)..(158): a, c, t, g, unknown or other
  misc_feature (156)..(158): n is a, c, g, or t

SEQ ID NO: 256233 - DNA, 469 bp, Homo sapiens
  misc_feature: GYAE6OF01B2ECH.34.31.C09.1.454.CMB.1.raw
  modified_base (268)..(268): a, c, t, g, unknown or other
  misc_feature (268)..(268): n is a, c, g, or t
  modified_base (451)..(451): a, c, t, g, unknown or other
  misc_feature (451)..(451): n is a, c, g, or t
  modified_base (457)..(469): a, c, t, g, unknown or other
  misc_feature (457)..(469): n is a, c, g, or t
tcagtacacgtgatcacgaccggtgctcgatttagacgtctcatcaaggaaggaaggggctggagtgggtctcaactattagtggtggtggtggtagcacatactacgcagactccgtgaagggccggttcaccatctccagagacaattccaagaacacgctgtttctgcaagtgaacagcctgagagccgaggacacggccgtatactactgtgcgaaaagatgtgacaacgggttactagtgggttcggggagtccaaccccgtnttttgatatctggggccaagggacactggtcaccgtctcttcagcctccaccaagggcccatcggtccttcccctggccaccctcctccaagacgcacctcgtcgggggcacgacgccggcccgtcgggctcgcctggtcgaaggactacttccatcacgtgtactgagcggctggcaaggcncatagnnnnnnnnnnnnn

SEQ ID NO: 256234 - DNA, 461 bp, Homo sapiens
  misc_feature: GYAE6OF01C3AM0.34.31.C09.1.454.CMB.1.raw
  modified_base (262)..(262): a, c, t, g, unknown or other
  misc_feature (262)..(262): n is a, c, g, or t
  modified_base (454)..(461): a, c, t, g, unknown or other
  misc_feature (454)..(461): n is a, c, g, or t
tcagtacacgtgatcacgaccggtgctcgatttagacgtctcatcaaggaaggaaggggctggagtgggtctcaactattagtggtggtggtggtagcacatactacgcagactccgtgaagggccggttcaccatctccagagacaattccaagaacacgctgtttctgcaagtgaacagcctgagagccgaggacacggccgtatactactgtgcgaaagatgtgcaacgggttactagtggttcgggagtcaccccgtnttttgatatctggggccaagggacactggtcaccgtctcttcagcctccaccacggcccatccggtcttcccctggccacccctcctccaagacgcacctcgtgggggccacagccggcccgtgggctcgccgtggtcgaaggactacttccatccacgttcgtactgagcgggctggcaagggcgcatagnnnnnnnn

SEQ ID NO: 256235 - DNA, 880 bp, Homo sapiens
  misc_feature: GYAE6OF01D1WKU.34.31.C09.1.454.CMB.1.raw
tcagtacacgtgatcacgaccggtgctcgatttagacgtctcatcaaggaaggaagggggcagctctgagagaggagcccagccctgggattttcaggttgttttcatttggtgatcaggactgaacagagagaactcaccatggagtttgggctgagcgtggttctttttctggtggtctttaagttttaaaaggtgtcctaggtgtgaggtgcagtcttgttgacgtaggtcggtagggggatacgttaggtacgacggtcccgggttcggggggtcccctaggacgtaccttccgtccgttggcgaccgaccgtcccttcgtacggttactttacctacccttttagacgacgtcttagtaccgccgtaagtcggtcggtccggttccgggtccccggaccggacgggtaccccggtacggggaaaacggggggacggggtaccgttggggacgggttacggggttaccttaacgttaaacggtttaggtttaggggttggggtttgggttaagggggttcggtaacgaccgtaaacgtaaaccgtaaaccgtaccggtaactaccggtaaccggttaccgggaaccggggttaaacccgggggttccccgttaaccgtaaacccctcgttacccgtaaaccggtaacggtaaaccgtaaacttaacccgtaaccgtaaaaccgaaccgtcgtttacccgtttacgtttactcggtaacgtaaacggtagtaaacctacgttaccgacggtaacggaccggtacgaaccggtacccggtaaccggtaacccgttaacgtacgttaacgtgggtaacggaagtaaaacggtcgtaacggttacgggtaacggttaaaccggggtttagttaacggggg

SEQ ID NO: 256236 - DNA, 531 bp, Homo sapiens
  misc_feature: GYAE6OF01AJEF3.34.31.C09.1.454.CMB.1.raw
  modified_base (188)..(188): a, c, t, g, unknown or other
  misc_feature (188)..(188): n is a, c, g, or t
  modified_base (310)..(310): a, c, t, g, unknown or other
  misc_feature (310)..(310): n is a, c, g, or t
  modified_base (374)..(374): a, c, t, g, unknown or other
  misc_feature (374)..(374): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
  modified_base (507)..(507): a, c, t, g, unknown or other
  misc_feature (507)..(507): n is a, c, g, or t
  modified_base (509)..(510): a, c, t, g, unknown or other
  misc_feature (509)..(510): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (524)..(524): a, c, t, g, unknown or other
  misc_feature (524)..(524): n is a, c, g, or t
  modified_base (527)..(527): a, c, t, g, unknown or other
  misc_feature (527)..(527): n is a, c, g, or t
tcagtacacgtgatcacgaccggtgctcgatttagacgtctcatcaaggaaggaaggggcctggagtgggtctcaactattagtggtggtggtggtagcacatactacgcagactccgtgaagggccggttcaccatctccagagacaattccaagaacacgctgttctgcaagtgaacagcctgagngccgaggacacggccgtatactactgtgcgaaagatgtgcgtaacggttactagtgggttcggggatccgaaccccgtcttttgatatcgtggggccaaggacacgtggtcaccgtctctcncgcctccacgaacggccagtccgtcctcccctggccaccgcctcagacgcctctcgcgggtccncgcgccgccgtggctgccgtggcacgtcctacctccatccgacgtgtacgtggacggtcggcgtggaccgaagggccgactaagtagcagctacgcacgtcgacgcacggtcagtcacacggntctagngcgngnngcncncacgcacanacngcac

SEQ ID NO: 256237 - DNA, 551 bp, Homo sapiens
  misc_feature: GYAE6OF01C5PMT.34.31.C09.1.454.CMB.1.raw
  modified_base (528)..(551): a, c, t, g, unknown or other
  misc_feature (528)..(551): n is a, c, g, or t
tcagtacacgtgatcacgaccggtgctcgatttagacgtctcatcaaggaaggaaggggctggagtgggtctcaactattagtggtggtggtggtagcacatactacgcagactccgtgaagggccggttcaccatctccagagacaattccaaagaacacgctgtttctgcaagtgaacagcctgagagccgaggacacggccgtaatactactgtgacgaaaagatgtgactaacgggttactagtgggttcggggagtccaaccccgtcgtttttagatatcggtcggggtaccgaagggacacgtggtccaccgtctcttcacgcctccaccgacggcccagtccgtcctccccgtgccctaccctcctaccaagacgccaccgtcggtcggggccacgacggcccggtcccgtcggggcctggtcccgtcgggtaccgaaacgggtacctaccgttacccacttaccgtacggttacgtacgtggacggcgggtacgtcgggaccgaagggcgactagtacgnnnnnnnnnnnnnnnnnnnnnnnn

SEQ ID NO: 256238 - DNA, 165 bp, Homo sapiens
  misc_feature: GYAE6OF01B5JIG.34.31.C09.1.454.CMB.1.raw
  modified_base (149)..(149): a, c, t, g, unknown or other
  misc_feature (149)..(149): n is a, c, g, or t
  modified_base (152)..(152): a, c, t, g, unknown or other
  misc_feature (152)..(152): n is a, c, g, or t
  modified_base (155)..(165): a, c, t, g, unknown or other
  misc_feature (155)..(165): n is a, c, g, or t
tcagtacacgtgatcacgaccggtgctcgatttagacgtctcatcaaggaaggaagggaccaaggtggagatcaaacgaactgtggctgcaccatctgtcttcatcttccgcatctgaatcacgtgtactgagcgggctggacaaggcntanagnnnnnnnnnnn

SEQ ID NO: 256239 - DNA, 920 bp, Homo sapiens
  misc_feature: GYAE6OF01BI644.34.31.C09.1.454.CMB.1.raw
  modified_base (213)..(213): a, c, t, g, unknown or other
  misc_feature (213)..(213): n is a, c, g, or t
tcagtacacgtgatcacgaccggtgctcgatttagacgtctcatcaaggaaggaagggggcagctctgagagaggagcccagccctgggattttcaggtgttttcatttggtgatcaggactgaacagagagaactcaccagtggagtttgggctgagcgtggtctttttctgtggtacttaagttttaaaaggtcgtccgtagtgtgaggtncagtctgttgcgagtcggtgggggagtacgtttaggtacacggccggttcggggggtaccctggacgtacctccgtccgtgtagcacggtcctcgtaggtacttacctacctttagctagtacctagtccgactagtacggcgtcggttccgggacccgtcgacggaccgtaccgggaagggggtaacggggtcgtaggggtaccggtacggggttaccttaacgttaaacgtttaaggtttacgggttcggggtttagggttacgggttaaggttaacgaccgtaaaggtaaacttaacccggtaccgacggtaacgttaaccccggttccggttaacgggtaacgggtccccggtttaccaacccgttactacccggttaaacgaaacgggtaacccgtaaaccgttaaacgtaaaccccgtaaaacggaacccgtttaaccggttaccttttaaccggggttttctaaaccggtaacggttaaaccggttaacggtaaaacccggtccggtaaccccgttagggaaccgggtaaccccgggtaaccgggaaacccgggttaaccccgggaaaccgggtttaaccccggtttaaacgtttaaccggtttaaccggttacggtaaaccggtaaacccggtaaaaaggttccggttaaagggttaccggtaaaccggttaaaaccggggtttacgtttaccgggggg

SEQ ID NO: 256240 - DNA, 433 bp, Homo sapiens
  misc_feature: GYAE6OF02IE5UQ.34.31.C09.1.454.CMB.1.raw
  modified_base (283)..(283): a, c, t, g, unknown or other
  misc_feature (283)..(283): n is a, c, g, or t
  modified_base (413)..(413): a, c, t, g, unknown or other
  misc_feature (413)..(413): n is a, c, g, or t
  modified_base (431)..(433): a, c, t, g, unknown or other
  misc_feature (431)..(433): n is a, c, g, or t
tcagtacacgtgatcacgaccggtgctcgatttagacgtctcatcaaggaaggaaggggcgtggagtgggtctcaactattagtggtggtggtggtagcacatactacgcagactccgtgaagggccggttcaccatctccagagacaattccaagaacacgctgttctgcaagtgaacagcctgagagccgaggacacggctatgtattactgtgcgagagagaccagccactcaggtggctgaccttgactccgtgggccagggaaccctggtcaccgtcncctcagcctccaccaaggcccatccggtctccccctgccaaccctcctccaagacgccacctctgggggcacgacgcggcccttgggctgcctgtacaaggactacttccatcacgtgtactgagcgggntggacaaggcgcattagnnn

SEQ ID NO: 256241 - DNA, 592 bp, Homo sapiens
  misc_feature: GYAE6OF02G5NZ4.34.31.C09.1.454.CMB.1.raw
  modified_base (184)..(184): a, c, t, g, unknown or other
  misc_feature (184)..(184): n is a, c, g, or t
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
  modified_base (255)..(255): a, c, t, g, unknown or other
  misc_feature (255)..(255): n is a, c, g, or t
  modified_base (264)..(264): a, c, t, g, unknown or other
  misc_feature (264)..(264): n is a, c, g, or t
  modified_base (285)..(285): a, c, t, g, unknown or other
  misc_feature (285)..(285): n is a, c, g, or t
tcagtacacgtgatcacgaccggtgctcgatttagacgtctcatcaaggaaggaagggggcagctctgagagaggagcccagccctgggattttcaggtgttttcatttggtgatcaggactgaacagagagaactcaccatggagtttgggctgagcggtgtgttctaggtgctattaaaggntcagtgtgagtgcagctgtgcngtctgggganctgtaacngcctgggggtcctagacgctctcctgtgcancctatggtntcaacttgcacgctatcgccntgtacgcgtcggtccgcgcgcgtacggagggaggcggtaggtgtcgtactactacgtacgtaggtggtggtggtggtagactacgtactacgtacgtacgtacgtacgtacgtacggtacggtccgtacgacgtacgtctacgacgacgaacgtaacgaacgaactaactactactacttaactaactaacgtacgaacgtacgtacgtacgtacggtaacggaacgtacgtaacgtagttacgttaacgttcgtagtacggtacgtacgacgaccgacccgaccgtaccgtacgtacgtcgtaccg

SEQ ID NO: 256242 - DNA, 659 bp, Homo sapiens
  misc_feature: GYAE6OF02GYG5V.34.31.C09.1.454.CMB.1.raw
  modified_base (185)..(185): a, c, t, g, unknown or other
  misc_feature (185)..(185): n is a, c, g, or t
  modified_base (199)..(199): a, c, t, g, unknown or other
  misc_feature (199)..(199): n is a, c, g, or t
  modified_base (219)..(219): a, c, t, g, unknown or other
  misc_feature (219)..(219): n is a, c, g, or t
tcagtacacgtgatcacgaccggtgctcgatttagacgtctcatcaaggaaggaagggggcagctctgagagaggagcccagccctgggattttcaggtgttttcatttggtgatcaggactgaacagagagaactcaccatggagtttgggctgagcgtgtgtttctagcgctatttaaaggtntcagtgtgagtgcngctgttgcagtctggggganacgttggtacagccgtgggggtccctgacgtactctcctgtgcagcctcgtggtacttcaccctttgcagctatcgcatgagtcgtcgggtccgccgtaggccgtccgaaggggaggggctggagttcggggtctacgtaactagttaggtgggtcgggtggtgggtagcgtaacgagttacgaaccgtcgtaacggtaaccgttcccgggtaagggaacccggggttacccggttaccgtaccctaagtcccgttacccaaggaaccgactaaaccttacccgaaaagaaccctaacgtctttacgggtttactacggtacctaaggtacgtaacgaccggtactacggagaacggcgtaaccggacgaccggtaccggttaataacccgtatacgtaccggtagacgtaggaaccacggtaactacccggtatccggg

SEQ ID NO: 256243 - DNA, 726 bp, Homo sapiens
  misc_feature: GYAE6OF02GF4R1.34.31.C09.1.454.CMB.1.raw
tcagtacacgtgatcacgaccggtgctcgatttagacgtctcatcaaggaaggaagggggcagctctgagagaggagccccagcccctgggattttcaggtgttttcatttggtgatcaggactgaacagagagaactcaccatggagtttgggctgagcgtggtcttttctgtggctatttaaaaggtgtccagtgtgaggtgcagctgttgcagtcgtgggggagacgttggtacaggccgtggggggtccctgagactctcctgtgcagccctctggtacttcctacctttagcagctatgccatgaggcgtcggggtacccgccgaggtccgtccgaggggaaggggtcgtgggaggttcggggtctaccgtaaacgttagttaggtgggttagggtgggtcggtagcactatacgtacgcacgtacgtccggtaggacggggtcccggttacacccgtacgtcccgtaccaacggacgtaaccaaacgtttacccaaaaggtaaaccctaaccgggtcctttagggtttttccgtaggtaccgtaaaggtaccgtaaaccacggtacccgtaggaagaaccggaccgggaaacggacccggaacgggtacccggtttaaacgtaaccctttacccggttacggttacggaacccggtaaaaggtacggttacgggtacggttaacccgggtaaaccggggtttttaaccgtttaacggggg

SEQ ID NO: 256244 - DNA, 518 bp, Homo sapiens
  misc_feature: GYAE6OF02H3YJH.34.31.C09.1.454.CMB.1.raw
  modified_base (266)..(266): a, c, t, g, unknown or other
  misc_feature (266)..(266): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (488)..(518): a, c, t, g, unknown or other
  misc_feature (488)..(518): n is a, c, g, or t
tcagtacacgtgatcacgaccggtgctcgatttagacgtctcatcaaggaaggaaggggctggagtgggtctcaactattagtggtggtggtggtagcacatactacgcagactccgtgaagggccggttcaccatctccagagacaattccaagaacacgctgtttctgcaagtgaacagcctgagagccgaggacacggccgtatactactgtgcgaaagatgtgcaacgggtttactatgggttcggggagttcaacccccgntttttgattatcgtggggccaagggacactggtcaccgtctcttcagccctccaccaagggcccatccggtccttcccccctggccacccctcctccaagcgcacctctcgggggcacagccggcccgtgggctcgccgtggttacgaaacggacttactttccatccacgttcgtactggacggcggggctcgggcgtaaagggcgcgtactaggnancgnnnnnnnnnnnnnnnnnnnnnnnnnnnnnnn

SEQ ID NO: 256245 - DNA, 553 bp, Homo sapiens
  misc_feature: GYAE6OF02HUZY6.34.31.C09.1.454.CMB.1.raw
  modified_base (227)..(227): a, c, t, g, unknown or other
  misc_feature (227)..(227): n is a, c, g, or t
  modified_base (259)..(259): a, c, t, g, unknown or other
  misc_feature (259)..(259): n is a, c, g, or t
  modified_base (273)..(273): a, c, t, g, unknown or other
  misc_feature (273)..(273): n is a, c, g, or t
  modified_base (501)..(501): a, c, t, g, unknown or other
  misc_feature (501)..(501): n is a, c, g, or t
  modified_base (512)..(512): a, c, t, g, unknown or other
  misc_feature (512)..(512): n is a, c, g, or t
  modified_base (514)..(518): a, c, t, g, unknown or other
  misc_feature (514)..(518): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
  modified_base (543)..(547): a, c, t, g, unknown or other
  misc_feature (543)..(547): n is a, c, g, or t
  modified_base (549)..(549): a, c, t, g, unknown or other
  misc_feature (549)..(549): n is a, c, g, or t
  modified_base (551)..(553): a, c, t, g, unknown or other
  misc_feature (551)..(553): n is a, c, g, or t
tcagtacacgtgatcacgaccggtgctcgatttagacgtctcatcaaggaaggaaggggctggagtgggtctcaactattagtggtggtggtgggtagcacatactacgcagactccgtgaagggccggttcaccatctccagagacaattccaagaacacgtctgtttctgcaagtgaacagcctgagagccgaggacacggccgtatactactgtgacgaaaagntggtgctaaacgggttactatgggttcggggntaccaacccccgtnttttgatatcgtcgggaccaagggtacacgttcggtcaccgttcctcttccacgtccctaccgaccgaacgggcccctaacgttccggttcccttcccccgtcggccctaccctcctaccgaacgacgccaccgtcgtcggggcacgagccgcgtcggctgcctggacacgtactactcatcacgttagtcgtagcggcggcgacgcgtaacggacgcctaagtcganctagcagtcgngnnnnncncngngcgngnacgcgtcgagcgnnnnncncnnn

SEQ ID NO: 256246 - DNA, 197 bp, Homo sapiens
  misc_feature: GYAE6OF01A9Q2H.39.33.C11.1.454.CMB.1.raw
  modified_base (195)..(197): a, c, t, g, unknown or other
  misc_feature (195)..(197): n is a, c, g, or t
tcagtcgcactagtcacgaccggtgctcgatttagagtgagctcgttgggtttgggtcagcctccaccaagggcccatcggtcttccccctggcaccctcctccaagagcacctctgggggcacagcggccctgggctgcctggtcaaggactacttccactagtgcgactgagcgggctggcaaggcgcatagnnn

SEQ ID NO: 256247 - DNA, 205 bp, Homo sapiens
  misc_feature: GYAE6OF01BDVR1.39.33.C11.1.454.CMB.1.raw
  modified_base (195)..(205): a, c, t, g, unknown or other
  misc_feature (195)..(205): n is a, c, g, or t
tcagtcgcactagtcacgaccggtgctcgatttagagtgagctcgttgggtttgggtcagcctccaccaagggcccatcggtcttccccctggcaccctcctcaaagagcacctctgggggcacagcggccctgggctgcctggtcaaggactacttccactagtgcgactgagcgggctggcaaggcgcatagnnnnnnnnnnn

SEQ ID NO: 256248 - DNA, 197 bp, Homo sapiens
  misc_feature: GYAE6OF02IDD8H.39.33.C11.1.454.CMB.1.raw
  modified_base (194)..(197): a, c, t, g, unknown or other
  misc_feature (194)..(197): n is a, c, g, or t
tcagtcgcactagtcacgaccggtgctcgatttagagtgagctcgttgggtttgggtcagcctccaccaagggcccatcggtcttccccctggcaccctcctccaagagcacctctggggcacagcggccctgggctgcctggtcaaggactacttccactagtgcgactgagcgggctggcaaggcgcatagnnnn

SEQ ID NO: 256249 - DNA, 485 bp, Homo sapiens
  misc_feature: GYAE6OF01CYV0L.12.8.A08.1.454.CMB.1.raw
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtcctactcatctttcaaaataccagcggccctcaggggtccctgaccgattctctggctcaagtctggcacctcagcctcctggccatcagtgggctccagtctgagatgaggctgattatactgtgcatcatgggctgacacctgactggtccggagtgtcgggcggagggaccaaggcctgaccgtcctaggtcacgcccgaaggcccg

SEQ ID NO: 256250 - DNA, 495 bp, Homo sapiens
  misc_feature: GYAE6OF01DRQ81.12.8.A08.1.454.CMB.1.raw
  modified_base (190)..(190): a, c, t, g, unknown or other
  misc_feature (190)..(190): n is a, c, g, or t
  modified_base (358)..(358): a, c, t, g, unknown or other
  misc_feature (358)..(358): n is a, c, g, or t
  modified_base (443)..(443): a, c, t, g, unknown or other
  misc_feature (443)..(443): n is a, c, g, or t
  modified_base (456)..(456): a, c, t, g, unknown or other
  misc_feature (456)..(456): n is a, c, g, or t
  modified_base (489)..(489): a, c, t, g, unknown or other
  misc_feature (489)..(489): n is a, c, g, or t
tcagatacgacgtacacgaccggtgctcgatttagcatactctacgggggctgggcctcaggaggcagcatcggaggtgcctcagccatggcatggatccctctcttcctcggcgtccttgcttactgcacagaatccatggcctactatgagttgactcagccaccctccatgtccgtgtcccccgganagacagccagcatcacctgctctggagatgtattgactaatgagtatgcttcctggtatcagcagaaggcaggccagccccctgtcctactcatctttcaaaataccaggcgccctctcggggtccctgagcgattctctggctccgactctggaacacagtcactcncgaccatcacgcggacccaggctattgatgagctgtctactactgtcagggcgtggacagcagcgtggtgttcggcggaggaccnggtctgtaccgtnttaggtcacgcccaggcctcgccccctcggtcncttccg

SEQ ID NO: 256251 - DNA, 490 bp, Homo sapiens
  misc_feature: GYAE6OF01DHWAU.12.8.A08.1.454.CMB.1.raw
  modified_base (190)..(190): a, c, t, g, unknown or other
  misc_feature (190)..(190): n is a, c, g, or t
  modified_base (217)..(217): a, c, t, g, unknown or other
  misc_feature (217)..(217): n is a, c, g, or t
  modified_base (444)..(444): a, c, t, g, unknown or other
  misc_feature (444)..(444): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccagcatcacctgctctgganatgtattgactaatgagtatgcttcctggtatcagcagaaggcaggccagccccctgtcctactcatctttacaaaatccaggcgccctctcggggtccctgagcgattctctggcctccgactctgggacacagtcactctgaccatcagcggacccaggctattgatgaggtctgtctactactgtcgaggcgtgggacagcagcgtggtgtcggcggaggaccngtcgtgacgtcttaggcagcccgaggcctcgccccctggtctaccg

SEQ ID NO: 256252 - DNA, 492 bp, Homo sapiens
  misc_feature: GYAE6OF01CC1GJ.12.8.A08.1.454.CMB.1.raw
  modified_base (452)..(452): a, c, t, g, unknown or other
  misc_feature (452)..(452): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaggcaggccagccccctgtcctactcatctttacaaaataccaggcgccctctggggtccctgagcgattctctggctccgactctgggacacagtcactctgaccatcagcggacccaggctatgatgaggctgtctactactgtcaggcgtggacagcagcgtggtggttcggcggagggccagtcgtgaccgtnttacggcacggcccaaggcctcggcccctcggtctacccg

SEQ ID NO: 256253 - DNA, 490 bp, Homo sapiens
  misc_feature: GYAE6OF01DIN68.12.8.A08.1.454.CMB.1.raw
  modified_base (189)..(189): a, c, t, g, unknown or other
  misc_feature (189)..(189): n is a, c, g, or t
  modified_base (306)..(306): a, c, t, g, unknown or other
  misc_feature (306)..(306): n is a, c, g, or t
  modified_base (372)..(372): a, c, t, g, unknown or other
  misc_feature (372)..(372): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctcatgtccgtgtcccccgganagacagccagcatcacctgctctggagatgtattgactaatgagtatgcttcctggtatcagcagaaggcaggccagccccctgtcctactcatctttcaaataccaggcggcctcngggtccctgagcgattctctggctccgactctgggacacagtcactctgaccatcagcgggacccnggctattgatgaggctgtctactactgtcaggcgtgggaccagcagcgtggtgttcgggcggagggaccagtcgtgaccgtgttcggcagacccgaggctcgccccctcggtctaccg

SEQ ID NO: 256254 - DNA, 551 bp, Homo sapiens
  misc_feature: GYAE6OF01CLOW5.12.8.A08.1.454.CMB.1.raw
  modified_base (337)..(337): a, c, t, g, unknown or other
  misc_feature (337)..(337): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagcccaccctccatgtccgtgtcccccggacagacagccagcatcacctgctctggagatgtattgactaatgagtatgcttctggtatcagcagaaggcaggccacgccccctgtccctactcatctttacaaaactaccaggccggccctcgtcggggtccctggacgcgattcncgtggctccgactcgtagggaacacgtagtcactctacgaccatcgacggccgggacccaggctagttgatgaggtctgtctactactgtcgaggcgtagggacagcgaggtcggtgggtcggtcgggacgggacgggaccgtaggtcgtcggacccgttcgttagggccacggaccccgtaaggcccgtacccggccccctgggtcctacccg

SEQ ID NO: 256255 - DNA, 583 bp, Homo sapiens
  misc_feature: GYAE6OF01A4H8T.12.8.A08.1.454.CMB.1.raw
  modified_base (217)..(217): a, c, t, g, unknown or other
  misc_feature (217)..(217): n is a, c, g, or t
tcagatacgacgtacacgaccggtgctcgatttagcatactctacaggggctgggcctcaggaggcagcatcggaggtgcctcagccatggcatggatccctctcttcctcggtgtccttgcttactgcacagaatccatggcctcctatgagttgactcagccaccctccatgtccgtgtcccccggacagacagccagcatcacctgctctgganatgtattgactaatgagtatgcttcctggtatcagcagaggcaggccagccccctgtcctactcatcttacaaataccaggccgccctcgtcgggtccctgacgcgattctctcggctccgactcgtgggaacacgagtcactctcgaaccatcgacggccgggacccgaggtcttagttgatggacggtccttaggtactaccttacgttggtaccgtagggcggttagggacagccgtaggtccggttgggtcggttccgggcgggtacgggtacccgtaggttccggtacggtacccggttcgttacgggctaccggaccccgtaacgggtccctccggtccccccgttcgggtcctacccgg

SEQ ID NO: 256256 - DNA, 529 bp, Homo sapiens
  misc_feature: GYAE6OF01BOQCL.12.8.A08.1.454.CMB.1.raw
  modified_base (190)..(190): a, c, t, g, unknown or other
  misc_feature (190)..(190): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccagcatcacctgctctggagatgtattgactaatgagtatgcttcctggtatcagcagaaggcaggccacgccccctgtcctactcatctttacaaaactaccaggccgccctcgtcgggtccctgagcgattctctggctccgactcgtgggaacacagtccactctagaccatcagcgggacccaggctatgatgaggtctgtctactcgtgtcgaggtcgtgggacaggcaggtcgtggtcggtcgggcgggacgggaccaggtcgtggtcccgttacggttcggccacggcccgtacggccctccggccccccgttgggtcctacccg

SEQ ID NO: 256257 - DNA, 647 bp, Homo sapiens
  misc_feature: GYAE6OF01DKTN3.12.8.A08.1.454.CMB.1.raw
  modified_base (190)..(190): a, c, t, g, unknown or other
  misc_feature (190)..(190): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccagcatcacctgctctggagatgtattgactaatgagtatgcttctggtatcagcagaaggcaggccacgccccctgtccctactcatctttacaaaatccaggccgccctcgtcggggtccctggacgcgtattcctctggcctccgacttcgtacgggaaccacgtacgtaccacttctacgaccctataccgacggacccggggaacccagggtaccttaagttaggaagttacgggacggtcttacggttaccttaaccgttacgttcggtaccgagggtccggtagggaccgacggtcgacggtcgggttagggttcgggttccggggcggggtaacgggacccgtagggttccgttcgggtacccggtttcggttacgggtacccgaacgggtaccccgtaagggtcccgttacccgggccccccgttgggtcccttaccccgg

SEQ ID NO: 256258 - DNA, 521 bp, Homo sapiens
  misc_feature: GYAE6OF01EWO1T.12.8.A08.1.454.CMB.1.raw
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtcctactcatctttacaaatccaggcgccctcgtcggggtccctgagcgattctctggctccgactcgtgggaacacagtcactctgaccatcgagcgggacccaggctatgatgaggtctgtctactactgtcaggcgtgggacagcaggcgtggtggttcggcgggacgggaccgaggtccgtggtacccgtcgttagggtccgagccccgaaggccttaccggccccccgttggtccctacccg

SEQ ID NO: 256259 - DNA, 610 bp, Homo sapiens
  misc_feature: GYAE6OF01CYL9J.12.8.A08.1.454.CMB.1.raw
  modified_base (188)..(188): a, c, t, g, unknown or other
  misc_feature (188)..(188): n is a, c, g, or t
  modified_base (241)..(241): a, c, t, g, unknown or other
  misc_feature (241)..(241): n is a, c, g, or t
  modified_base (370)..(370): a, c, t, g, unknown or other
  misc_feature (370)..(370): n is a, c, g, or t
  modified_base (415)..(415): a, c, t, g, unknown or other
  misc_feature (415)..(415): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctcatgtccgtgtccccgganagacagccagcatcacctgctctggagatgtattgactaatgagtatgcttcnggtatcagcagagcaggccacgcccctgtcctactcacttcctttacaaaactccgacggccggaccctcgtcggggtccctggacgcgtacttctcgtcggcctcgactcgtagggaccacgcgtacncctcacgacctatccgacggccgggacccaggtcttagtgatggngtctgtctactactgtcgagggtcgtagggaccaggcgaggtcggttgggtcggttcggggaccgggtacgggaccgtaggttcccggtacgggttacccggttacggttaccgggtcccgtaaaccgggtaccccggtaaacgggtccccgttaccccggtacccccccggttcgggtaccctttacccccggg

SEQ ID NO: 256260 - DNA, 537 bp, Homo sapiens
  misc_feature: GYAE6OF01C94V7.12.8.A08.1.454.CMB.1.raw
  modified_base (190)..(190): a, c, t, g, unknown or other
  misc_feature (190)..(190): n is a, c, g, or t
  modified_base (476)..(476): a, c, t, g, unknown or other
  misc_feature (476)..(476): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccagcatcacctgctctggagatgtattgactaatgagtatgcttcctggtatcagcagaggcaggccacgccccctgtcctactcatcttacaaactaccgaggccgcctcgtcgggtccctgacgctattctctcggctccgactcgtagggaacacgagtcactctcgaccagtcacggccggacccaggctagtgagtgacggtcttcgtctactacgtcgtcgaggtcggtggacgagcgacggcggttgggtcggtcgggcgggacgggaccgnggtccgtcggaccgttcgtacggtcgaccgaccgtacggcctcgcccccgtgtccctaccg

SEQ ID NO: 256261 - DNA, 551 bp, Homo sapiens
  misc_feature: GYAE6OF01ELT0V.12.8.A08.1.454.CMB.1.raw
  modified_base (193)..(193): a, c, t, g, unknown or other
  misc_feature (193)..(193): n is a, c, g, or t
  modified_base (220)..(220): a, c, t, g, unknown or other
  misc_feature (220)..(220): n is a, c, g, or t
  modified_base (447)..(447): a, c, t, g, unknown or other
  misc_feature (447)..(447): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacagccagcatcacctgctctgganatgtattgactaatgagtatgcttcctggtatcagcagaaggcaggccacgccccctgtccctactcattcttacaaactaccaggccgcccttcgtcggggtccctgacgcgattctctcggtcctccgactcgtcgggaaacacgagtaccacttctcgaccagtcacgggccggacccgaggtcctattgatggacggtctgtctactacgtgtcgaggtcggnggacagcaggtcgtggtcggtcggcgggacgggccaggtccgtcggtaccgttgttcgggacgacgaccccgaggccctcccggcccccgttcggtcctacccg

SEQ ID NO: 256262 - DNA, 586 bp, Homo sapiens
  misc_feature: GYAE6OF01CKDXF.12.8.A08.1.454.CMB.1.raw
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaagcaggccacgccccctgtccctactctactcttacaaataccacggccggtccctcgtggggtccctggacgctattctcgtcggcctccgtactcgtagggaacacacgtcactctacgaccatcgacggccgggacccaggtcttatgtagtggaggtctgtactacttcgtgtccgaggtcggtagggacgaggcgtacggtcgggttggggttcggtccggggacgggaacgggtaccgaggttccggtacggtacccggtcgtttacgggacctaccggacccgtaagggcccctacggtccccccgttacggtccttaccccg

SEQ ID NO: 256263 - DNA, 632 bp, Homo sapiens
  misc_feature: GYAE6OF01DOLQ6.12.8.A08.1.454.CMB.1.raw
  modified_base (190)..(190): a, c, t, g, unknown or other
  misc_feature (190)..(190): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccagcatcacctgctctggagatgtattgactaatgagtatgtcttcctggtatcagcagaaggcaggccacgccccctgtcctactctatcctttacaaaactaccaggcgcccctcgtcggggtccctgacgcgtattcgtctggcctcccgactcgtaggggaaaccacgtaacgtcctaacctcgtacgacctaactcgacggaccgggaacccctagggtccttaagttcggagttacggaggtcttcgtacttacgtaacgtgttaccgagggtcggtacgggacctaggcgtaaggtcgggttagggttcgggttccggggacgggtacggggacctaagggtccgtacggtacccggttcggtttacggtaccgaaccggccccgtaaacgggccctaccggtccccccgttcggtcccttaccccgg

SEQ ID NO: 256264 - DNA, 617 bp, Homo sapiens
  misc_feature: GYAE6OF01CZHBJ.12.8.A08.1.454.CMB.1.raw
  modified_base (221)..(221): a, c, t, g, unknown or other
  misc_feature (221)..(221): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagttaatccatggcctcctatgagttgactcagccaccctccatgtcccgtcgtcccccggacagacagccagcatcacctgctctgganatgtattgactaatgagtatgcttcctggtatcagcagaaggcaggccacgccccctgtcctactctatctttacaaaactccaggccgccctcgtcggggtccctgagcgtattctcgtcggtctcccggactcgtagggaacacgtagtccactctcgaaccactacgacggccgggacccgaggtcttagtggtaatcgggaaggtcgtacggtaccttacgtacgttggtaccgacgggtcggtacgggactacgggacgacggtacggttgggtcggttcggggacggggtacggaccgtaggttcgtaccgggtaccggttacggtcggtaccgacggtacccggtaaacggtcccgttacccggtcccccgttccgggtcctaccccgg

SEQ ID NO: 256265 - DNA, 570 bp, Homo sapiens
  misc_feature: GYAE6OF01E3Y8U.12.8.A08.1.454.CMB.1.raw
  modified_base (191)..(191): a, c, t, g, unknown or other
  misc_feature (191)..(191): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagcccaccctccatgtccgtgtcccccgganagacagccagcatcacctgctctggagatgtattgactaatgagtatgcttcctggtatcagcagaaggcaggccacgccccctgtcctactcattcttacaaaactccaggccgccctcgtcggggtccctggacgcgtattctcgtggcctccgactcgtagggaaccacgagtccactctagacccatcgacggccgggacccgaggtctagtgagtgagctgtctactactgtcgaggcggtgggacaggtcgaggtcggttgggtcggttccgggcgggacgggaccgtacggtccgtcggtacccggttcgttacgggtccgacggtaccccgaacgggcccgtacccggccccccgttcggtcccgtacccg

SEQ ID NO: 256266 - DNA, 663 bp, Homo sapiens
  misc_feature: GYAE6OF01BAD1N.12.8.A08.1.454.CMB.1.raw
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacagccagcatcacctgctctggagatgtattgactaatgagtatgctttccgtggtatcgagcgaggaaggcaggccacgccccctgtccctactctattcttacaaaactccacggccgcccgttcgtcgggtccctgacgtcgtattccgtcgtcggcctacccgacttcggtacgggaaccacgtacggtccacttctacgaacctacgtaccgacggcccgggaaccccgtaggtaccttagttgaacgttcgggaacgtccgttacgtaccgttaaccgttacgtcgttacggacgggtcggtaggggaacctgggaccgacgggttcggtacgggttcgggttccgggacggggaccgggtacctacgggttaccgtcgggtacccgttacggttaccggaccgtaacggtcccgtaaacggtcccgttacccggtacccccggttcggtacccgtaccccgg

SEQ ID NO: 256267 - DNA, 533 bp, Homo sapiens
  misc_feature: GYAE6OF01BWTU6.12.8.A08.1.454.CMB.1.raw
  modified_base (218)..(218): a, c, t, g, unknown or other
  misc_feature (218)..(218): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcccagcatcacctgctctgganatgtattgactaatgagtatgcttcctggtatcagcagaaggcaggcccagcccccctgtccctactcatctttacaaaataccaggcggcccctcgtcggggtccctggagcgattctctggctccgactctggggaacacagtcactctcgaccatcagccgggacccaggctagttgatgaggtctgtctactactgtcaggcgtgggacagcaggcgtgggtgttcgggcggagggacccaggtcgtcgtacccggttcgttacgggcacggccccgaacgggtcctccggccccccttcggtcctacccg

SEQ ID NO: 256268 - DNA, 444 bp, Homo sapiens
  misc_feature: GYAE6OF01D1SW0.12.8.A08.1.454.CMB.1.raw
  modified_base (191)..(191): a, c, t, g, unknown or other
  misc_feature (191)..(191): n is a, c, g, or t
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
  modified_base (391)..(391): a, c, t, g, unknown or other
  misc_feature (391)..(391): n is a, c, g, or t
  modified_base (393)..(444): a, c, t, g, unknown or other
  misc_feature (393)..(444): n is a, c, g, or t
tcagatacgacgtacacgaccggtgctcgatttagcatactctacagggggctgggcctcaggaggcagcatcggaggtgcctcagccatggcatggatccctctcttcctcggcgtccttgcttactgcacagaatccatggcctcctatgagttgactcagccaccctcatgtccgtcgtcccccgganagacncgccagcatcacctgctctgganatgtattgaactatgagtatgtcttcgtggtatcgagcaagacggcacggccaccgccccctgtccctactctacttaccttaacaaactccgacgggtcccggtccccttcggtccgggggtccctgggacgggtccgggtcgtcgggacgaacgggcctacaagtacggncnnnnnnnnnnnnnnnnnnnnnnnnnnnnnnnnnnnnnnnnnnnnnnnnnnnn

SEQ ID NO: 256269 - DNA, 776 bp, Homo sapiens
  misc_feature: GYAE6OF01C0TLA.12.8.A08.1.454.CMB.1.raw
tcagatacgacgtacacgaccggtgctcgatttagcatactctacaggggctgggcctcaggaagcagcatcggaggtgcctcagccatggcatggatccctctcttcctcggcgtccttgcttactgcacaggttccgtggcctcgtatgacctgactcacgccaccctctgtgtccgtcgtcccaggacagacagtcacaatctcatcgctcgtggagatgcgtaggttagggggtaaaagtttgtacgtttcgttaggtatacgagacgaaggaacgccgacggcccgtacgttccccgtggttcgttggtactatacgttaagtaaggagtacgcgacggtccggaccctacggagggtacttccgtaggacggtaccggttacgttccggtaccggtacccttacccgaaaccgttacccgggaccaaacgacccgaccgtacccaaccttacgtaccgaacccgtactaccggaccgggtacccgggaacccagggtcccttcggtaccgtaggtacggaccgggtctacggtaaccttaacgttacgccggtaccgtacgggtaccgggttacggggaacctacggtccccttacccggttacccgttttcccggtttaagttcccggtttacggttacggggtacgggttaccgggaaccttacgggttcccgggtacccgttacccggttacccgttaggggcccctaaaccggaccccgtaaaacggaacccccctaacccgttaacgttcccctacgttaccccg

SEQ ID NO: 256270 - DNA, 570 bp, Homo sapiens
  misc_feature: GYAE6OF01BZ2RD.12.8.A08.1.454.CMB.1.raw
  modified_base (189)..(189): a, c, t, g, unknown or other
  misc_feature (189)..(189): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccacctccatgtccgtgtcccccgganagacagccagcatcacctgctctggagatgtattgactaatgagtatgcttcctggtatcagcagaggcaggccagccccctgtcctactcatctttacaaatccgaggccgccctcgtcggggtccctgacgcgtattctcgtcggcctccgactcgtagggaaccacgagtccacttctacgacctatcgacggccgggacccaggtctagttcgagtggacggtcttacgtcttactacgtgtcgagggcggtagggacacggtcgaggtcggtgggttcggttccgggacgggtagggcctaggtccgtcggtacccggttcggttacggtccgacggcccgaagggtccctaccggcccccgttggtccctacccg

SEQ ID NO: 256271 - DNA, 695 bp, Homo sapiens
  misc_feature: GYAE6OF01BDBSU.12.8.A08.1.454.CMB.1.raw
tcagatacgacgtacacgaccggtgctcgatttagcatactctacaggggctgggcctcaggaggcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcagttgggggaaaagttttgctttctggtatcagcagaagccaggccagtcccctgtcttggtcatctataaggatagcgaggcggccctgaggtacttccgtgacgcgattcctccggctccaactcccggacaacacacgccactctacgaccatccgacggccgggacccaggtcctcgtcgatcggacggtctaggtaaccttacttacgtcggacccgtagggtccgggttacggggaacctaccggtacccttccccgttaacccgttttccccggtttacgtttccgggtttacccggtttaccgggggaacggggtttaccggggtaccccttacggtttacccggggttccccgttaaccccgggttaccccggttaaccgggttcccgaaccccgggtaaccccccgtaaaaccgaaccccccctaaaccccccgtaccgttcccggtaccccgttaacccccgg

SEQ ID NO: 256272 - DNA, 554 bp, Homo sapiens
  misc_feature: GYAE6OF01EUYP8.12.8.A08.1.454.CMB.1.raw
  modified_base (361)..(361): a, c, t, g, unknown or other
  misc_feature (361)..(361): n is a, c, g, or t
  modified_base (433)..(433): a, c, t, g, unknown or other
  misc_feature (433)..(433): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccacgccccctgtccctactcattcctttacaaaactccgaggccggcccctcgtcggggtccctgagcgtattctctggctccgactcgtgggaacncagtcactctacgaccatcagccggaccaggctatgatgagtctgtctactacgtcgtcgacggcgtggacnggcgaggtcgtgggtcggttcgggcgggacgggtaccgtaggtcgtcggtaccggttacgttacgggtccgacggccccgtaaacgggccgtacccggccccccgttcggtccttaccccg

SEQ ID NO: 256273 - DNA, 714 bp, Homo sapiens
  misc_feature: GYAE6OF01EVQRE.12.8.A08.1.454.CMB.1.raw
  modified_base (192)..(192): a, c, t, g, unknown or other
  misc_feature (192)..(192): n is a, c, g, or t
  modified_base (221)..(221): a, c, t, g, unknown or other
  misc_feature (221)..(221): n is a, c, g, or t
  modified_base (339)..(339): a, c, t, g, unknown or other
  misc_feature (339)..(339): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtcgtccccccgganacgacacgccagcatcacctgctctgganatgtattgactaatgagtatgcttctggtactcagcagaagcagtccacgccccctgtccctactcatcttacaaaatccgaggtccggcccttcgtcggggtccctgacgcgattcncgtcgctccgactcgtcgggaacactacgtcctactcctacgacctagtaccgtacggacccgggaccctaggtacctaagtttacgagtacgggtacggccgtttagtacccttaacgttaccgtacggttacggtaacggggccggttaacgggggtaaccacgggtacccggtaaggggttccggttagggggttccggttaccggggggtaacggggtaaccggggtaccgttacgggttcccggtttaaccgggtaccccgggtttaaccgggtttaaccgggttacccgaaacccgggtacccccgggtaaacggggttcccctaccccgggtacccccccccggttcgggttaccccgttacccccgg

SEQ ID NO: 256274 - DNA, 610 bp, Homo sapiens
  misc_feature: GYAE6OF01DMF4I.12.8.A08.1.454.CMB.1.raw
  modified_base (191)..(191): a, c, t, g, unknown or other
  misc_feature (191)..(191): n is a, c, g, or t
  modified_base (213)..(213): a, c, t, g, unknown or other
  misc_feature (213)..(213): n is a, c, g, or t
  modified_base (218)..(218): a, c, t, g, unknown or other
  misc_feature (218)..(218): n is a, c, g, or t
  modified_base (420)..(420): a, c, t, g, unknown or other
  misc_feature (420)..(420): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagcccaccctccatgtccgtgtcccccgganagacagccagcatcacctgctntgganatgtattgaactaatgagtatgtcttcctggtatcagcaagaaggcacggcccacgcccccttgtcctactcacttactttacaaaactccgacggccggccctcggtcggggtccctggacgtcgtattcctcgtcggtcctccgtactcgtagggaccacgacgtcacttcacgacctactccgaacggccgggaacccnggtactaagtgagtcggaggtctcgtacttactcgtcggtcgtacgggcggtgggacaggtcgacggtcgggttaggtcgggttccggggacgggtacgggaccgtaggtccgtacggtacccggttacgttacgggtaccaccggtacccgtaacgggtccctcccggtcccccgtcggtcctacccgg

SEQ ID NO: 256275 - DNA, 598 bp, Homo sapiens
  misc_feature: GYAE6OF01BZHUD.12.8.A08.1.454.CMB.1.raw
  modified_base (394)..(394): a, c, t, g, unknown or other
  misc_feature (394)..(394): n is a, c, g, or t
  modified_base (438)..(438): a, c, t, g, unknown or other
  misc_feature (438)..(438): n is a, c, g, or t
tcagatacgacgtacacgaccggtgctcgatttagcatactctacaggggctgggcctcaggaggcagcatcggaggtgcctcagccatagcatggatccctctcttcctcggcgtccttgcttactgcacagaatccatggcctcctatgagttgactcagcccaccctcatcgtccgtcgtcccccagacagacacgccagcatcacctgctctggatatgtattgactaatgagtatgtcttcgtgtatcagcagaggcaggccacgcccctgtcctactctacgttacttacaaaactccgacgggccgtccctcggtcgggtccctggctacttctcgtcggcctccgtactcgtagggaacctacgacgtcctctcgacgtaaccgtntaccgacggaccggaccaggtctagtcgagtcggtagtccgttntacctacgttacgtcggtcgacgggtcgggtaggaccaggtccgtagggtccggttggggtcggtaccggggcgggtacgggacccgtgtccgtcgggtacccgttcgtacggtccgaccgtcccgaacggttcctccccggccccgtgtcccgtacccg

SEQ ID NO: 256276 - DNA, 837 bp, Homo sapiens
  misc_feature: GYAE6OF01CYF6T.12.8.A08.1.454.CMB.1.raw
  modified_base (156)..(156): a, c, t, g, unknown or other
  misc_feature (156)..(156): n is a, c, g, or t
  modified_base (207)..(207): a, c, t, g, unknown or other
  misc_feature (207)..(207): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcaacagaactcccagtcggcctactagngtagttacgactcacgccctacctcagtcggtccgtccggacccccggaanacgacgacgccagtacactccgtaccgtcgtcctacggtaggagtagtttagttaacgttacgtaaacgttagtaggtagttcgttccgttccgtttacggtagtacacggacggaacggaagggacgaccgaccggacccctaccccggtccccgttaccttccttaaccgtacttaactttaacccgttaaaccgaacgtccggtaccgggtcccgtcccggttcggggtccgggtacctaggtacgtcgttacttccgtcggaccgttcccgtaccgtcggtacggtaaccgtaacctcgtaccgtacctaccgtacgtaccgtaccgtacggaccggaccgggacccgggaccgtacggttacgttaggtacggtacggtacggtacggttaccgttcgttaccgttaccgttacggtacggtacggtcgggtacggtacggacggtcgggtaccggtcgggttcgggttacgggttcggggtacgggtaaccggggtaccggtaccgggttaccggttaccgggtaccggttaccgggttacggttccgggtaacccggtacccgggaccggtacccgggttccccggttaccccggtaccccggttccgttacccggtaccccg

SEQ ID NO: 256277 - DNA, 691 bp, Homo sapiens
  misc_feature: GYAE6OF01EMNZ0.12.8.A08.1.454.CMB.1.raw
  modified_base (209)..(209): a, c, t, g, unknown or other
  misc_feature (209)..(209): n is a, c, g, or t
  modified_base (224)..(224): a, c, t, g, unknown or other
  misc_feature (224)..(224): n is a, c, g, or t
tcagatacgacgtacacgaccggtgctcgatttagcatactctacgagggggcgtgggcctcaggaggcagcagtcggaggtgcctcacgccatggcatggactccctctcttcctcggcgtccttgcttactgcacagaactccgatggcctctatggagttcgactcgacgcccctaccctcgatcggtccgtaccggtccccgganaggacacgccagcanccacctgctcgtaggatatgttatagaacttaatgaagttatcgctttacgtgtacgtcgagacgtaacggacggactaacggcccctaccgtccccgtttgtaccctactctaccttaccgtaacaaacgtccgacgggtcccgtaccgtccggttacggtcctaggacgacgtctttcgcgttggcccgttcgacgttccggagaactcggcttacacgtcgactccgaacgtccggaggaccccggtactggtactacggtagtacgtacggtcggttcttaggtaccctttagttacccgtgggaccggtacgggtacggtacggaccgtaggtccgttacgggtcgttacggggttcggtaccgggccgggaaggtccctagggtctaccggggatttaccggaacggtcgaacccgggtccgacggttacccgccccgtttaccggtccgttcttccccgg

SEQ ID NO: 256278 - DNA, 723 bp, Homo sapiens
  misc_feature: GYAE6OF01CQPLI.12.8.A08.1.454.CMB.1.raw
  modified_base (189)..(189): a, c, t, g, unknown or other
  misc_feature (189)..(189): n is a, c, g, or t
tcagatacgacgtacacgaccggtgctcgatttagcatactctacagggggctgggcctcaggaggcagcatcggaggtgcctcagccatggcatggatccctctcttcctcggcgtccttgcttactgcacagaatccatggcctctatgagttgactcagcccaccctcatgtccgtcgccccgganagacagccagcatcacctgcttcaggagatgttaatcgaactaagtgaagtatcggtcttcgtggtatcagcgagaaggcgacggtaccgaccgcccccttgtccctacctcaactttacttaacctaaaaatacccgaacggtcccggtccccgtccggtaccggggttcccctggaccgtacgtactttccgtcgtccgggtcctacccggtacgtaccggtaagggggaaacccacgtaaacggttcccaaccggttctaccggtaaccacgtaccggaacgggtaccccgggaacccgaaggttcctaagttacgagtacgggaggtctaggttacctacgttaacttggtaccggtacgggtcggtacgggacgaacggcggtacggtcgggttgggtacgggtccgggagggggtaaccgggtaccgtacggttccggtaaccggtacggtttaccggtaggttaccgacggtaacccgtaacccggggtccctaccccgggtcccccttccgggtcccttaccccgg

SEQ ID NO: 256279 - DNA, 647 bp, Homo sapiens
  misc_feature: GYAE6OF01ETFL0.12.8.A08.1.454.CMB.1.raw
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
tcagatacgacgtacacgaccggtgctcgatttagcatactctacagggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacagccagcatccacctgctctgganatgtatgactatgatatgtcttcgtggtatcagacaaggaacggcacggccaccgtccccctgtcccttactctacttcctttaacaaacgtccgacggcccgtcccgttcggtcgggtccagacgtcgtatctcgtgccgtccgactcggtacggaactacgacgtccactcgacgaccagtccgacggaccggacccgagtccgttagtcgacgtggtacgtcttcgtactacgtactcggtcggacggtcggacggacgacgtacgtacgggtacggttgggtacgggttaccggggacgggtaccgggtaccgtacggttccggtacggttacccggttacggtttaccgggaccgtacccggacccggtaaccggtccccggtaccccggttccccccggtcggtcccgttaacccccgg

SEQ ID NO: 256280 - DNA, 607 bp, Homo sapiens
  misc_feature: GYAE6OF01CNOW9.12.8.A08.1.454.CMB.1.raw
  modified_base (192)..(192): a, c, t, g, unknown or other
  misc_feature (192)..(192): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagacagccagcatccacctgctcgtggagatgtattgactaatggagtatgtcttccgtggtatcagcaggagcacggccacgcccctgtcctactctacttcttaacaaactaccgacggtccgccctcggtcgggtccctggacgctatctcgtcggctccgcgtcgtacggacacgcgtctacctctacgacctacgtacgacggaccgggaccgtacggtacgttagttcggagtggtacggtcgtacgtaccttacgttacgtgtaccggtagggcggtagggacgacgtcgaggtcgggttggttcggtcggggcgggacggtaccggtgtaccggtcggtaccggttcggttacggtccgaaccggtacccgacggtcccgtaccggtcccccgttcggtcctacccg

SEQ ID NO: 256281 - DNA, 691 bp, Homo sapiens
  misc_feature: GYAE6OF01C99P4.12.8.A08.1.454.CMB.1.raw
  modified_base (195)..(195): a, c, t, g, unknown or other
  misc_feature (195)..(195): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcacgcccaccctccatcgtcccgtcgtcccccgganagacagccagcatcacctgctcgtggatatgttattgaactaatgtagtatgtccttccgtaggtaactcgagacgaaggaacggccgaacggtccgaccgtcccccctgtccctactctaacttaccgtttaaacaaaacgtccgacgggtcccggtccccgttcggtccgggggttccctaggacgtaccggtacttccgttcggtccggtccgttacccgtaaccgttcggtaacgggaaacctaccgtaggtacctacttccgtaccggaacctacgtaccgacgggacccgggaaccccgaggttacctaagttcgaggtcggtacggtcttacgtaccttacgtacgtagttaccggacgggttcggacgggacacgggccgagggtccgggtgggttcggtccgggacgggtacgggaccgtagtcggtcggtaccgttgtacggccgtacgcccgtaacggccctacccggccccctcggtcctcccg

SEQ ID NO: 256282 - DNA, 779 bp, Homo sapiens
  misc_feature: GYAE6OF01DGL6E.12.8.A08.1.454.CMB.1.raw
  modified_base (191)..(191): a, c, t, g, unknown or other
  misc_feature (191)..(191): n is a, c, g, or t
  modified_base (202)..(202): a, c, t, g, unknown or other
  misc_feature (202)..(202): n is a, c, g, or t
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
tcagatacgacgtacacgaccggtgctcgatttagcatactctacaggggctgggcctcaggaggcagcatcggaggtgcctcagccatggcatggactccctctcttcctcggcgtccttgcttactgcacagaactccatcgcctctatgtagttgactcacgcccacctcatcgtccgtcgccccganagacacgccancatccactgctcgtggagtntgtattgaactaanggtaatgtcgtccttccgtaggtactacgaggacaggacggcaccgggccaccgtccccgtcgtcctactactactttaacttaaacaaacgtcccgacgggtcccgtccccgttcgggtaccgggttcccaggacggtacccgttagtttcccgtcggtccggtccctaccggaccgtttacggaaacgggaaccttaacggacggttacccacgttaccgaccgaacctacgtaccgggaaccgggacccgggtaaaccgttgtaactttaagtacggagttcggtaccggttacgttaaccgttaccgtttaccgttaaccgggtacggtttaccggaacgggggtaccgtacggggacgtaaccggttaaccgggcggggttcgggggtttaaccggggtgggtacccgggggagggttaacccggacggttaacgggttccggtacgggtaacccgggttcggtttaaaccgggcgaaaaccccggtccgtaccggggttcccttccccgggaacccgtttcggtaccgtttaccccg

SEQ ID NO: 256283 - DNA, 575 bp, Homo sapiens
  misc_feature: GYAE6OF01DVZ57.12.8.A08.1.454.CMB.1.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
  modified_base (390)..(390): a, c, t, g, unknown or other
  misc_feature (390)..(390): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagcccaccctccatgtccgtgtcccccgganagacagccagcatcacctgctctgganatgtattgactaatgagtatgcttcctggtatcagcagaaggcaggccagccccctgtcctactcatcctttacaaatccaggccgccctgtcggggtccctggagcgattctctggcctccgactcgtagggaacacgagtccactctcgaccatccaggccgggaacccnggctagttgagtgaggtctgtaccttactacgtgtcgagggcggtgggacaggtccgaggtccggtgggttcggtccggggcgggacgggtaccgaggttccggtcggtacccggttcggttacgggtacccacggacccccggtaaagggcccttcccggcccccccgttgggtccctaccccg

SEQ ID NO: 256284 - DNA, 776 bp, Homo sapiens
  misc_feature: GYAE6OF01BZO73.12.8.A08.1.454.CMB.1.raw
  modified_base (323)..(323): a, c, t, g, unknown or other
  misc_feature (323)..(323): n is a, c, g, or t
tcagatacgacgtacacgaccggtgctcgatttagcatactctacagggctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacagccagcatccacctgctcgtggagatgtattgactaatgagtatgtcttctgtatcagcagaagcgacggccacgcccctgtcctactctattcttacaaactccgacggccgtccctcgtcggtccngacgctattctcgtcgtcctccgtactcgtacggaaccacgtagtcctactcgtacgacctacgtacgacggacccgggacctagggtacctttaggtaacggacgttacgggacggttcgttaccgttaacccttacgtttaaccgtttacgggtacccgggtaacggggtccgggttaacggggaacccgtaacgggtaccgggttaacggggttccggggttttacgggggtttaccgggtttaccccgggggggaacgggggttaaacccgggggtaccccggttaaaccggggtttcccgggttaaacccggggttaaccccgggttttacccggtttaaacgggggtccccgtaaaacccccgggtccccgggtaaaccgggttccccccggtttcccccgggtaccccccccgtttccgggggttaaccccctttaaccccccggg

SEQ ID NO: 256285 - DNA, 514 bp, Homo sapiens
  misc_feature: GYAE6OF01DVXWV.12.8.A08.1.454.CMB.1.raw
  modified_base (326)..(326): a, c, t, g, unknown or other
  misc_feature (326)..(326): n is a, c, g, or t
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
  modified_base (439)..(439): a, c, t, g, unknown or other
  misc_feature (439)..(439): n is a, c, g, or t
  modified_base (456)..(456): a, c, t, g, unknown or other
  misc_feature (456)..(456): n is a, c, g, or t
  modified_base (469)..(469): a, c, t, g, unknown or other
  misc_feature (469)..(469): n is a, c, g, or t
  modified_base (485)..(485): a, c, t, g, unknown or other
  misc_feature (485)..(485): n is a, c, g, or t
tcagatacgacgtacacgaccggtgctcgatttagcatactctacaggggctgggcctcaggaggcagcatcggaggtgccctcagccatggcatggatccctctcttccctcggcgtccttgcttactgcacaggttccgtggcctcgtatgacctgactcagccaccctctgtgtccgtgtccccaggacagacagtcacaatctcatgctctggagatgcaagttgggggtaaaaatttgctttctggtatcagcagaacgcaggccacgtcccctgtccttggtcatctaataaggatagcaggcggccctcagggattccngagcgacttcgtcccggctacccaactccggacaaccacacgaccactctgaaccatcagccgggaaccccnggctctcgangagctgtactattactgccaggcgtggaacngcctcacttccgttatntcgtgaggtgacngtgtccacgtctagcncgacccacgaacccaccctatcgtctacg

SEQ ID NO: 256286 - DNA, 660 bp, Homo sapiens
  misc_feature: GYAE6OF01BKFT6.12.8.A08.1.454.CMB.1.raw
  modified_base (406)..(406): a, c, t, g, unknown or other
  misc_feature (406)..(406): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcagttagggggtaaaagtttgtctttctggtatcagcagaagccaggccacgtcccctgtcttggtcatctagtaagatagcaggcgccctcgagggtactccgtgacgtcgtacttccgtccggctacccgaaccgtccggacaaccgacacgcccactctacgaccatccgacggccgggaccncggcctcgacgtagtcggaggtctgtaccttagttaccgtggacccgtacgggccggtggggaacctacggacccttaccccgtaccggttttacccgttacgttcggttcccgtttacggggtacgggttacgggtacccgtaggttcccgggtaccgtaccccgggttccggttaacgggtaccccaacgggtaaccccccgaaaccgtaaccccccgaaccccctacggttacccgtcccgttaaaccccg

SEQ ID NO: 256287 - DNA, 824 bp, Homo sapiens
  misc_feature: GYAE6OF01DKZIS.12.8.A08.1.454.CMB.1.raw
  modified_base (192)..(192): a, c, t, g, unknown or other
  misc_feature (192)..(192): n is a, c, g, or t
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (279)..(279): a, c, t, g, unknown or other
  misc_feature (279)..(279): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagcccaccctccatcgtccgtgtcccccgganagacagccagcatcacctgctctggatatgtattgactaatgagtangtcttcgngtatcagcagagcagctacgcccctgcctacnctattaccgtttaacaaaactccgacggcccgccccttacggtcggggtcccctaggaccgtaccggtaactttccgtacccgggtccttaacccgaacccgtcccgggaaccaaaccgtaaccaccgggaccctaaccttccgacgtaaccccgagtacccgaacgggccccggggaaccccaggggccctttaccaccgggaagttacgggaaccggtcgtaacggtaaccctttaagtttaacccggccggaccggttaacgggaccgggttaccggggaacttaacccgggcccctttaacccctaacccggtttttccccgggtttaaagtttcccgggtttacccgggttttaacggggggaaaccgggttaccgggggtaaaccccttagggttttccccgggggttaacccctaaccccccggggtttttacccggtaaccggggttaaccccaacccggggtaaaccccccctaaaaaccggggaaaccccccccttaaacccccccggtaaacgtttccccgggttaaacccccg

SEQ ID NO: 256288 - DNA, 701 bp, Homo sapiens
  misc_feature: GYAE6OF01BMHKW.12.8.A08.1.454.CMB.1.raw
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
  modified_base (224)..(224): a, c, t, g, unknown or other
  misc_feature (224)..(224): n is a, c, g, or t
  modified_base (442)..(442): a, c, t, g, unknown or other
  misc_feature (442)..(442): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatcggcctcctatgagttgactcacgcccaccctccatcgtcccgtcgtcccccgganagacagccagcatccacctgctnggatntgtatgaactatgagtatcggtcttccgtggtactcgagcgaaggaggcgacggccaccggccccctgtccctactctaacttccttaacaaaactccgacggtcccgcccttcggtcgggtccctaggacgtccgtattccgtcgtcggtcctccgtagtcggtaacgggaaccacgtacgtccacttcgacgacactacgaccggaccggaacccnggtaccttagttacgaggtacggacggttcgtacgttaccgttaacttacgtacggtacggacgggtcggtaacggacgtacggtacgtaacggggttggttcggggtacgggttacccggggaacgggtacgggtaacccgtagggttacccggttacggtacccggggtttacgttaacgggtacccggaacccggtacccggtaaccgggtccccggtccccggtccccccgttccggtaccgtttacccccccgg

SEQ ID NO: 256289 - DNA, 684 bp, Homo sapiens
  misc_feature: GYAE6OF01CUUYD.12.8.A08.1.454.CMB.1.raw
  modified_base (188)..(188): a, c, t, g, unknown or other
  misc_feature (188)..(188): n is a, c, g, or t
  modified_base (215)..(215): a, c, t, g, unknown or other
  misc_feature (215)..(215): n is a, c, g, or t
  modified_base (425)..(425): a, c, t, g, unknown or other
  misc_feature (425)..(425): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctctatgagttgactcagccaccctcatgtccgtgtcccccgganagacagccagcatcacctgctctgganatgtattgactaatgatatcgcttccgtgtatcagcagagcaggccacgcccctgtcctactctacgttcttaacaaaagtccacggtccgccctcggtccggggtaccctggacgtcggtacttccgtcgtcggtccgtacccgtactccgtaggggaaccacgtacgtccacgtctacgaaccctgtaccgacggacccggaacccgnggtaccttaagttcggtagttcggaacgggttcttcgtaaccttacgtacccgttggtaaccgtcggggtacgttaccggggaactcgggtaccgtacgggtcggttcgggttacgggttaccgggacgggaacgggtaccccgttagggtacccggttacggtaccccggtttaccggtttaaacgggccgttaacccgggaccccgtaaacggggtccctaccccggtacccccggttccggttcccgttaaccccg

SEQ ID NO: 256290 - DNA, 741 bp, Homo sapiens
  misc_feature: GYAE6OF01D4JFI.12.8.A08.1.454.CMB.1.raw
  modified_base (190)..(190): a, c, t, g, unknown or other
  misc_feature (190)..(190): n is a, c, g, or t
  modified_base (195)..(195): a, c, t, g, unknown or other
  misc_feature (195)..(195): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctctatgagttgactcacgccaccctcatcgtccgtcgtccccgganagacngccagcatccacctgctcgtggagtattgtattgaactaagtgaagttatcgtcctttcgtaggtactcgagacgaaggaacggcgacgggaccccacccgtcccccgttgtacccttacgtacctaactttaccgttaaacaaaacgtacccggacgggtcccgtcccgttcggtccggggtccctaggacgtcgttacttcgtcgtcggtacctccgtacgtcgacggaacacgtcgtacctactacgtacgacctacgtaccggaccgggaccgggaaccgtacggtacttaaggttcggacggtggtccggttacgttacgttaccgtacttcggttacggtacggtacgggtcgggtaacgggaacgcggtaggtaccgggttcgggttcggggtacgggttccggggaccgggaacgggtacccgtacggttaccggttaccgggttaaccggttcggtttaaccggaccggtaaaccccggtacccggtaaccgggtcccccgttaccccggtcccccggttcggtccccttaccccgg

SEQ ID NO: 256291 - DNA, 669 bp, Homo sapiens
  misc_feature: GYAE6OF01EK6AX.12.8.A08.1.454.CMB.1.raw
  modified_base (196)..(196): a, c, t, g, unknown or other
  misc_feature (196)..(196): n is a, c, g, or t
tcagatacgacgtacacgaccggtgctcgatttagcatactctacagggggctgggcctcaggaggcagcatcggaggtgcctcagccatggcatggatccctctcttcctcggcgtccttgcttactgcacagaatccagtcggcctctatgagttgactcacgcccaccctccatcgtccgtcgtcccccgganagacacgccagcatccacctgctcgtaggatatgtattgaactaagtgagtatcgtctttccgtaggtactacgagacaaggacggcacggcccaccgtcccctgtaccctactactactttaccttaacaaacgtccgacgggcccgtccgttcggtcgggtccctgacgtcgtacttccgtcgtcgcctaccgacttcggagaaacctacgtagtacctacgtacgtacgaacctacgtacgacgggtccgggaacctagtactaagttacggacgtacggacggtccttacgttacctaacgtcgtacggtacggtacgggtcggtacggacgtacggtacgtagggtcggttcgggtacgggtcggggacggtaaccgggtcctaggtaccgttaccggtacgttacggtacggccgtaacggacccgtacggtcccgtaccccggtccccggttcgtacccgtacccg

SEQ ID NO: 256292 - DNA, 620 bp, Homo sapiens
  misc_feature: GYAE6OF01D4XXR.12.8.A08.1.454.CMB.1.raw
  modified_base (155)..(155): a, c, t, g, unknown or other
  misc_feature (155)..(155): n is a, c, g, or t
  modified_base (189)..(189): a, c, t, g, unknown or other
  misc_feature (189)..(189): n is a, c, g, or t
  modified_base (359)..(359): a, c, t, g, unknown or other
  misc_feature (359)..(359): n is a, c, g, or t
  modified_base (508)..(508): a, c, t, g, unknown or other
  misc_feature (508)..(508): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagatccatcggcctctatgagttnactcagcccacctcatcgtccgtcgtccccgganacgacagccagcatccacctgctcgtggatattgttattagaacttaatgagttatcgtccttccgtaggtatcgagacgaaggaacgcgacggccctaccgtccccctggttccctactcctatttaccttaacaaactccgacggtcccgtcctcggtccgggtcccnggacgcgttacttcgtcgtcggcctccgactcgacggaccacgtacgtcaccgtcgtacgaccacgtcgacgggtaccggaccgtaggtacttagtgagttcggcgttcttacgtctacttcgttggtaccgagggtcggtacggacgnggacgtcggtcggttacggtcggtccgggacggtacgaccgtagtccggtacgtacggtcgttacggccgtaccgaccggtacggtccctacccgtccccgtgtccgtaccg

SEQ ID NO: 256293 - DNA, 653 bp, Homo sapiens
  misc_feature: GYAE6OF01DRB03.12.8.A08.1.454.CMB.1.raw
  modified_base (191)..(191): a, c, t, g, unknown or other
  misc_feature (191)..(191): n is a, c, g, or t
  modified_base (220)..(220): a, c, t, g, unknown or other
  misc_feature (220)..(220): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctctatgagttgactcacgccaccctcatcgtccgtcgtcccccgganagacacgccagcatccacctgctctgganatgtattagaactagtgatatcgtccttcgtggtactcgagcgaaggacggcgacggacccaccgtccccctgtaccctactctaactttacctttaacaaaacctccggaggtccccgtcccgttacggtcggggtaccctggacgtcgtacttccgtcgtcggtccctaccgacttacggtacggaaccacgtacgtaccctacgtcgtaccgacctacgtaccgaccgggaccgggtaccctaggtcttaagtcggatcgggacggttctcgttaccgtacgtacgtggtacgacgggtcggaacggacgcggtcgtaggttcgggtgggttacgggtcggggaacgggtacggtaccgtggtccgtaccggtccggttagtcggaccacggacccgtacggtccctcccgccccgttgtacccttcccg

SEQ ID NO: 256294 - DNA, 574 bp, Homo sapiens
  misc_feature: GYAE6OF01D7HX9.12.8.A08.1.454.CMB.1.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
  modified_base (333)..(333): a, c, t, g, unknown or other
  misc_feature (333)..(333): n is a, c, g, or t
  modified_base (395)..(395): a, c, t, g, unknown or other
  misc_feature (395)..(395): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccatcctccatgtccgtcgtcccccgganagacagccagcatcacctgctctgagntgtatgactaatgagtatgcttctgtatcagcagagcacggccacgcccctgtcctactctactcttacaaactaccgacggccggtccctcgtcggggtccctgacgctattcncgtcggcctccgactcgtacggaacacgatccactcacgacactcgacggccgggaacccgngtcttagtgagtcggtacgtcgttacgtccttactacgtggacgacgggtacggtcgggaacgtagaccgtggacggttgggtacggtcgggacggacgggtacgtcgtcgtaccggtaccggttcgtaccggaccgaccggtaccgacggtcccgtcccggtccccgtcggtaccccg

SEQ ID NO: 256295 - DNA, 849 bp, Homo sapiens
  misc_feature: GYAE6OF01DUSC1.12.8.A08.1.454.CMB.1.raw
  modified_base (192)..(192): a, c, t, g, unknown or other
  misc_feature (192)..(192): n is a, c, g, or t
  modified_base (197)..(197): a, c, t, g, unknown or other
  misc_feature (197)..(197): n is a, c, g, or t
  modified_base (218)..(218): a, c, t, g, unknown or other
  misc_feature (218)..(218): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttcgactcagcccaccctcatcgtccgtcgcccccgganagacngccagcatccacctgcctcgnggatactgttagttgaactaagtgagttatcgtaccttccgtaggtactacgagacgaaggaacggtcgacggccctaccgtcccccttagtcctacctctacttacttaacaaagtcccgagggtccccgtacccgttccggtccggggtccctagacgtccgttacttccgtaccgtcgggtcccttacccggtacgttccggtaaccggggaaacctaccgtacgtaccctacgttacccgtaccgaacctaccgtacccggaaccggggaccccggtaaaccccggtagggttaccctttaacggttaaggacggttacggggtaccgttacccgtttccggtaaccccttttaaccgtaccggttccgggtaacgggtccggggtaccgggttaccgggaacgtacgggtccgggttaaccgggtttcggggttacgggggtttcccgggtccggggggaaccggggtaacggggtaaccccgttagggttaccccggtaccgggttaaccccgggttttacggtttaaccggggaacccccgtacccgggtaaccccgggtaccgggtttccccccggtaccccggtttacccccccgggttccgggttaaccccttcccccggg

SEQ ID NO: 256296 - DNA, 798 bp, Homo sapiens
  misc_feature: GYAE6OF01BNM4T.12.8.A08.1.454.CMB.1.raw
  modified_base (194)..(194): a, c, t, g, unknown or other
  misc_feature (194)..(194): n is a, c, g, or t
  modified_base (254)..(254): a, c, t, g, unknown or other
  misc_feature (254)..(254): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagcccaccctccatcgtcccgtcgtcccccgganagaccagccagtcatccacctgcctcgtggagtattgttattagacttaagtgtaagttntcgtccgtttccgtaggtactcgacgacgaaggaacggcgacggtcccacccgtcccctcgtccctactcctacttccttaaacaaacgtccgacgggccgtcccgttcggtcgggttccctaggccgtataccgttccgtcgtcggtacctccgtacttcggtacggaacctagtacgtaccctacgtcctacgaccgacgtaccgaccggggcccggtaaccgtacggtctaagtcggacgttaggaccgttcggttccgtttaacctaccgtttcgtacggtacggtcggggtaccggttaccgggaacgtcgggtacggttaccggggtcggtttaacggggtcccgggttacggggggaaccgggttaccgggggtaaccccttacggggttaccccgggtttaccggttaacccgggtttccggttaaacccggggacccgggttaaacccggtaccccggggtaaaccccgggttcccccggttaacccccccggggtcccccccgtttacggggtttaccccgtttcccccccggg

SEQ ID NO: 256297 - DNA, 728 bp, Homo sapiens
  misc_feature: GYAE6OF01A865Q.12.8.A08.1.454.CMB.1.raw
  modified_base (194)..(194): a, c, t, g, unknown or other
  misc_feature (194)..(194): n is a, c, g, or t
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatcggcctcctatgagttgactcacgccaccctcagtcgtcccgtcgtccccgganagacacgccagctactcacctncttcgnggatatgtattgactaatgatatgtcttccgtggtatcagcaggacgtcacggaccctaccgtccccctcgtaccttacttacgtaacttacctttaaacaaaaccgttacccggacgggtccccgtccccgttacgggtccgggggtccctagggtacggtccttacttcgtaccggttacgggtccctaccggtacgttacggtaaacgggacctaaacggttccggtacctaacccgttgtaaccgaccgtacgttaccggaaccgggtacccgggacccgtacggtacgtacgttacgtaacggttcggtacggtacttacgttaccgttaccgttacggtacggtaccggtagggtcggtacgggacgtacggcggtacgggtcggttagggttccgggtacgggacgggtacggacgtaccggttacgtacggtacgttacggtaccggtacgaccggaccgtaccgcccggttacccgtccccgtcgtcccgttacccg

SEQ ID NO: 256298 - DNA, 785 bp, Homo sapiens
  misc_feature: GYAE6OF01ADM48.12.8.A08.1.454.CMB.1.raw
  modified_base (200)..(200): a, c, t, g, unknown or other
  misc_feature (200)..(200): n is a, c, g, or t
  modified_base (411)..(411): a, c, t, g, unknown or other
  misc_feature (411)..(411): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgacacagactccatcggccctcctatgagttgacctcacgccctaccctcactcgtcccgtccgcccccgganacgaccgacgccagccacgtaccaccttcgctcgtaggatatgttatagacttaagtgagttatcgtccgttttaccgtggtactcgacgacgaacggacggcgtaccggccccacccgtccccgttacgttaccctaccgtacttacctttaccgtttaaaccaaccgtacccggtaccggccggttccccgtacggttccgggtacccnggtaccgtcgttacttccgtcgtcgtacccgttacccgacgttacggtacggaaccctacgtaccgtccttaaccgtccgtaacgacctacgacccgggaaccgggtaccccggaccgtaaggtcttaggacgtgaccgtaggtccttacgtaccgtacttcggtacgacgggtagggtcccggtaagacgtaccggtagggtcggttaacccgggttggggttacccgggaccggggtaggaacccggttcggtacccgttacgggttaccggttaccccggttggttaaccggtacccggacccggtaaacccggttccggttcccccccgtacccggacccccgggttttcgtaccccgtttacccccggg

SEQ ID NO: 256299 - DNA, 646 bp, Homo sapiens
  misc_feature: GYAE6OF01A32DT.12.8.A08.1.454.CMB.1.raw
  modified_base (200)..(200): a, c, t, g, unknown or other
  misc_feature (200)..(200): n is a, c, g, or t
  modified_base (250)..(250): a, c, t, g, unknown or other
  misc_feature (250)..(250): n is a, c, g, or t
  modified_base (388)..(388): a, c, t, g, unknown or other
  misc_feature (388)..(388): n is a, c, g, or t
  modified_base (504)..(504): a, c, t, g, unknown or other
  misc_feature (504)..(504): n is a, c, g, or t
  modified_base (603)..(603): a, c, t, g, unknown or other
  misc_feature (603)..(603): n is a, c, g, or t
tcagatacgacgtacacgaccggtgctcgatttagcatactctacaggggctgggcctcaggaggcagcatcggaggtgcctcagccatggcatggactccctctcttcctcgacgtccttgcttactgcacagaactccagtcggcctcctatggagttgacctcacgcccaccctccagtcgtccgtccgccccgganacgaccagccagcacgtccacctgctacgtggagtatgtatgacttaagngagtatcgtcttcgtggtactcgagcgaagtaacggcacggtccaccgtccccgtgtacccctctacctacttactttaaccaaaagtcccgacggtccgcccgtacggtccggggtcctacgacggtctacgtttcncgtcgtccgtccgactcggaacgacacgtctaccgactcgactactacgacgaaccggccgggaacctaggtctaaggtagtacgtgacgtcgtctacgtacgttcgtacgtacgngggtacgtcgggaacaccgtggtacgggtcggttacgggtcgggtacgggtccggggacggtacggacggttcggttcggtaccggtcgttaccgggtnacccggaccgtacgtcccgtcccgttcccggcggtaccctccg

SEQ ID NO: 256300 - DNA, 727 bp, Homo sapiens
  misc_feature: GYAE6OF01DSKPM.12.8.A08.1.454.CMB.1.raw
  modified_base (225)..(225): a, c, t, g, unknown or other
  misc_feature (225)..(225): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatcggcctcctatgagttgactcagcccaccctcatcgtcccgtcgtcccccggacagacagccagcatccacctgcctcgtggatntagtattgactagtgagttatcgtcttccgtaggttataccaggtacgaaggaacggccgacggccccgaccggtccccccttggttaccctacgttacctactttcctttaacaaaaacctccgaacgggtcccggtacccgttcggtccggggtccctgggacgtcgtacgttccgttacgtcggtcctcccgtacgtcggtaacggaccacgtacgtactacgtacctacgacctacgtccggaccgggcccggtaccgtacggtagttacgttaggacgttaggacgttacgtcgttaccgttacgttcgtggtaacgggcgggttaccgggaaggtaccgcggtacgtacgggttccgggttagggtcgggtacggggtaccgggaaccgggtaccgtagttccgggtacggttacccggttacgttccgggacccgtaacggacccgttaccggtaccccggttcccgtcccccggttcgtccccgtttaccccgg

SEQ ID NO: 256301 - DNA, 566 bp, Homo sapiens
  misc_feature: GYAE6OF01DLS42.12.8.A08.1.454.CMB.1.raw
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
  modified_base (374)..(374): a, c, t, g, unknown or other
  misc_feature (374)..(374): n is a, c, g, or t
  modified_base (467)..(467): a, c, t, g, unknown or other
  misc_feature (467)..(467): n is a, c, g, or t
  modified_base (474)..(474): a, c, t, g, unknown or other
  misc_feature (474)..(474): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagcccaccctccatcgtccgtgtcccccgganagacagccagcatcacctgctctgganatgtattgactaatgagtatgcttccgtgtatcagcagaaggcacggccacgcccctgtcctactcattccttaacaaactccgaggccgccctcggtccggggtccctggacgtcgtattccgtcgtcggcctcccggactcggtacgggaacncgacgtcactcgtacgacctactaccgacggcccggaccaggtctagttgagtggacgtcgtcgtctacttacgtgtcgtaggcggtaggacnggtacgnggtcggtgggttcggtcgggcgggacggaccgtgtcgtcggtacccgttggtacgcgacgacccgtacgcccgtccgccccgtgtcctcccg

SEQ ID NO: 256302 - DNA, 664 bp, Homo sapiens
  misc_feature: GYAE6OF01C2MZ1.12.8.A08.1.454.CMB.1.raw
  modified_base (223)..(223): a, c, t, g, unknown or other
  misc_feature (223)..(223): n is a, c, g, or t
  modified_base (262)..(262): a, c, t, g, unknown or other
  misc_feature (262)..(262): n is a, c, g, or t
  modified_base (455)..(455): a, c, t, g, unknown or other
  misc_feature (455)..(455): n is a, c, g, or t
  modified_base (469)..(469): a, c, t, g, unknown or other
  misc_feature (469)..(469): n is a, c, g, or t
  modified_base (480)..(480): a, c, t, g, unknown or other
  misc_feature (480)..(480): n is a, c, g, or t
  modified_base (523)..(523): a, c, t, g, unknown or other
  misc_feature (523)..(523): n is a, c, g, or t
tcagatacgacgtacacgaccggtgctcgatttagcatactctacaggggctgggcctcaggaggcagcatcggaggtgcctcagccatggcatggactccctctcttcctcggcgtccttgcttacgtgcacagaatccatcggcctcctatgagttgactcacgcccacctcatcgtccgtcgcccggacagacagcagtcactcacctgcctgtggaatnttgtattcgaataagtggtatatcgtcttcgttgtactnacgacgaaggaacgcgacggccaccgtccccgtcgtaccttacctctaactttcctttaaacgaaaaccgtcgtaccggtccgtcccgttcggtaccgggtcctaggacgtcgtactttcacgttcgacctacgcgtacggtacggaactcgaacgttcgacttccgacgactacgacggacgggccgaccgnggttactagtaagngtcgggacttntaccgtctacggtgtacgtcggaacggttccggaggtaaccgngtaccgggtcgttcgggacggttcgggtacgggaccgacggggttacctaacgggtccgtaacggttcccgtacggttaccgaccggtaccggaaccctacgggttcccgtaccccggtccctagggtttcctaaccccgg

SEQ ID NO: 256303 - DNA, 752 bp, Homo sapiens
  misc_feature: GYAE6OF01AXLII.12.8.A08.1.454.CMB.1.raw
  modified_base (150)..(150): a, c, t, g, unknown or other
  misc_feature (150)..(150): n is a, c, g, or t
  modified_base (157)..(157): a, c, t, g, unknown or other
  misc_feature (157)..(157): n is a, c, g, or t
  modified_base (192)..(192): a, c, t, g, unknown or other
  misc_feature (192)..(192): n is a, c, g, or t
  modified_base (273)..(273): a, c, t, g, unknown or other
  misc_feature (273)..(273): n is a, c, g, or t
  modified_base (433)..(433): a, c, t, g, unknown or other
  misc_feature (433)..(433): n is a, c, g, or t
  modified_base (475)..(475): a, c, t, g, unknown or other
  misc_feature (475)..(475): n is a, c, g, or t
tcagatacgacgtacacgaccggtgctcgatttagcatactctacaggggctgggcctcaggaggcagcatcgggaggtgcctcagccatggcatggatccctctcttcctcggcgtccttgcttactgcacagaatccatggcctctangtagttnactcagcccaccctcatcgtccgtcgtccccgganagacagcagacactcacctgcttcgtggagtattgttactagaacttaagtgagttactcgtccgtttaccgttggttacncgaacgacgaaggaacggccgacggccccgacccggtcccccgttcggtaccctttacttacctaacctttacctttaaacgaaaactacccggagggtacccggtcccggtccggtcgggttccccaggtacgtccgtacttctccggccgtccgtccngttacggacggaactcgtataccctacggtccacggtaaccntacccgggcgggtaacccggaccgtagggtccgttagtacggatacgggtcgttacgtctttaccggtacctttacggaccggttacggtcggtaaccggggtcgaccggtagggacccggtaacgggggttcgggtttacggggttaccgggtacgggggacggtccggggaaaccttccggttcggtaccggtaccggttttacggtccggtaccgtaaccgccggttaaccgggtccccgaccccggtttcccccgtcggttcccttaccccgg

SEQ ID NO: 256304 - DNA, 851 bp, Homo sapiens
  misc_feature: GYAE6OF01CZCLU.12.8.A08.1.454.CMB.1.raw
  modified_base (111)..(111): a, c, t, g, unknown or other
  misc_feature (111)..(111): n is a, c, g, or t
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
tcagatacgacgtacacgaccggtgctcgatttagcatactctacaggggctgggcctcaggaggcagcagtcggaggtgcctcagccatggcatggatccctctcttccncggctccttgcttactgcacagaactccatcggcctactagtcgagttagacctcgacgccctacccgtcacgtcgttccggtccggtcccccgganacgacgcgaccganacctactacccgaccttggaccttcggtagggtaagtagttacggttaattcggaaacttagtacggtaagttattccggtcttacggtaggtaactccgaagtacgaaggtaacgtccgaccggtaccccgaccggttacccccgtacgtttcctaaccgttactaaccgttttacccgttaaacgtaaaccgttcccggtaccgggtaccggttacccccgttgggttaacccggggttaccctggaccggttaccgttacgttccgttccggtcggtacccgttaccgtaacggtccggtaacgggtaacctacggttacgttacccgtaaacgttcccggtaagaccccgtaacggttaccggtaacccgggacccggggtaaaccgtacggtaacgttaacgtacgggtaacgtcgggttaccgtacgttacgtcgttaacggtaccgttcggtaacgggtacggtccggtacggaaccgtcggcgtacggggtttcggtaacgggttcggtaccgggtacggccggtaccgtcggtaccgttacggtaccggtttaccgtaccgggactaacccggtaccgtacggttccccgtacccggttccccgttgtccccgttaccgg

SEQ ID NO: 256305 - DNA, 774 bp, Homo sapiens
  misc_feature: GYAE6OF01AS3BT.12.8.A08.1.454.CMB.1.raw
  modified_base (201)..(201): a, c, t, g, unknown or other
  misc_feature (201)..(201): n is a, c, g, or t
  modified_base (476)..(476): a, c, t, g, unknown or other
  misc_feature (476)..(476): n is a, c, g, or t
  modified_base (494)..(494): a, c, t, g, unknown or other
  misc_feature (494)..(494): n is a, c, g, or t
tcagatacgacgtacacgaccggtgctcgatttagcatactctacaggggctgggcctcaggaggcagcatcggaggtgcctcagccatggcatggactccctcgtcttcctcggcgtccttgcttactgcacagaactccatcggcctccttatgtagttgactcacgccctaccctcatcggtccgtccgtccccgganacgacacgccagcactccgacctgctcgtaggatacttggttattgaacgttaataggacttagttcgttcccttacggttagtacgtacgaacgtacgaaaggacggcgtaaccggcctacccggtcccccttacgttacctacctacctactttacttaaaccgtaaacgtcccggaaccgtccgtacccgttccggttaccggtccttacggccgtacgtaccttacgtccgtacggtcccgtaccgtacgtccgaagtactacgtcgtacncggttaccgtacaccgtntaccggacggggcccgaaccgtaggtacttcggtaacggttacgacggggtaccgttggttacgttacccgtcgttaacgtaccgttacggggacggtttaccgggacggggaaccctacgggtacgttcgggggttaacccggtggggttaaccgggtcccgggggaaaaccggttcggtacccgggtactttaccggggccttagggttaacccgttaggaccccgtaaccgcggtaccccgtaccgtaccccggttcccgacgggttcctaccccgg

SEQ ID NO: 256306 - DNA, 692 bp, Homo sapiens
  misc_feature: GYAE6OF01CBD4Z.12.8.A08.1.454.CMB.1.raw
  modified_base (193)..(193): a, c, t, g, unknown or other
  misc_feature (193)..(193): n is a, c, g, or t
  modified_base (220)..(220): a, c, t, g, unknown or other
  misc_feature (220)..(220): n is a, c, g, or t
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagcacgccagcatcacctgctgtggantgtatgactatgagtntgcttcgngtactcagcgaagaggcgaggcccaccgtcccctgtccctctctacttacttaacgaaactccgacggccgtcccttcggtccgggtcctggacgtcgtattccgtcgtcggacctccgtactcggtacggacacgtacgtcctactcgtacgacctagtaccgacgggaccccgggaccgtaggtaacttacgttaggtacgtacgggcggttccgttacgtttacccgtacgtttaaccggtggtaccgggtcgggtacgggtacgggacgaggtccggttacggggtcggttcgggttccgggtacggggaccgggtaccgggacccggttacgttcccggtaacgggttacccggttacggttacccgggtaccgacccgggtaacccggtaccgggttccccgttacccccggtcccccggttcccgttcccgttacccccgg

SEQ ID NO: 256307 - DNA, 663 bp, Homo sapiens
  misc_feature: GYAE6OF01AEWZL.12.8.A08.1.454.CMB.1.raw
  modified_base (168)..(168): a, c, t, g, unknown or other
  misc_feature (168)..(168): n is a, c, g, or t
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (282)..(282): a, c, t, g, unknown or other
  misc_feature (282)..(282): n is a, c, g, or t
  modified_base (448)..(448): a, c, t, g, unknown or other
  misc_feature (448)..(448): n is a, c, g, or t
  modified_base (457)..(457): a, c, t, g, unknown or other
  misc_feature (457)..(457): n is a, c, g, or t
  modified_base (489)..(489): a, c, t, g, unknown or other
  misc_feature (489)..(489): n is a, c, g, or t
  modified_base (510)..(510): a, c, t, g, unknown or other
  misc_feature (510)..(510): n is a, c, g, or t
  modified_base (562)..(562): a, c, t, g, unknown or other
  misc_feature (562)..(562): n is a, c, g, or t
tcagatacgacgtacacgaccggtgctcgatttagcatactctacaggggctgggcctcaggaggcagcatcggaggtgcctcagccatggcatggatccctctctttccgtcggcgtccttgcttactgctacagaactccgagttcggcccttccgtatgtagttnactcagccctaccctcatcgtccgtcgacccccgaacgacagccagcatccacctggctcgnggactntgtactagaatagtgagttactcggtcctttcgtaggactgacggnaggtacggccgagggccctcccgacccccttgttacccctacggtctactttacttaaacggaaacctccggacgggtccccgaccccgttgggtaccgggtcctgacgtccttgtccctcgggccgtcctaacggtctacggaacgacctacggtctcaccggtntacaccganaccgccggggaaccgtccggactctagtacgngtcgcgtattccggtactacncgtcggtacgcggtggtaaggccagcgggtgcgggttcggtgggtaccgggnggccgttacgcgggtcgttaaccggtaccgggtttacgacccgacggtacccgacgggtcccgtacccgtcccccgtccgttaacccgggtccctttccgg

SEQ ID NO: 256308 - DNA, 498 bp, Homo sapiens
  misc_feature: GYAE6OF02IZAH7.12.8.A08.1.454.CMB.1.raw
  modified_base (306)..(306): a, c, t, g, unknown or other
  misc_feature (306)..(306): n is a, c, g, or t
tcagatacgacgtacacgaccggtgctcgatttagcatactctacagggctgggcctcaggaggcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaatttgctttctggtatcagcagaagccaggccagtcccctgtcttggtcatctataaggatagcaggcggccctnagggattcctgagcgattctccggctccaactccggcaacacagccactctgaccatcagcggacccaggctctcgatgaggctgactattactgccaggcgtgggacagctccacttccgtatgtcttcggagtgggaccagtcggtcaccgtctaggtcagcccaaggacccaaccccactcgtcctacc

SEQ ID NO: 256309 - DNA, 498 bp, Homo sapiens
  misc_feature: GYAE6OF02F1RKM.12.8.A08.1.454.CMB.1.raw
tcagatacgacgtacacgaccggtgctcgatttagcatactctacagggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtccctactcatctttcaaaataccaggcggccctctggggtccctgagcgattctctggctccgactctgggaacacagtcactctgaccatcagcgggacccaggctattgatgaggctgtctactactgtcaggcgtgggacagcgagcgtggtgttcggcggagggccaggtctggaccgtcgttaggtcaggcccaaggcctcggccccctggtcctaccg

SEQ ID NO: 256310 - DNA, 502 bp, Homo sapiens
  misc_feature: GYAE6OF02HJB0H.12.8.A08.1.454.CMB.1.raw
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagcccccctgtcctactcatctttcaaaataccaggcggccctctgggggtccctgagcgattctctggctccgactctgggaacacagtcactctgaccatcagcggacccaggctattgatgaggctgtctactactgtcaggcgtgggacagcagcgtggtgttcggcggagggccaggtcgtggaccgttcgttacggtcaggcccaagggcctcggccccctggtcctaccg

SEQ ID NO: 256311 - DNA, 526 bp, Homo sapiens
  misc_feature: GYAE6OF02HH8ZG.12.8.A08.1.454.CMB.1.raw
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccacgccccctgtcctactcatctttacaaataccaggcgccctcgtcggggtccctgagcgattctctggctccgactcgtagggaacacagtcactctcgaccatcgagccgggaccaggctatgagtgaggctgtctactactgtcgaggcgtggacagcaggcgtgggtgttcgggcgggacgggaccgaggtccgtcggtaccgtcgttacggtccgacggtcccgaacggccgtccggcccccgtcggtcctacccg

SEQ ID NO: 256312 - DNA, 477 bp, Homo sapiens
  misc_feature: GYAE6OF02HU85I.12.8.A08.1.454.CMB.1.raw
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccacctccatgtccgtgtcccccggacagacagccagcatcacctgctctggagatgtattgactaatgagtatgcttcctggtatcagcagaaggcaggccagccccctgtcctactcatctttcaaataccagcgcctctggggtccctgagcgattctctggctccgactctgggaacacagtcactctgaccatcacgcggacccaggctatgatgaggctgtctactactgcaggcgtgggacagcagcgtggtgtcggcggnggacngtcgngaccgtntaggcagccaggcctcgcccctcggtctcg

SEQ ID NO: 256313 - DNA, 523 bp, Homo sapiens
  misc_feature: GYAE6OF02HE9FO.12.8.A08.1.454.CMB.1.raw
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtccctactcatcctttacaaaactaccaggccggccctcgtcggggtccctgagcgattctctggctccgactctgggaacacagtcactctgaccatcagccggacccaggctattgatgaggctgtctactactgtcaggcgtaggacagcaggcgtggtgtcggcggagggaccgtaggtccgtggaccgttcgttacggtcgtacggcccgaaggtccgtccggtcccccgttcggtcctacccg

SEQ ID NO: 256314 - DNA, 494 bp, Homo sapiens
  misc_feature: GYAE6OF02HK2AT.12.8.A08.1.454.CMB.1.raw
  modified_base (217)..(217): a, c, t, g, unknown or other
  misc_feature (217)..(217): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctgganatgtattgactaatgagtatgcttcctggtatcagcagaaggcaggccagccccctgtcctactcatctttcaaataccaggcgcctctggggtccctgagcgattctctggctccgactctgggaacacagtcactctgaccatcagcgggacccaggctatgatgaggctgtctactactgtcaggcgtgggacagcagcgtggtgtcgggcggagggaccaggtcgtggaccgttcttacggtcagcccaaggcctcggcccctggtcctaccg

SEQ ID NO: 256315 - DNA, 486 bp, Homo sapiens
  misc_feature: GYAE6OF02IXDNC.12.8.A08.1.454.CMB.1.raw
  modified_base (439)..(439): a, c, t, g, unknown or other
  misc_feature (439)..(439): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtcctactcatctttcaaaataccagcgccctctggggtccctgagcgattctctggctcgactctgggaacacagtcactctgaccatcagcggacccaggctatgatgagctgtctactactgtcaggcgtgggacagcagcgttggtgttcggcggagggacnggtcgtgaccgtcgttagcagcccaggcctcggcccctcggctaccg

SEQ ID NO: 256316 - DNA, 598 bp, Homo sapiens
  misc_feature: GYAE6OF02JHI9N.12.8.A08.1.454.CMB.1.raw
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtcccgtgtcccccggacagacagccagcatcacctgctctggagatgtattgactaatgagtatgcttcctggtatcagcagaaggcaggccagcccccctgtcctactcactctttacaaaatcccaggccgccctcgtcggggtccctggacgcgtattctcgtggctccgactcgtgggaaccacagtccactctcgaccatcaggccggacccaggctagttcgagtcgaggctgtcttactacgtgtcgacgggcgttacgggacgagccgtaggaccggttgggtcggttccggggacgggtacggggtacccgtagggttccgtcgggtaaccgttccggttaacgggtcccgaacggtacccccggtaagggtcccttacccggggtcccccccgttcggggttacccctacccgg

SEQ ID NO: 256317 - DNA, 539 bp, Homo sapiens
  misc_feature: GYAE6OF02F8JGV.12.8.A08.1.454.CMB.1.raw
  modified_base (190)..(190): a, c, t, g, unknown or other
  misc_feature (190)..(190): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccagcatcacctgctctggagatgtattgactaatgagtatgcttcctggtatcagcagaaggcaggccagccccctgtcctactcatctttacaaatccaggcgccctctggggtccctgagcgattctctggctccgactctgggaacacagtcactctgaccatcacgcggacccaggctattgatgacggtctgtctactactgtcgaggcggtagggacaggctaggcggttggtcggttcgggcgggacgggtaccgaggtccgtgggacccggttgttaacgggtcctaacggcccaacgggtcccgttaccggccccccgttcggtcctacccgg

SEQ ID NO: 256318 - DNA, 539 bp, Homo sapiens
  misc_feature: GYAE6OF02I6BHZ.12.8.A08.1.454.CMB.1.raw
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgatatgcttcctggtatcagcagaaggcaggcccagccccctgtcctactcatctttacaaaatccaggcgccctcgtcggggtccctgacgcgattcgtctggctccgactcgtgggaacacgagtcactctacgaccatcgagccgggaccaggctatgatgagctgtctactactgtcgaggcgtacggacagcgagcgtgggtcgttcgggcgggtagggaccaggtccgtacggtccggttacgttacgggtcctacggaccccgaagggcctcccggtaccccccttcgggtaccctacccg

SEQ ID NO: 256319 - DNA, 652 bp, Homo sapiens
  misc_feature: GYAE6OF02H1RM0.12.8.A08.1.454.CMB.1.raw
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccacgccccctgtcctactcatctttacaaactaccaggccgccctcgtcggggtccctgacgcgtattctcgtcggtcctccgactcgtacgggaaccacgacgtcacctctacgaccagtccgaacgggtcccgggaacccgaggtccttaagttggacgttaggaacgggttccttacggttaccttaaccgttaacgtcggtaccgacgggtccgggttagggacctagggaccgtagggtccggttgggtcggttccggggacgggtacgggaccgtaaggtcccggttacgggtacccggtttcggttaaccgggtaccgtaccggaccccgtaacgggtcccgttaccccgggtaccccccgttacgggtccctaaccccgg

SEQ ID NO: 256320 - DNA, 527 bp, Homo sapiens
  misc_feature: GYAE6OF02INIXK.12.8.A08.1.454.CMB.1.raw
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtcctactcatctttacaaaataccaggccgccctcgtcggggtccctgagcgattctctggctccgactcgtgggaaccacgagtcactctcgaccatcagccggacccaggctattgatgaggctgtctactactgtcaggcgtggacgagcgagcgtggtgttcgggcgggagggaccaggtcgtcggtaccgttcgttacggtccgacggtcccgaacggtccgtccggcccccgttccggtcctacccg

SEQ ID NO: 256321 - DNA, 510 bp, Homo sapiens
  misc_feature: GYAE6OF02HFROV.12.8.A08.1.454.CMB.1.raw
  modified_base (317)..(317): a, c, t, g, unknown or other
  misc_feature (317)..(317): n is a, c, g, or t
  modified_base (410)..(410): a, c, t, g, unknown or other
  misc_feature (410)..(410): n is a, c, g, or t
  modified_base (420)..(420): a, c, t, g, unknown or other
  misc_feature (420)..(420): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccacgccccctgtcctactcatctttacaaatccaggcgcctcgtgggattccngacgcgattctccggctccaactccggacaacacagccactctgaccatcacgcggacccaggctctcgatgacgctcgtctactactgtcgnggcgtggacngcgagcgtggtcgtcggcggagggccaggtcgtcgtaccgttcgttacggtccgacgcccgaggccgtccggccccgttcggtcctaccg

SEQ ID NO: 256322 - DNA, 551 bp, Homo sapiens
  misc_feature: GYAE6OF02HY5TZ.12.8.A08.1.454.CMB.1.raw
  modified_base (367)..(367): a, c, t, g, unknown or other
  misc_feature (367)..(367): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaagcaggccagccccctgtcctactcatctttacaaaatccaggccgccctcgaggggtccctgacccgtattcctctggcctccgaagtctggccaccctcacgcctcccncggccctagtcaggtcgggcctccgagtctagaggatggagtctgtaatttattactgtgctatcgagtgggctagacctacccgtaggaccgtgggtccgggtagttcgggttccgggcgggtaacgggacctaaggccgtacggacccgttaccgtaggtaccgacggaccccgaaggcccg

SEQ ID NO: 256323 - DNA, 582 bp, Homo sapiens
  misc_feature: GYAE6OF02H44RL.12.8.A08.1.454.CMB.1.raw
  modified_base (189)..(189): a, c, t, g, unknown or other
  misc_feature (189)..(189): n is a, c, g, or t
  modified_base (216)..(216): a, c, t, g, unknown or other
  misc_feature (216)..(216): n is a, c, g, or t
  modified_base (352)..(352): a, c, t, g, unknown or other
  misc_feature (352)..(352): n is a, c, g, or t
  modified_base (395)..(395): a, c, t, g, unknown or other
  misc_feature (395)..(395): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccacctccatgtccgtgtcccccgganagacagccagcatcacctgctctgganatgtatgactaatgagtatgcttcctggtatcagcagaaggcaggccagccccctgtcctactcacttcttacaaaactaccaggaccggcccttcgtcggggtccctggagcgtattctctcggcctcgactcgngggaacacgagtcactctcgaccatcgacggtccgggaacccnggtctacttgactaggaggtctgtactactctgtcgagggcggttagggacaggtcacggtcgggttgggttggttccggggacggggacgggaccgtacggttcggtcggtacccggttgttaccgggttaccacggtacccggtaacggccggttcccggacccccgtccgggtcccttacccgg

SEQ ID NO: 256324 - DNA, 521 bp, Homo sapiens
  misc_feature: GYAE6OF02ITIX8.12.8.A08.1.454.CMB.1.raw
  modified_base (189)..(189): a, c, t, g, unknown or other
  misc_feature (189)..(189): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctcatgtccgtgtcccccgganagacagccagcatcacctgctctggagatgtattgactaatgagtatgcttctggtatcagcagagcaggccagcccctgtcctactcatcttacaaatccaggcgcctcgtggggtccctgagcgtattctctcggctcgactcgtgggaacacagtccactctgaccatcaggcggacccaggctattgatgagtctgtctactacgtgtcgaggcggtaggacagcgaggtcgttggtcggttcgggcgggtagggaccgaggtcgtcggtaccgttcgttacggtcgacggcccgaaggtcctccggcccccgttcgggtccctaccg

SEQ ID NO: 256325 - DNA, 587 bp, Homo sapiens
  misc_feature: GYAE6OF02HJHKJ.12.8.A08.1.454.CMB.1.raw
  modified_base (218)..(218): a, c, t, g, unknown or other
  misc_feature (218)..(218): n is a, c, g, or t
  modified_base (367)..(367): a, c, t, g, unknown or other
  misc_feature (367)..(367): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtcccgtgtcccccggacagacagccagcatcacctgctctgganatgtattgactaatgagtatgcttcctggtatcagcagaaggcaggccacgccccctgtccctactcatctttacaaaatccgaggccgccctcgtcggggtccctggacgcgattctcgtcggcctacccgactcgtacgggaaaccncgacgtcactctacgaccatcgacggccgggacccaggtacctagttcgagtggacggtctacggttccttaacgttactcgtcgaggccggtagggaacacggcacgggtcgttgggtcggttcgggacggacgggaccgtaggtcgtacggtaccgttacgtacggtcgtacggcccgaacgggtcccgtacccggtcccccgttcggtacctacccg

SEQ ID NO: 256326 - DNA, 625 bp, Homo sapiens
  misc_feature: GYAE6OF02JB0AJ.12.8.A08.1.454.CMB.1.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
  modified_base (487)..(487): a, c, t, g, unknown or other
  misc_feature (487)..(487): n is a, c, g, or t
tcagatacgacgtacacgaccggtgctcgatttagcatactctacagggctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagacagccagcatcacctgctctgganatgtattgactaatgagtatgcttctgtatcagcagagcagccacgcccctgtcctactcacttctttaacaaactccaggccgtccctcgtcggggtccctgacgcgtattctcgtcggtcctccgacgtcgtacgggaacctacgtacggtcctacctcgtacgaaccctacgtccgaacgggtacccgggacccgtaggtacttaacgttggaacggtcggggtctcgttacctacgttagtcgtacgcgggtcggttacgggacncggacgtacggtcgggttcgggtcggttcgggacgggtacgggacccgtagttccgtacggtacccggttagttacgggtccgaacggtcccgaagggtccctacccggtccccggttacggacctacccggttcccg

SEQ ID NO: 256327 - DNA, 634 bp, Homo sapiens
  misc_feature: GYAE6OF02JKR9W.12.8.A08.1.454.CMB.1.raw
  modified_base (221)..(221): a, c, t, g, unknown or other
  misc_feature (221)..(221): n is a, c, g, or t
  modified_base (333)..(333): a, c, t, g, unknown or other
  misc_feature (333)..(333): n is a, c, g, or t
tcagatacgacgtacacgaccggtgctcgatttagcatactctacaggggctgggcctcaggaggcgagcatcggaggtgcctcagccatggcatggatccctctcttcctcgcgtccttgcttactgcacagaatccatggcctcctatgagttgactcagcccaccctccatgtccgtcgtcccccggacagaccagcccagcatcacctgctctgagntgtattgactaatgagtatgcttcctggtatcagcagaaggcaggcctacgcccctgtccctactcacttctttaacaaatacccaggccgccctacgtcggggtccctagngccgacttccgtctcggcctccgactccgtacgggaactaccgagtcctaacctcgtcgacctactaccgacggccggaccccgagtactacgttagagtacgagggtccttacggttacctaccgttaacgtcgtacgtacggtcgggacggtacgacgcgtacggtcggttcggttaggttccgggacgggtacggtaccgtacggtcgtccggtaccggtttaccgttacggtaccgaccggaacccggtaacgggtcccgtcccgggtaccccccgttccgggtcccgttaccccgg

SEQ ID NO: 256328 - DNA, 519 bp, Homo sapiens
  misc_feature: GYAE6OF02GUCOG.12.8.A08.1.454.CMB.1.raw
  modified_base (189)..(189): a, c, t, g, unknown or other
  misc_feature (189)..(189): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctcatgtccgtgtcccccgganagacagccagcatcacctgctctggagatgtattgactaatgagtatgcttcctggtatcagcagaaggcaggccagccccctgtcctactcatctttacaaaataccaggcggccctctcggggtccctgagcgattctctggctccgactctgggaacacagtcactctgaccatcagcgggaccaggctattgatgaggctgtctactactgtcgaggcgtgggacagcaggcgtggtgttcgggcgggacgggacctaggtccgtggacccggttcgttaagggtccacggacccgaaggcctccggccccccgtcggtcctaccg

SEQ ID NO: 256329 - DNA, 516 bp, Homo sapiens
  misc_feature: GYAE6OF02FJIYT.12.8.A08.1.454.CMB.1.raw
  modified_base (192)..(192): a, c, t, g, unknown or other
  misc_feature (192)..(192): n is a, c, g, or t
  modified_base (365)..(365): a, c, t, g, unknown or other
  misc_feature (365)..(365): n is a, c, g, or t
  modified_base (456)..(456): a, c, t, g, unknown or other
  misc_feature (456)..(456): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagcccaccctccatgtccgtgtccccccgganagacagccagcatccacctgctctggagatgtattgactaatgagtatgcttcctggtatcagcagaaggcaggcccagccccctgtcctactcatctttcaaaatccaggcgccttcgtggggtccctgagcgattctctggcctccgactctgggaaccacgagtcactcngaccatcagcggacccaggcctattgatgaggctgtctactactgtcaggcggtgggacagcgaggcgtggtggttcggcgggagggaccnggtcctggaccgtcgttacggtcaggcccaagggtcctccggccccctcggtcctacccg

SEQ ID NO: 256330 - DNA, 593 bp, Homo sapiens
  misc_feature: GYAE6OF02HR130.12.8.A08.1.454.CMB.1.raw
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagcccaccctccatcgtccgtgtcccccgganagacagccagcatcacctgctctgganatgtattgactaatgagtatgcttctggtatcagcagaaggcaggcccagccccctgtccctactcatctttacaaaatccgaggtcgccctcgtgggtccctgcgcgtattctcgtggcctccgactcgtacgggaaccacagtccactctacgacctatccgacggaccggacccgaggccttagttgagtgaggtcttaggtaccttacttacgtggtccgagggtaccggtgggacgtagcgaggtccggttgggtcgttcggggcgggtacgggtccgaaggttcccgtcggtacccggtttcgttaccggtacctacggtaccccgtaagggccccgtcccggtaccccccgttggtccccgtaaccg

SEQ ID NO: 256331 - DNA, 598 bp, Homo sapiens
  misc_feature: GYAE6OF02FXKC2.12.8.A08.1.454.CMB.1.raw
  modified_base (191)..(191): a, c, t, g, unknown or other
  misc_feature (191)..(191): n is a, c, g, or t
  modified_base (377)..(377): a, c, t, g, unknown or other
  misc_feature (377)..(377): n is a, c, g, or t
  modified_base (432)..(432): a, c, t, g, unknown or other
  misc_feature (432)..(432): n is a, c, g, or t
  modified_base (518)..(518): a, c, t, g, unknown or other
  misc_feature (518)..(518): n is a, c, g, or t
tcagatacgacgtacacgaccggtgctcgatttagcatactctacaggggctgggcctcagggaggcagcatcggaggtgcctcagccatggcatggatccctctcttcctcggcgtccttgcttactgcacagaatccatggccctctatgagttgactcagccaccctccatgtccgtgtcccccgganagacagccagcatccacctgcctctggagatgtatgactaatgagtatgcttctggtatcagcagaagcacggcccaccgcccctgcctactctacttctttacaaaactccgacggccggtcccctggtcggggttccctgacgtcgtattccgtcgtcggcctccggaccttcgtacgggaacncacgtcctaccgtctacgacctatcgacggcccggaccgaggtcttagtcgtagngtaggtcttgttactactacgttgtccgtagggtcgtacggactacgcgtacggtcggttggtcgggttacggcgggtacggaccncggtccgtccggaccgtttcggtacggtaccgaccggtacccgaccggtccctacccgcccccgttacggtcctaccccg

SEQ ID NO: 256332 - DNA, 632 bp, Homo sapiens
  misc_feature: GYAE6OF02G9J3W.12.8.A08.1.454.CMB.1.raw
  modified_base (195)..(195): a, c, t, g, unknown or other
  misc_feature (195)..(195): n is a, c, g, or t
  modified_base (216)..(216): a, c, t, g, unknown or other
  misc_feature (216)..(216): n is a, c, g, or t
  modified_base (257)..(257): a, c, t, g, unknown or other
  misc_feature (257)..(257): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcacgcccaccctccatcgtcccgtcgtcccccgganagacacgccagccatcacctncctctggagatgtattgactaatgagtatgtcttcgtgtancagcaagagcacgccacgcccctgtcctactctatctttacaaactcgacggtccgccgtcggtcgggtaccctgacgtcgtacttcgtcgtcgcctcccgacgtcgtacggaacacgtacggtcctacctctacgacctacgtcgaaccgggccgaacgtcgtactagtcgacgtggacgtcgtacgttctacttcgtcggttacgacgggtccgtaaggggtcaacggtcgacgggttcgggttcggtcgggttaccggggacgggtacgggtacccgtacggttccggtaccggttacccggttagttaccgggaccttaccgggacccgtacgggtacccttccccggcccggttacggtcccgttacccg

SEQ ID NO: 256333 - DNA, 575 bp, Homo sapiens
  misc_feature: GYAE6OF02F14Q4.12.8.A08.1.454.CMB.1.raw
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
  modified_base (362)..(362): a, c, t, g, unknown or other
  misc_feature (362)..(362): n is a, c, g, or t
  modified_base (375)..(375): a, c, t, g, unknown or other
  misc_feature (375)..(375): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagacagccagcatcacctgctctgganatgtattgactaatgagtatgcttctggtatcagcagaaggcacggccacgcccctgtcctactcacttcttacaaactaccaggccgcccgtcgtcggggtccctggacgcgtattctcgtcggcctccgctcgtaggaacncgacgtccactcncgaccatcgacgccggacccaggtctagttgagtggacgtctcgtaccttacgtacgtcgtacgacgggtcggtcgggacgacggcgagggtcggttgggttcggtccggggacgggacgggaccgtaggtccgtcggtaccgttcgttacggtccgacggacccgacggtcccgtcccgcccccgttacggtcctaccg

SEQ ID NO: 256334 - DNA, 882 bp, Homo sapiens
  misc_feature: GYAE6OF02J3RA7.12.8.A08.1.454.CMB.1.raw
  modified_base (128)..(128): a, c, t, g, unknown or other
  misc_feature (128)..(128): n is a, c, g, or t
tcagatacgacgtacacgaccggtgctcgatttagcatactctacaggggctgggcctcaggaggcagcatcggaggtgcctcagccatggcatggactccctctcttcctcggcgtccttgcttacngcacagaactccagtcggcctctatgagttcactcacgcccacctcatcgtccgtccgaccccggatcggaccacgcctagccacttccgaccgtgtaccttcggtaggaactcgttagttaacgtttacgaaccgttaaagttggtaacgttcgtaccggttccgtttacggttacggttaactcggaaccggacggtaagggtaaccggtacccgaccccgggtacccctacccccgttccccggttacgttaccccgttaaccttacgttaacctttaaccccgtttaaacgaaaaccccggttccggggacccgggttcccccggtaccccgggtttacgggggttaccccggggttacccggcgggtttaacccggtaccggtttaccctttacccgggttaccgggtacccggttcccgtaaccccgggttaccgtttaaccggggtaaaccgtaaaccgttaaccgtaccgttacccggtaaccttttcccggtaaaccggacccgttacggtacccggggaccgggtaaccccggtacccttaagggtccttaagggttacgacgggttacgtaacgtccgtttacgaaccgttacgtccgtggacccgggttaggcgggtaaccgtcgtacggtcggtacggttcggggtacttcgggacgggactaccggtacgcgttaccggtaccgtcgtagtaccggccgaccgtacgtccggcctacccggtcccgtgttaccctcccgg

SEQ ID NO: 256335 - DNA, 619 bp, Homo sapiens
  misc_feature: GYAE6OF02FYZA9.12.8.A08.1.454.CMB.1.raw
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtccccccggacagacagccagcatccacctgctctggagatgtattgactaatgagtatgcttctgtatcagcgagaggcaggccacgccccctgtcctactcattcttacaaaactaccgaggccgtcccgtcgtcggggtccctggacgcgtattcctcgtcggcctccggactcgtacgggaactacgtacgtccaacctcgtacgaacctacgtaccgacggacccggggaacccgtacggtccttaagttacgagtacgggaacggttccgtaggttccttacgtaccgttggtacgacgggtcgggtacgggacgtacgcgaggtcgggttggtgggttcggacggggacggtaccgacggtcgtcggtaccgttacggttacggtccgaccgaccggtacggtccgtcccggtccccgtccggtcctacccg

SEQ ID NO: 256336 - DNA, 704 bp, Homo sapiens
  misc_feature: GYAE6OF02FQG63.12.8.A08.1.454.CMB.1.raw
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatccacctgctctggagatgtattgactaatgagtatgcttctggtatcagcaggaaggcaggccacgccccctgtcctactcacttcttacaaaactccgaggtccgcccttcgtcggggtccctggacgcgtacttctcgtcggcctcccgacgttccgtagggaaccacgtacgtcctaacctctacggaacctacgtaccgaccgggtaccccggggaaccccgagggtccctttaagttacgggacgttacgggaacgggttccgttcggtttacccttaaccgttacgttcggtccggaacggggttcgggtacggggaacctacggacgtacgggttcgggttcggggtcggtttccgggggacgggtaacgggtaccgaggttcccggtccgggtaacccgttttacggttaacgggtacccgaacccgggtaccccggtaaccgggtcccgttacccccgggtccccccgttacgggttaccccttaaccccgg

SEQ ID NO: 256337 - DNA, 784 bp, Homo sapiens
  misc_feature: GYAE6OF02IBRHE.12.8.A08.1.454.CMB.1.raw
  modified_base (105)..(105): a, c, t, g, unknown or other
  misc_feature (105)..(105): n is a, c, g, or t
  modified_base (192)..(192): a, c, t, g, unknown or other
  misc_feature (192)..(192): n is a, c, g, or t
tcagatacgacgtacacgaccggtgctcgatttagcatactctacaggggctgggcctcagggaggcagcatcgggaggtgcctcagccatggcatggatccctntcttcctcggcgtccttgcttactgcacagatccatgcctcctatgagttgactcagcccaccctccatcgtccgtcgtccccgganacgacagcccagcatcactgctgtggatatgtattgactaagtgatatacgtcttcgtggatcagcgaagagcacggccacgcccctgtcctctacacttcttaacaaacgtcccgagggcccgcccttacggtccggggttacccgtgacggtcgtacgttcgtcgtcggtacctacccgttaacgtccggtcgggtaaaacctaccgtaaccggttccaaccgttccgtaacgaaccgtagtacccggacggtaacccgggtacccgtaacggttaccgttaacgttacgtaacggttcggtaacgggttacttaccggtttaaccttaaccgttaccggttacggtaacccgggtcggggttaccgggtaccggggttaacgtaccggtaccggggtaacgggtttacggggtcggggtttaacggtcccggggggtaacggtaacccggggaccggttaacggttaccggtaacccggggttaccggtttaccggttaacgggtacccctaccgggtaaaccccgggaccggttacccgggttacccccggttacccccggttttaccggaccccgttttacccccgg

SEQ ID NO: 256338 - DNA, 680 bp, Homo sapiens
  misc_feature: GYAE6OF02HO22Z.12.8.A08.1.454.CMB.1.raw
  modified_base (221)..(221): a, c, t, g, unknown or other
  misc_feature (221)..(221): n is a, c, g, or t
  modified_base (252)..(252): a, c, t, g, unknown or other
  misc_feature (252)..(252): n is a, c, g, or t
  modified_base (287)..(287): a, c, t, g, unknown or other
  misc_feature (287)..(287): n is a, c, g, or t
tcagatacgacgtacacgaccggtgctcgatttagcatactctacaggggctgggcctcaggaggcagcatcggaggtgcctcagccatggcatggatccctctcctttcctcggcgtccttgcttactgcacagaatccatcggcctcctatgagttgactcagccctaccctccatcgtccgtcgtcccccggacagacacgccagtcatcactgcctnggacgatgtattgactaatgagtatgcttcnggtatcagcagagcagccacgtcccctgtcctacnacttctttacaaaacgtccaggccgtcctcgtacgggtcccagtacgctagttctctggcctacgacgtcgtagggaacacgaacgttcaacctttctagtaacccagtcccgacggggacccgtaaccccgagggttccttaaagttcggacttgggacggtaccctttagtacccttaacgtaaccttggtacgaccggtgggtaccgggacctaaggctacgggtccgggtttaggtcggttaccggggaacgggttacccggggacctttacgggttacgacccgggttaaccgggttccttaaacggggttacccgaaccggtaacccccggtaacggggtcccgtttccccgggaacccccccgtttccggggttattaaccccccg

SEQ ID NO: 256339 - DNA, 647 bp, Homo sapiens
  misc_feature: GYAE6OF02IVZPV.12.8.A08.1.454.CMB.1.raw
  modified_base (218)..(218): a, c, t, g, unknown or other
  misc_feature (218)..(218): n is a, c, g, or t
  modified_base (222)..(222): a, c, t, g, unknown or other
  misc_feature (222)..(222): n is a, c, g, or t
tcagatacgacgtacacgaccggtgctcgatttagcatactctacaggggctgggcctcaggaggcagcatcggaggtgcctcagccatggcatggatccctctcttccctcggcgtccttgcttactgcacagaatccatggccctctatgagttgactcagcccaccctcgatgtcccgtgtccccccggaagacacgccagcatcacctgctcgngganatgtattgactaatgagtatgtccttccgtggtatcgagcgaagaggcaggccacgcccctgtcctactcattctttaacaaactccgacggccgacctcggtcggtccctgacgctatctcgtcgcctcgtactcggtacgaacacgtcgtacaacctcgtacgacctacgtccgacggtccgggacccgtacgacgttagttacgtagtacggtacggtccgttaggttcttaaccgttacgttccggtacggtacgggtcggttacgggaacggtacgaccggtacgttcgggttcgggttcgggttcggggaccggtaccgggtaccgtacggttccgtaccggttaccggttcggttaacggtccggtaccggtacccggaacgggtccctacccggtcccccgttacgtcccgtccccg

SEQ ID NO: 256340 - DNA, 666 bp, Homo sapiens
  misc_feature: GYAE6OF02IDWNE.12.8.A08.1.454.CMB.1.raw
  modified_base (193)..(193): a, c, t, g, unknown or other
  misc_feature (193)..(193): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacagccagcatcacctgctctggagatgtattgactaatgatatgcttcctggtatcgagacgaagaacggcaggcccacgtccccctctaccgtactcacttctttaacaaactaccgacggaccggcccttcgtacggggtccctggacgcgtacttctcgtacggtctccgtactcgtacgggaacctacgacgtaccacttcacgtaccacgtccgaacgggacccggggaaccccgaggtaccgttagttaacggagtacgggacggtacgttcgttaccgtaccttaaccgtcgtaccggtacgggtcggttacggggacgaacgtcgaagggtccgttgggtcggttaccgggagggaccgggtaccgtaggttccgtcggtaaccggttcggttacggttaccgaaccggtaccccgggtaacgccggttacccggacccccggttacggcccttaaccccgg

SEQ ID NO: 256341 - DNA, 598 bp, Homo sapiens
  misc_feature: GYAE6OF02FIBDN.12.8.A08.1.454.CMB.1.raw
  modified_base (224)..(224): a, c, t, g, unknown or other
  misc_feature (224)..(224): n is a, c, g, or t
  modified_base (254)..(254): a, c, t, g, unknown or other
  misc_feature (254)..(254): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtcccgtgtccccccggacacgacacgcccagccatccacctgctctgganatgtattgactaatgagtatgcttctgtancagcagaagcaggccacgcccctgtcctactcattcttacaaatccaggccgtccctcgtcggggtcctggacgcgtattcgtctggcctccgactcgtagggaaccacgtagtccactcgtacgaccctatccgacggacccgggtaacccctagggtcttaacgttcgacgttgacggtctcggttacctactacgtcgtaccgagggtccggtacgggacacggtacgtaggtccggtgggttcggttcgggaccgggtacgggaccaggttccgtacggtacccgttcgtaacggtccgacggcccgaacggtccctccggcccccgtcggtcctacccg

SEQ ID NO: 256342 - DNA, 543 bp, Homo sapiens
  misc_feature: GYAE6OF02FM3AQ.12.8.A08.1.454.CMB.1.raw
  modified_base (218)..(218): a, c, t, g, unknown or other
  misc_feature (218)..(218): n is a, c, g, or t
  modified_base (402)..(402): a, c, t, g, unknown or other
  misc_feature (402)..(402): n is a, c, g, or t
  modified_base (422)..(422): a, c, t, g, unknown or other
  misc_feature (422)..(422): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagcccaccctccatgtccgtgtcccccggacagacagccagcatcacctgctctgganatgtattgactaatgagtatgcttcctggtatcagcagaaggcaggccacgccccctgtccctactcatctttacaaatccaggccgtcctcgtcgggggtccctgacgcgtattctctggcctccgatcgtaggaacacgagtccactctcgaccatcgagccgggacccaggctagtgatgnggctgtcttactatgtacgnggcgtagggcagcgagtgtgggtcgtcggggacggtacgggcgtacggtcgtcggtaccgttacggttacgccgtacgcccgaaggtcccgtcccggacccccggttccggtactaccccg

SEQ ID NO: 256343 - DNA, 609 bp, Homo sapiens
  misc_feature: GYAE6OF02HD5XR.12.8.A08.1.454.CMB.1.raw
  modified_base (196)..(196): a, c, t, g, unknown or other
  misc_feature (196)..(196): n is a, c, g, or t
  modified_base (460)..(460): a, c, t, g, unknown or other
  misc_feature (460)..(460): n is a, c, g, or t
  modified_base (489)..(489): a, c, t, g, unknown or other
  misc_feature (489)..(489): n is a, c, g, or t
tcagatacgacgtacacgaccggtgctcgatttagcatactctacagggggctgggcctcaggaggcagcatcggaggtgcctcagccatggcatggatccctctcttcctcggcgtccttgcttactgcacagaatccatggcctcctatgagttgactcagcccaccctccatcgtcccgtcgtccccccgganagacagccagcatccacctgcctcgtggagatgtaattgaactaatgagtatgcttccgtggtatcgagcaggaaggcaggcccacgccccccttgtcccctactcctacttacctttaaccaaaaactcccgaacgggtccccggtccccttcggtcgggggtccctggacgtcgtcttctcgtgcctcgactcggtacggaactacgagtccacttcacgaccactcgacggccgggacccgtaggccttagtcgagtcggnggtcgtcgttcctacgttccgtgtacggnggtcggtagggcaggcgagtcgggttggtcggtccgggagggaccggaccgtcggtccggtcgtaccggtcgttacgccgacggtcccggacggtccgtcccgtcccgtccgtcctaccg

SEQ ID NO: 256344 - DNA, 761 bp, Homo sapiens
  misc_feature: GYAE6OF02GV17B.12.8.A08.1.454.CMB.1.raw
  modified_base (191)..(191): a, c, t, g, unknown or other
  misc_feature (191)..(191): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagcccaccctccatgtccgtgtcccccgganagacagccagcatcacctgctcgtggagatgtattgaactaatgagtatgtccttcctggtactcgagtacaggaaggcgacggtcccaccgtcccccccgtgttacccctacctcctacttaccgtttaaccaaaaaccgtacccgtaacggggcccggtacccccgttaccggtccccgggggttaccccgttacggacggtccgtaacgttttccctcgttccgggtcccgtacccgtaccgtccggtacgggaacccgtacgtaccgtcctaaccgttccgtacgtaccctacgtaccggaccgggaccccggggtaacccgacggtcttagttaggtagtacggtacggtcgttcgttaacccgttacgttaaccgttcggtaaccgggacgggtaccgggtcggggaacctaggccggtaccgggtggtttacggggttcgggttacggggacggggtacgggtaccgtacggttccgtccggttaacccggttcggttaccggaccggacccgaccggtacggtcccgttaccccgcccccgggttccgtacccttaccccgg

SEQ ID NO: 256345 - DNA, 557 bp, Homo sapiens
  misc_feature: GYAE6OF02F98ZL.12.8.A08.1.454.CMB.1.raw
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtccccccggacagacagccagcatccacctgctctggagatgtattgactaatgagtatgcttcctggtatcagcagaaggcaggccacgccccctgtcctactcatctttacaaaataccaggccggccctcgtcggggtccctgagcgattctctggcctccgactcgtaggggaaccacgagtctacctctcgaccatcgacgccgggacccaggctattgatgaggtctgtactactacgtgtcgagggtcgtagggacgagcgaggtcggtggttggttccgggcgggacgggacctacggtcgtcggtacccgttcggttaggtaccgacggcccgaaggtccgtcccggcccccgttcggtccctacccg

SEQ ID NO: 256346 - DNA, 707 bp, Homo sapiens
  misc_feature: GYAE6OF02HBLAJ.12.8.A08.1.454.CMB.1.raw
  modified_base (155)..(155): a, c, t, g, unknown or other
  misc_feature (155)..(155): n is a, c, g, or t
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctctatgagttnactcacgccaccctccatcgtccgtcgtcccccgganacgacagccagcatccactgctctgganatgtattgactaatgagtatcgtcttcgtgtactcagcaaggaacggcacggccgaccgcccccgttgtaccctactctacttcttaacaaaactccgacggcccgtccgtacggtccggggtccctaggacgtacgtacttccgtcgtacggtcctacccgacgttcggtacggaacctacgtacgtacctactacgtacgacctacgtacgacggacccgggaccgtacggtacgttaacgtagtacgtaggtcgttacgttacgttaccgttacgttacgtcggtaccgtacgggtaccgggtacgggaaccgtacgggaccgtagggtcggttacggggttacggtaccggggtacggggaacggtaccggtacggtccggttacgggttaaccggttaccggttacggtacgtaacccgggtaccgaaccggggttccccgttaccccgggtcccccgggttacccgttaccgttaccccgg

SEQ ID NO: 256347 - DNA, 673 bp, Homo sapiens
  misc_feature: GYAE6OF02G203I.12.8.A08.1.454.CMB.1.raw
  modified_base (497)..(497): a, c, t, g, unknown or other
  misc_feature (497)..(497): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagcccaccctccatcgtcccgtgtccccccggacagacagccagcatccacctgctctggagatgtattgactaatgagtatgcttcctggtatcagcagagcacggccacgccccctgtcctactcacttctttacaaaactccgacggccgccctcgtacggggtccctggacgccgtattcctcgtcggcctcccgactcgtacgggaaccacgacgtcctactctacggacctagtccgacgggtcccgggaacccgtacggtacctagttacggatcgggacggtcttacggttacctaccgttacgtcgtcggacgggtccggtagggacnggcctagggtccggttagggttcggttaccggggcgggtaaccggggtaccgtacgggttccggttaccggtaacccggtttacggttaaccgggtaccgtaaccgggtacccccggtaaacgggttccccgttaccccgggtaccccccgtttccgggtacccctttaaccccgg

SEQ ID NO: 256348 - DNA, 781 bp, Homo sapiens
  misc_feature: GYAE6OF02FZ588.12.8.A08.1.454.CMB.1.raw
tcagatacgacgtacacgaccggtgctcgatttagcatactctacaggggctgggcctcaggaggcagcatcggaggtgcctcagccatggcatggatccctctcttcctcggcgtccttgcttactgcacaggttccgtggcctcgtatgacctgactcagcccaccctctgtgtccgtgtccccaggacagacagtcacaatctcatgctcgtagggactatcgtacgtagggttaaggggttaaagtttcgtcgtttacgtaggtactacgagtacaagaacgccgacgaccaccgtcccgtgttcgttcgtactacttacgtaagtaaggtactacggacggaacgggtcccggtaccccgtacgggaacggggttaccttacccggtaggaacggttaccggttacctttacccgggcccgggtacccttaaccccgtaaccggtcccgggaaacctaaaccgaaccgaccgtacccgtaccgtacgtacccgaacctacgtacccgaaccggggtaccccggaacccgtcggtacctaccgtacgtacgtacggacgtcgtacgtaactacgttcgacgaccggtacgggcggtacggacgtccgtccctaccggttaccctttaccgtttacgttcccggttcggttaaccggggtacgggtaccggtaccgtcgttaccgggttacccgaaccggttccgttaacgggcccttaacccggaaccctaacccggtaaaccccgtacccgtaccgttaccgtacccttaccccgg

SEQ ID NO: 256349 - DNA, 567 bp, Homo sapiens
  misc_feature: GYAE6OF02GF3N5.12.8.A08.1.454.CMB.1.raw
  modified_base (190)..(190): a, c, t, g, unknown or other
  misc_feature (190)..(190): n is a, c, g, or t
  modified_base (216)..(216): a, c, t, g, unknown or other
  misc_feature (216)..(216): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccagcatcactgctctgganatgtattgactaatgagtatgcttcctggtatcagcagaaggcaggccacgccccctggtccctactcgattcttacaaaactccaggtccgccctcgtcggggtccctgagcgattctcgtgctccgactcgtacgggaacacagtcacctctacgaccatcgaggccgggaccaggtctatgatggacggtctgtctactacgtcgtacgagggtccgtgggacgacgcgacggtcggttaggtcggttcgggcgggagggtaccgagttcgtacggtacccgttacgttacggtcgaaccggtacccgtaaggtcccgttacccggcccccttacggtccctacccgg

SEQ ID NO: 256350 - DNA, 678 bp, Homo sapiens
  misc_feature: GYAE6OF02G9K9Q.12.8.A08.1.454.CMB.1.raw
  modified_base (193)..(193): a, c, t, g, unknown or other
  misc_feature (193)..(193): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacagccagcatccacctgcctcgtggagtattgtattgactaatgagtatgtcttcgtggtatcgagcaaggaggcacggccaccgcccctgtacctactcctacttacctttaacaaaacgtccgacggtcccggtcccgttcggtccggggtccctgacgtcgtacttcgtcgtcggtcctccgtacgtcgtacgggaacacgtagtcctacgtctacgaaccgcgtaccgaacgggccccgggaacctacggtacttagttagacggtacgggtacgttccgttacgttaccctacgttaccgtcggtacggtaccgggtacgggtacgggaaccgtcggaccgtcgggttcggggttcgggtacgggttacggggacggggaccggtacgtacggttccggtacgttaccggttacggtacggtcccgacggacccggtacggtcccctccccggtccccggttacgtcccttacccgg

SEQ ID NO: 256351 - DNA, 587 bp, Homo sapiens
  misc_feature: GYAE6OF02IE7R3.12.8.A08.1.454.CMB.1.raw
  modified_base (132)..(132): a, c, t, g, unknown or other
  misc_feature (132)..(132): n is a, c, g, or t
  modified_base (217)..(217): a, c, t, g, unknown or other
  misc_feature (217)..(217): n is a, c, g, or t
  modified_base (254)..(254): a, c, t, g, unknown or other
  misc_feature (254)..(254): n is a, c, g, or t
  modified_base (283)..(283): a, c, t, g, unknown or other
  misc_feature (283)..(283): n is a, c, g, or t
  modified_base (430)..(430): a, c, t, g, unknown or other
  misc_feature (430)..(430): n is a, c, g, or t
  modified_base (450)..(450): a, c, t, g, unknown or other
  misc_feature (450)..(450): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacngaatccatggcctcctatgagttgactcagccaccctccatgtccgtgtcccccggacagacagccagcatcacctgctctgganatgtattgactaatgatatgcttcctggtactcgagnagaaggcaggcccagccccctgtcctacnctactcttacaaatccaggtccgcctcgtcggggtccctgacgcgtacttctcgtcggctccggactcgtacggaacacgagtcctactctgaccagtccgagcgggacccaggctatcgatgaggtctcgttacttactactcgcncgggacggttacgggaccgnggtaccgaggtccggtttgggtcggttcgggaccgggaaccgggtacgtaccggtcgttcggtaaccggttctttaaccgggacttaaccggcccgtaacgggtcccgtccggcccccgttccgggtcttaaccccg

SEQ ID NO: 256352 - DNA, 590 bp, Homo sapiens
  misc_feature: GYAE6OF02GN0W5.12.8.A08.1.454.CMB.1.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatcgtccgtgtcccccgganagacagccagcatcacctgctctgganatgtattgactaatgagtatgcttcctggtatcagcagagcaggccacgcccctgtcctactcattctttacaaaactccaggccgccctcgtcggggtccctggacgcgtattctcgtggcctccgactcgtacgggaacacgcgtcactcgtcgaccatcgacgccgggaccaggtctagtgatggaggtctcgtacttacgtacgtcggtacgacgggtcggtagggaaccgaggccgtaggtcgggttcggtcgggttccggggacggggtacgggaccgtaggtcccgtagggtacccgttacggttacggaccgtacggaccccgtaacgggtccctaccggtccccccgttacggtcctacccgg

SEQ ID NO: 256353 - DNA, 776 bp, Homo sapiens
  misc_feature: GYAE6OF02GV5UQ.12.8.A08.1.454.CMB.1.raw
  modified_base (189)..(189): a, c, t, g, unknown or other
  misc_feature (189)..(189): n is a, c, g, or t
  modified_base (288)..(288): a, c, t, g, unknown or other
  misc_feature (288)..(288): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctcatgtccgtgtcccccggangacagccagcatcacctgctctggagatgtattgactaatgagtatgcttcctggtatgagcagaagcaggccacgcccctgtccctactcattcttanaaaatccaggccgccctcgtcggggtaccctgacgtaccgtagtttcctcgttcgggaccttaccggtacctaccgttaaggggaaacctaaaccgtaggttcccaaaccttccgtacgtaacccaacgttacgaaccgggaccccggggtaaaaccccgaggggtacctttaacgtttagggaacgttaccggtaagggtcccgtttaagttaacccgttaacgttaacccttagggtccgtaacgggggtaccggtttaagggggaaccctaaggtcccgggaagggtttaaccgggttcggggtttccggttttacggggggaccgggggaaccggtaacccggtaacggtttccgtaacccgggtaaacccccggttttgggttaacccgggttaaccgtaaaccgggaacccccgttaaaagggggtcccccgtttaaccccgggtcccccccggttttacgggacccccgtttaacccccgg

SEQ ID NO: 256354 - DNA, 717 bp, Homo sapiens
  misc_feature: GYAE6OF02H3GDI.12.8.A08.1.454.CMB.1.raw
  modified_base (265)..(265): a, c, t, g, unknown or other
  misc_feature (265)..(265): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagcccaccctcctatcgtcccgtcggcccccggacagacagccagcaatccacctgctctggagtatgttattcgactaagtgaagtagtcgtcttccgtaggtntcagcgaaggaaggcgacggacccaccgtccccccttcgtacccttacctacctactttacgtttaaacaaaacgtaccggaacggtccccggacccgttcggtccgggggttccctaggacggtcgtacgttccgtccgttcggtccgttccgtaccgttaccggtacggggaacctacgtacggtacctccgtaacgtaccggaactacctcggtaccgggaacccgggacccgaaggttccttaagtcgaggtacggtcgtccttaggttaccctaattaccgtgttacggcgggttaccggtacggggtacacgacggtacggtggttgggtcgggtacggggaaccgggtacggtacggtacggttcggtacgggtaccgttacggttacggacccgaacggtaccggacggtccccgacccggtccccggtacgtccgttaccccg

SEQ ID NO: 256355 - DNA, 698 bp, Homo sapiens
  misc_feature: GYAE6OF02HJUS7.12.8.A08.1.454.CMB.1.raw
  modified_base (222)..(222): a, c, t, g, unknown or other
  misc_feature (222)..(222): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcacgcccaccctcatcgtccgtcgtcccccggaacgacagccagcatcacctgctcgtggatntgtatgactaatgatatcgtcttctggtactcgagacgaaggacggcgacggccaccgtcccccgtgtaccccgttactacctacttaccgtttaaccaaaacgtacccgacgggtcccggtcccttcggtccggggtccctggacgtctacgttcctacgtcgtaccgtcccgacgtcggtacgggaacctcgacgttaccgaccttaccgacgaacctacgtaccggacgggaccccgggtaaccaacggttcgttacgttaggacgtacggacggtctttacggtccttaacctcgttcgggtacggtacgggtcggttacgggacgacggcggtacggttcgggttcgggttcgggtccgggacggggttaccgggaccgttaggttccgtcgggttaaccggttcgttacggaaccggtacgtaccccggtacggtccgtaccccggtaccccggttccgtacccgttccg

SEQ ID NO: 256356 - DNA, 629 bp, Homo sapiens
  misc_feature: GYAE6OF02FOS3D.12.8.A08.1.454.CMB.1.raw
  modified_base (218)..(218): a, c, t, g, unknown or other
  misc_feature (218)..(218): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtcccgtgtcccccggacagacagccagcatcacctgctctgganatgtattgactaatgagtatgccttcctggtatcagcagaggcaggccacgccccctgtccctactcattcctttacaaaattcccgaggccgtccctcggtcggggtccctggacgcgtacttcctcgtcggcctccgtactcgtaggggaaaccacgtagtccactctacgacccagtaccgacggccgggaccccaggtcctagttgagtggaggtccttagtccttaacctcgtgtaccgacgggtcgtacgggacacggacgaggtcggttgggttcggttcggggacgggtacgggaccgtacggttccgtaaccgggtaccggttaccgttaacgggtccctaaccgggaccccgaacgggttccccgtacccggtccccccggtttcggtacccttaacccgg

SEQ ID NO: 256357 - DNA, 702 bp, Homo sapiens
  misc_feature: GYAE6OF02HI04Z.12.8.A08.1.454.CMB.1.raw
  modified_base (195)..(195): a, c, t, g, unknown or other
  misc_feature (195)..(195): n is a, c, g, or t
  modified_base (273)..(273): a, c, t, g, unknown or other
  misc_feature (273)..(273): n is a, c, g, or t
  modified_base (276)..(276): a, c, t, g, unknown or other
  misc_feature (276)..(276): n is a, c, g, or t
  modified_base (381)..(381): a, c, t, g, unknown or other
  misc_feature (381)..(381): n is a, c, g, or t
tcagatacgacgtacacgaccggtgctcgatttagcatactctacaggggctgggcctcaggaggcagcatcggaggtgcctcagccatggcatggatccctctcttcctcggcgtccttgccttactgcacagaatccatggccctctatgagttgactcagccctaccctcattcgtccgtcgtcccccgganagaccacgccagcactaccaccttgccttcgtaggagtatgttattcgaatatgtattatcgcttccgtgtataccgnganaacggaaggtcgacggacccgccgtccccccgttatcccttacctctacgttacctttacgaaaaacttcccggaggaccccgttcgttaccggtcggttccccnggtacgtacttccttacgtcgttccggctacccgttaacgtcgaacggtaaaactcgaagtttccaacgtttaccctcggaacctaacgttccgaaccggtacccggggtaacccaggtccgttaagttagaccggtaggtaaccggttcgttcgtaaccttaacgtacgtcgttaccgagggttccggtaggacctagtcgaggtccggtttagggtcgcggggaacggtacgccggttaagccggttaccgcgttacggtaacccgtgtaacccgacccggtgtcccgtaccccggtacccgtttccggttacacccgg

SEQ ID NO: 256358 - DNA, 699 bp, Homo sapiens
  misc_feature: GYAE6OF02GT1N1.12.8.A08.1.454.CMB.1.raw
  modified_base (192)..(192): a, c, t, g, unknown or other
  misc_feature (192)..(192): n is a, c, g, or t
  modified_base (197)..(197): a, c, t, g, unknown or other
  misc_feature (197)..(197): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagcccaccctccatcgtccgtgtcccccgganagacngccagcactcacctgcctctggatatgtatgactaatgatatgtccttctggtatcagcaaggaggcacggccaccgcccctgtccctactccattccttacaaatcccgaggccgtccctcggtccggggtccctggacgtcgtacttcctcgtacggcttcccgacttcggacgggaaacctacgacgtaccacgttacctacgacccgtacgtccgacgggacccgggtacccgtagggtaccttaagttggacgtaggtacggtccgttaggttacccgttacgttacgttacggaccggtacgggtccggttacgggaccgtaacggtcgtacgggttcgggtttagggttcccgggttacgggggaccggtaaccggggtacccgtacggtccggttaccgggtacccggtttacggttaccgggtaccgtacccggtacccggtaacgggtccccgttacccgggtaccccccgttccgggtacccttaccccgg

SEQ ID NO: 256359 - DNA, 590 bp, Homo sapiens
  misc_feature: GYAE6OF02I5ODB.12.8.A08.1.454.CMB.1.raw
  modified_base (182)..(182): a, c, t, g, unknown or other
  misc_feature (182)..(182): n is a, c, g, or t
  modified_base (192)..(192): a, c, t, g, unknown or other
  misc_feature (192)..(192): n is a, c, g, or t
  modified_base (198)..(198): a, c, t, g, unknown or other
  misc_feature (198)..(198): n is a, c, g, or t
  modified_base (275)..(275): a, c, t, g, unknown or other
  misc_feature (275)..(275): n is a, c, g, or t
  modified_base (291)..(291): a, c, t, g, unknown or other
  misc_feature (291)..(291): n is a, c, g, or t
  modified_base (300)..(300): a, c, t, g, unknown or other
  misc_feature (300)..(300): n is a, c, g, or t
  modified_base (354)..(354): a, c, t, g, unknown or other
  misc_feature (354)..(354): n is a, c, g, or t
  modified_base (402)..(402): a, c, t, g, unknown or other
  misc_feature (402)..(402): n is a, c, g, or t
  modified_base (482)..(482): a, c, t, g, unknown or other
  misc_feature (482)..(482): n is a, c, g, or t
  modified_base (568)..(568): a, c, t, g, unknown or other
  misc_feature (568)..(568): n is a, c, g, or t
tcagatacgacgtacacgaccggtgctcgatttagcatactctacaggggctgggcctcaggaggcagcatcggaggtgcctcagcccatggcatggatccctctcttcctcggcgtccttgccttactgcacagaactccatcggccttcctatgagttgactcagccaccctcatgtccncgtccccganagaccngccagcatcacctgcctatcggagactgtaacttgactaatgagtatcgtcttcgtggtaatccgaagcagaacggntaggcccacgcccctntcccgtacnctacttcctttacgaaacctccgaacggtccgtcccgtcgttaccggggtcccngtacgcctagtccgtgcgtctaccgatcgtacggacacgtacgtaccncgttcacgtacaacgtacgacggaccggacccgagtaccgtagttcgacgtcgacgtacgtcctacgtatcgttcggacngggtacgtcggagcgatggtcgtaggtcgtaacgggcgaacggtctacgtacggtcgaccttggacgttcgaccgccgtggacccnccggttacccgccgttactccg

SEQ ID NO: 256360 - DNA, 702 bp, Homo sapiens
  misc_feature: GYAE6OF02F4KAN.12.8.A08.1.454.CMB.1.raw
  modified_base (196)..(196): a, c, t, g, unknown or other
  misc_feature (196)..(196): n is a, c, g, or t
  modified_base (230)..(230): a, c, t, g, unknown or other
  misc_feature (230)..(230): n is a, c, g, or t
tcagatacgacgtacacgaccggtgctcgatttagcatactctacaggggctgggcctcaggaggcagcatcgggaggtgcctcagccatggcatggactccctctcttcctcggcgtccttgcttactgcacagaatccatcggcctcctatgagttgactcagcccaccctccatcgtccgtcgtcccccgganacgacagccagcactccacctcgtctcgtggatnttgtattcgaactatcggattactgtccttcgtggtactcgacgacgaaggacggcgacggcccaccgccccgttcgtccctacctcttacttaccgtttaacaaaaacgtcccggtacgggtccccgttaccccgttcggggttcccgggggttacccctaggggtaccggtaccggttcttccgggtaccgtaccgggtcccgtacggtactaacgggtacggactaccgacgtactaccgtcgtacgacctacgaccgtacgggacccggtacgacgttctacgttgagtacgcggtagtccttcgtacctcgtaggtcgtcgggcgtagggcccaggtcgaggtcggttaggtcggttcgggacgggtacgccgtaacgtcggtacccggtttatacccggttacggtacaacccggcccgggtaccggtacccggttcccggtcccccttcgggtaccttaccccgg

SEQ ID NO: 256361 - DNA, 748 bp, Homo sapiens
  misc_feature: GYAE6OF02HXVBK.12.8.A08.1.454.CMB.1.raw
  modified_base (214)..(214): a, c, t, g, unknown or other
  misc_feature (214)..(214): n is a, c, g, or t
tcagatacgacgtacacgaccggtgctcgatttagcatactctacaggggctgggcctcaggaggcagcatcggaggtgcctcagccatggcatggactccctctcttcctcggcgtccttgcttactgcacagaactccagtcggcctcctatgacgttgactcacgtccaccctctagtcgtccgtccgtccccggacacgacacgccgacnctactccacctcgtcctcgtacggagtatagttacgtaggtaactaagtggtaattcgtcggttaccttaccgtaggtactacgaacgacggaaggaaccgggtaccgacgacccgacccgtccccgtttacgtaccttacgtactacgttaccttaaccaaacgtccggacggcccgtacgtcggtcggtaccgagcgtactcgttcgtccgtcggaccttccgacggtacgtacgaacctcacgtctactcggtacaccgtcgacggaccgggaccgtaacgacggttactacggtacgtacgtacggtacgttaccgttctaaccgttaccgtaacggtccgtaacgggcggttaccggacgtaacggccgtaacgggtagtttccggggtacggttccgggtaaccggggtaccggtaccggtaaccgggttcgaccgggttaaccggtaacccggtttgttaacccggaccggtccggttaaccggccggttaaccgtccccggttccgttaccgggacgtttaccccg

SEQ ID NO: 256362 - DNA, 696 bp, Homo sapiens
  misc_feature: GYAE6OF02GW9L4.12.8.A08.1.454.CMB.1.raw
  modified_base (190)..(190): a, c, t, g, unknown or other
  misc_feature (190)..(190): n is a, c, g, or t
  modified_base (218)..(218): a, c, t, g, unknown or other
  misc_feature (218)..(218): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctcatgtccgtcgtcccccgganagacagccagcatcacctgctcgtgganatgtattgactaatgagtatgcttcgtggtatcgagcgaaggacggcgaggcccacgtccccctgtacccgtactcctacttaccttaacaaaaactcccgaacgggtcccgtaccccgttcggtccgggggtcccttaggacggtacgtacgttccgtcgtcgggtccttacccggacttcggtacgggaacccacgtacggtacctaccgttccgtaccgaaccctacgtaccgaacgggacccgggtaacccgtaagggtccttacgttacggtagtacggaggtaccttacggttacctaccgttacgtcgtacgggtacggtccgggtaggacgaacggcggtaaggttcgggttcgggttacggtacgggacgggaccgggtaccgtggtccgtacggtaccggttcggttaaccggtcgacccggacccgtacgggtccctacccgggtacccgttcggtccctaacccgg

SEQ ID NO: 256363 - DNA, 942 bp, Homo sapiens
  misc_feature: GYAE6OF02IOUYF.12.8.A08.1.454.CMB.1.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
tcagatacgacgtacacgaccggtgctcgatttagcatactctacaggggctgggcctcaggaggcagcatcggaggtgcctcagccatggcatggactccctctcttccgtcggctccttgcttactgacacagtaactccatcggccttcctatgtagttgactcacgcccaccctcatcgtccgtcgtccccganacgacncgccagctactccaccgttgaccttcgtagggacgtagttggttaacttgaaacttaagttcggaagtacttcggacctttcggtacggtataccgaggtaccgtaggaaccggtcgaccggtaccccgacccgtccccgttacgttacccttacctctaaccgttttccttaaactaaacccgtccggaccggtccccggttacccgtttccgggttcccgggtaccgttagggaccgttacgttcttcccggtccgtaccgggtccctacccggttaccgttacggtaaacccgggtaaaccctacgggtaccgttacccgtaacgtttacccgtaacccgtaaccgttacgaaccggtacccggggtaacccgggtaacccgtacgggtttacgtaaccggttacggttaacgtacgggttaacggttccgttttaacccggtttaccttaaccgggttaaccgttacgggtaaccgggtacggggttacccgggtttaaacgggggacccgtacggggttaaaccgggttaccgggtttccgggggtttaaccgggttacccggggtttaaccggggggaaccggggttaaccgggttacccgggtaacgggttcccgggttaaaccgggtttacccggtttaacccggtttccggaaccggtaccccggttaccgggtaacccgtttccccgggtacccccggtcccgtttacccgggtaccctttccccggg

SEQ ID NO: 256364 - DNA, 691 bp, Homo sapiens
  misc_feature: GYAE6OF02FP2CK.12.8.A08.1.454.CMB.1.raw
  modified_base (384)..(384): a, c, t, g, unknown or other
  misc_feature (384)..(384): n is a, c, g, or t
tcagatacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagcccaccctccatcgtcccgtcgtccccccggacagacacgccagccaactccgacctcgctcgtggagtatgtattgactaagtgagtatgcttctggtatcagcaaggagcgaggccacgtcccctgtcctactctatcttacaaatcgacgtccgaccgtcgtccgggtcctgcgtcgtagttcctcgtcgcctccgtctcgtacggactacgcgtaccnctcgagtacctacgcgacgggcccggtaccgacggttactacgttacggagtcggtaacgtcgttaccgttacgttaccgtcgttaggtccggtacgggtacgggtaggaccgacggtcgtaacggggtttcgggtccgggttaggggttacccggggacggtaaccgggggtacccgttaacgggttccgggttacccgggttaaaccgtttcccgggtttaaaccgggccgtaacccggggtacccggtaaccgggttccccgttaccccggtaaccccccggtttcggaaccgtttcccccggg

SEQ ID NO: 256365 - DNA, 166 bp, Homo sapiens
  misc_feature: GYAE6OF01A0BCK.3.55.E11.1.454.CMB.1.raw
  modified_base (156)..(166): a, c, t, g, unknown or other
  misc_feature (156)..(166): n is a, c, g, or t
tcagagacgcactccacgaccggtgctcgatttagcactcgcacgttggttggctgaccaaggtcaccgtcctaggtcagcccaaggccaaccccactgtcactctgttcccaccctctcgagtgcgtctctgagcgggctggcaaggcgcatagnnnnnnnnnnn

SEQ ID NO: 256366 - DNA, 162 bp, Homo sapiens
  misc_feature: GYAE6OF01DSOHG.3.55.E11.1.454.CMB.1.raw
  modified_base (159)..(162): a, c, t, g, unknown or other
  misc_feature (159)..(162): n is a, c, g, or t
tcagagacgcactccacgaccggtgctcgatttagcactcgcacgttgggtttggactgaccaaggtcaccgtcctaggtcagcccaaggccaacccactgtcactctgttcccaccctcctcgagtgcgtctctgagcgggctggcaaggcgcatagnnnn

SEQ ID NO: 256367 - DNA, 199 bp, Homo sapiens
  misc_feature: GYAE6OF01DSYKS.3.55.E11.1.454.CMB.1.raw
  modified_base (162)..(199): a, c, t, g, unknown or other
  misc_feature (162)..(199): n is a, c, g, or t
tcagagacgcactccacgaccggtgctcgatttagcactcgcacgttgggttgggctgaccaaggtcaccgtcctaggtcagcccaaggccaaccccatgtcactctgttcccaccctcctcgagtgcgtctctgagccgggctaggccaaggcgacatagnnnnnnnnnnnnnnnnnnnnnnnnnnnnnnnnnnnnnn

SEQ ID NO: 256368 - DNA, 163 bp, Homo sapiens
  misc_feature: GYAE6OF01BW024.3.55.E11.1.454.CMB.1.raw
  modified_base (160)..(163): a, c, t, g, unknown or other
  misc_feature (160)..(163): n is a, c, g, or t
tcagagacgcactccacgaccggtgctcgatttagcactcgcacgttgggtttgggctgaccaaggtcaccgtcctaggtcagcccaaggccaaccccactgtcactctgttcccgccctctcgagtgcgtctctgaggcgggctggcaaggcgcatagnnnn

SEQ ID NO: 256369 - DNA, 163 bp, Homo sapiens
  misc_feature: GYAE6OF01BUVBP.3.55.E11.1.454.CMB.1.raw
  modified_base (160)..(163): a, c, t, g, unknown or other
  misc_feature (160)..(163): n is a, c, g, or t
tcagagacgcactccacgaccggtgctcgatttagcactcgcacgttgggtttgggctgaccaaggtcaccgtcctaggtcagcccaaggccaaccccactgtcactctgttcccaccctcctcgagtgcgtctctgagcgggctggcaaggcgcatagnnnn

SEQ ID NO: 256370 - DNA, 161 bp, Homo sapiens
  misc_feature: GYAE6OF01EV1E8.3.55.E11.1.454.CMB.1.raw
tcagagacgcactccacgaccggtgctcgatttagcactcgcacgttgggtttggactgaccaaggtcacccgtcctaggtcagcccaaggccaaccccactgtcactctgttcccaccctcctcgagtgccgtctctgagcgggctggcaaggcgcatag

SEQ ID NO: 256371 - DNA, 174 bp, Homo sapiens
  misc_feature: GYAE6OF01AZL9F.3.55.E11.1.454.CMB.1.raw
  modified_base (151)..(151): a, c, t, g, unknown or other
  misc_feature (151)..(151): n is a, c, g, or t
  modified_base (157)..(174): a, c, t, g, unknown or other
  misc_feature (157)..(174): n is a, c, g, or t
tcagagacgcactccacgaccggtgctcgatttagcactcgcacgttgggtttgggctgaccaaggtcaccgtcctaggtcagcccaaggccaaccccactgtcactctgttcccacctctcgagtgcgtctctgagcggctggcaaggcncatagnnnnnnnnnnnnnnnnnn

SEQ ID NO: 256372 - DNA, 164 bp, Homo sapiens
  misc_feature: GYAE6OF02HYBX2.3.55.E11.1.454.CMB.1.raw
  modified_base (160)..(164): a, c, t, g, unknown or other
  misc_feature (160)..(164): n is a, c, g, or t
tcagagacgcactccacgaccggtgctcgatttagcactcgcacgttgggtttggactgaccaaggtcaccgtcctaggtcagcccaaggccaaccccactgtcactctgttcccaccctcctcgagtgcgtctctgagcgggctggcaaggcgcatagnnnnn

SEQ ID NO: 256373 - DNA, 161 bp, Homo sapiens
  misc_feature: GYAE6OF02G59IG.3.55.E11.1.454.CMB.1.raw
  modified_base (160)..(161): a, c, t, g, unknown or other
  misc_feature (160)..(161): n is a, c, g, or t
tcagagacgcactccacgaccggtgctcgatttagcactcgcacgttgggtttgggctgaccaaggtcaccgtcctaggtcagcccaaggccaaccccactgtcactctgttcccgccctcctcgagtgcgtctctgagcgggctggcaaggcgcatagnn

SEQ ID NO: 256374 - DNA, 161 bp, Homo sapiens; identical to SEQ ID NO: 256373
  misc_feature: GYAE6OF02FI96N.3.55.E11.1.454.CMB.1.raw
  modified_base (160)..(161): a, c, t, g, unknown or other
  misc_feature (160)..(161): n is a, c, g, or t

SEQ ID NO: 256375 - DNA, 161 bp, Homo sapiens; identical to SEQ ID NO: 256373
  misc_feature: GYAE6OF02HWNWH.3.55.E11.1.454.CMB.1.raw
  modified_base (160)..(161): a, c, t, g, unknown or other
  misc_feature (160)..(161): n is a, c, g, or t

SEQ ID NO: 256376 - DNA, 596 bp, Homo sapiens
  misc_feature: GYAE6OF01BPXC8.8.43.D10.1.454.CMB.1.raw
  modified_base (317)..(317): a, c, t, g, unknown or other
  misc_feature (317)..(317): n is a, c, g, or t
tcagctcgcgtgtccacgaccggtgctcgatttagactagcagtaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtagtccagcctgggaggtcacagagactctcctgtgcagcctctgggttcaccttcagtagctacggcatgcactcgggtccaccaaactccgaggcaaggggtnttgggagtgggtggctagtttgttcatcgtggaggcaggttgtacaagttggtatgcgtgacgtccgtagaacggctattcacactctcagacgacactcaaggaacacaatgtattcgactagaacagacctaagtcctaggacggacgtacgggttatactaacgtacgtacggtaacggaacggggacgggggaaccacgggtacgggtaacgttaccgtaacgttaccgtaccgttacggtacgtacggtacggggcctaagggtccccgtacgg

SEQ ID NO: 256377 - DNA, 680 bp, Homo sapiens
  misc_feature: GYAE6OF01BXM2Z.8.43.D10.1.454.CMB.1.raw
  modified_base (299)..(299): a, c, t, g, unknown or other
  misc_feature (299)..(299): n is a, c, g, or t
tcagctcgcgtgtccacgaccggtgctcgatttagactagcagtaaggggggagaggagcccagcactagaagtcggcggtgtttccattcggtgatcagcactgaacacagaggactcaccatggagtttgggctgagcttgggttttcctcgttgctcttttaagaggtgtccagtgtcaagtgcagttggtggagtcgtgggggaggcgtggtccagccgtggggaggtccctgagactctcctgtgcagcctctggattccaccttcagtagctatgacatgcacgtgggtcccnccgaggcctccgaggcgaagggtctggaggtgggtgctagtttatatcaatatgagtagggaaggttaatacgaaattactagtcgactaaggtaccttccgggtaggaacggggccgtattaccaaccctaattcccgtacccgaaggaacgtaaacctaaacgttacccaaaaggtaacctaacgtactaccgttaactactaacgaacctaaaagtacgaaaccaggtaccccgtaaggaaacggaaccgtagggaacggaacgtaccgggtacgtttaggttacggttacgttttaccggaggggttaaacgggggaaaacgggtcttaaggtaccgggtaaagtagggttaacggaaaaccgttacgtaaacccgg

SEQ ID NO: 256378 - DNA, 688 bp, Homo sapiens
  misc_feature: GYAE6OF01CTZVG.8.43.D10.1.454.CMB.1.raw
  modified_base (275)..(275): a, c, t, g, unknown or other
  misc_feature (275)..(275): n is a, c, g, or t
  modified_base (355)..(355): a, c, t, g, unknown or other
  misc_feature (355)..(355): n is a, c, g, or t
  modified_base (390)..(390): a, c, t, g, unknown or other
  misc_feature (390)..(390): n is a, c, g, or t
tcagctcgcgtgtccacgaccggtgctcgatttagactagcagtaagggggggagaggagcccagcactagaagtcggcggtgtttccattcggtgatcagcactgaacacagaggactcaccatggagtttgggctgagctgggttttcctcgttgcttcttttaagaggtgtccagtgtcaagtgcaggttggtggagtcgtgggggaggcgtggtccagccgtggggacggtccctgacgacctctcctgtgcagcctctggattcaccttnagtgctatgacatgactacgtcgggtcccgccgacgggcctccgaggacgtaagggtcgtgggagtgggtggctatttanatcattagtgaagtgggaagttaatagaatactancgacacggtaccgtaccgagggaacgggtacccgtaacttaccgaacctattacccgtacccgaagtaaacgtaacctaacttaacccgaaagaaacccaaccgtacttaccttaactcgtaacgtaactaaaacgtacggaaaccgtaccgtaccgttaagaaacggtaacgtgggtaaaccgggaccgtaacgggtccgtttaggtaggttttaacgtttcggttagggtaaggggggaaacggtaactaggttacgaaacgggttaggtaaccgggtaaaccgttcggtaaaccg

SEQ ID NO: 256379 - DNA, 644 bp, Homo sapiens
  misc_feature: GYAE6OF01CYCOR.8.43.D10.1.454.CMB.1.raw
  modified_base (289)..(289): a, c, t, g, unknown or other
  misc_feature (289)..(289): n is a, c, g, or t
  modified_base (324)..(324): a, c, t, g, unknown or other
  misc_feature (324)..(324): n is a, c, g, or t
  modified_base (373)..(373): a, c, t, g, unknown or other
  misc_feature (373)..(373): n is a, c, g, or t
  modified_base (394)..(394): a, c, t, g, unknown or other
  misc_feature (394)..(394): n is a, c, g, or t
  modified_base (405)..(405): a, c, t, g, unknown or other
  misc_feature (405)..(405): n is a, c, g, or t
  modified_base (473)..(473): a, c, t, g, unknown or other
  misc_feature (473)..(473): n is a, c, g, or t
  modified_base (507)..(507): a, c, t, g, unknown or other
  misc_feature (507)..(507): n is a, c, g, or t
  modified_base (544)..(544): a, c, t, g, unknown or other
  misc_feature (544)..(544): n is a, c, g, or t
tcagctcgcgtgtccacgaccggtgctcgatttagactagcagtaagggggggagaggagcccagcactagaagtcggcggtgtttccattcggtgatcagcactgaacacagagactcaccatggagtttgggctgagcttgggttttcctcgttgcttcttttaagaggttgtccagttgtcaagtgctaggttggtggagtcggtgggggagcggtggtccaggccgtggggacggtccctggacgtactctccgtgtcgcacgcctcgtggatttccacccgttnagtagtctatcgacagtcgctacgtcggggtcccncgaggtcctccgaggtcgaagggtctagggaggtgggtgacttatttanatcatatgagttggaagttanagtaatactangacagtactaccggaggaacggcctattaccgacctatcctcgaagacaacttactaccaaagaaccncgtattactatcgtacgaactaaagacgaaccgntaccgagtaagtaaccgtggaacggaactaccgggtntttaaggtcgttaagttttcgggaaggggttaacggggaaacgggtacttaagttacgggtaaacgtaggggtaacggtaaaccctaaggttaaacccgg

SEQ ID NO: 256380 - DNA, 805 bp, Homo sapiens
  misc_feature: GYAE6OF01ER7DJ.8.43.D10.1.454.CMB.1.raw
tcagctcgcgtgtccacgaccggtgctcgatttagactagcagtaagggggggagaggagcccagcactagaagtcggcggtgtttccattcggtgatcagcactgaacacagaggactcaccatggagtttgggctgagcttgggttttcctcgttgcttcttttaagaggtgtccagtgtcaagtgcagttggtggagtcgtgggggaggcgtggtccagccgtgggacgtccctgagtactctccgtgtcgcacgcctcgtggtacttccaccttcaagtacgacttaatcgaactatcggacctacgttcggggtcccgccacgggtccctacccggagggaccgtaaggggttccgtaggggtagggttcgggggtacgactttaagtttttaaaggacttaccgtaaagtttaaggtggtaaagtttacgggggtaaaggttaaagtacggtaaaaactttaccgtaagtacgaaccgtaaggtacccgtttaccggggtaaggaaaccggggtacccttaacgtttaccccaacctacgtttaccccgaacgtaaacgaacgtaaacctaaacttaacccgaaaacgtaaacccacgttaacttacgttaactcctaacggaaactaaacgtacggtaaacctaacgggttccgaaacggtaaacgtaacggtaacggaacggtaccgtaacggttcgttaaggttacgtttacggtttagggtaaggggtaaacgggggtaaacgtagttaacggtaggtaaacccgtaagggtaaccggtaaattaccgtaaacgg

SEQ ID NO: 256381 - DNA, 807 bp, Homo sapiens
  misc_feature: GYAE6OF01C1YHA.8.43.D10.1.454.CMB.1.raw
  modified_base (147)..(147): a, c, t, g, unknown or other
  misc_feature (147)..(147): n is a, c, g, or t
tcagctcgcgtgtccacgaccggtgctcgatttagactagcagtaaggggggagaggagcccagcactagaagtcggcgtgtttccatcggtgatcagcactgaacacagagactcaccatggagtttggctgagcttggttttccngttgcttcttttaaggaggtgtccagttgtacaagtgactaactggtaggagtcgtgggggagtcgtagtccagtccgtgggacgtcaagagacgtacctcgtccgtgtcgactacgcctttcgttacgggttacctacccgtttacgaacggttaccgtaccgtaacgggctaacgttcggaccgtaaccggtcggtaccccgtaacccgtaaaccgtacccgaagggtacgaaacgggtaggtttagggaggttgggtacggtacgttaaggtttcgtttacgaacgtttcggtagggaacgggtacgttaggtttaccggttaaccgtaagtttacggggttactaccgggttccgtaccgggtacccgtaaccgggtttaacgggaaaccgggtccctaacgttaccaccggtaactaccgtaccgaagtaacccgtaaccgtaacgtaccgaaacgtaaaccgtataacggttattaccgtacgtaacgtacgaacgtacgtacgttacgtacgaggtcgtaaccggtacgtagttaacgtacgtaacggtcggtaaacgggaagggaacgggtaaccgcggtacgggtaacttaaccggtaacgtcccggtttcgtaacggtccggtaggtccgggtacccgtagggttacccg

SEQ ID NO: 256382 - DNA, 811 bp, Homo sapiens
  misc_feature: GYAE6OF01A6JTS.8.43.D10.1.454.CMB.1.raw
  modified_base (328)..(328): a, c, t, g, unknown or other
  misc_feature (328)..(328): n is a, c, g, or t
tcagctcgcgtgtccacgaccggtgctcgatttagactagcagtaagggggggagaggagcccagcactagaagtcggcggtgtttccattcggtgatcagcactgaacacagaggactcaccatggagtttggctgagcgttgggttttcctcgttgcttcttttaagaggtgtccagtgtcaagtgctagttggtggagtcgtgggggagcgtgtccagccgtgggacgtccctgagacctctcctgtcgctacgccttcgtggtacttcctaccttcgaagttacgcttagtacgactagtcgacctaccggtcggggtaccccnccgacgggtccctacccggaggggtacccggtaaagggggtttccgtagggggttacggttcgggggtacggtacctttaagtttttaacgtacgttaccttaaacgtttaggtagggtaaggttagggtaaaggtttaaattacggtaaacgtttacgttacgtaccggtaactaacggtacccgttaccgggtaagggtaaccggggtccctttaacgttaccccaacccgttacgttaccccaaacggtaaacgtaaacgtaacctaaaccgtttaccgaaaacggaccttaccgtattacctacgtcctaaggaactaacgtaccaacgtacgtccgaagacgtaacgtcggaacgtaccgaggttcttaacggtttgttaaccggtttggggaaacgggggttaaaccggggtaaaggtacctaaggtttacgggtaacgttaaacggggttacccggtaaaactttcccgggaaacg

SEQ ID NO: 256383 - DNA, 752 bp, Homo sapiens
  misc_feature: GYAE6OF02GBFVZ.8.43.D10.1.454.CMB.1.raw
  modified_base (327)..(327): a, c, t, g, unknown or other
  misc_feature (327)..(327): n is a, c, g, or t
tcagctcgcgtgtccacgaccggtgctcgatttagactagcagtaagggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggaggcgtggtccagcctgggaggtcacgagagactctcgtgtgcagcctcgtgggttccaccttcgagtaacctacggactagtgccacgttgggtcccaccaagcctccgaggcaagggnttggaggttggggtggccgtaggtttcgtttacagttcgtaggagggctaggttcgtttacaaagttcgggtaatcgactaacgtaccgttcccggtagggaaccggggtccctaagttcccaaccgtacttcccgtaccgaacggtaaccgtaacctaaaccgttacccgaaacgggtaaaccaaacgtaagttacggtttaacgtttagggaacgtacgtaacggaaaccgtacgtacccgtaacggttacccgtagggaacggtaaccggtacgggtaccgttaaacgtacgttaaccgttaggaacgggtaacggggaacgggggaacccggtaagggtaccggggtaacgtttaccggtaaggttaccgtttaccggttacggtaccggttcggtaccgggggtacccgttaaccggggg

SEQ ID NO: 256384 - DNA, 638 bp, Homo sapiens
  misc_feature: GYAE6OF02JFI2Y.8.43.D10.1.454.CMB.1.raw
  modified_base (301)..(301): a, c, t, g, unknown or other
  misc_feature (301)..(301): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
tcagctcgcgtgtccacgaccggtgctcgatttagactagcagtaagggggggagaggagcccagcactagaagtcggcggtgtttccattcggtgatcagcactgaacacagaggactcaccatggagtttgggctgagctgggttttcctcgttgctcttttaagaggtgtccagtgtcaagtgcagttggtggagtcgtgggggaggcgtggtccagccgtgggacggtccctgagactctcctgtgcagcctgtggattccaccttcagtagctatcgacatgctacgtgggtcccnccaggcctccgagggccgaagggttctgggaggtggggtgctagtttanatcatntgactgggagtaatgaattactagtgacacgacgttaccggtagaacgggaccgtaattcccaacgtactcctacgagtaacaacgtaacttaccgaaagaaccacgtactactacgttctaagactaaaagtacgaacgtcgtaaccgtacgtaacgtaagtcggaacgaccgtaacggtcgttacggttaggtttaactttacgggtaacgggttaacggggaaacgggtagttaacgtacggttaaacgtgggttaaaccggtaacttacccgtaacgg

SEQ ID NO: 256385 - DNA, 635 bp, Homo sapiens
  misc_feature: GYAE6OF02HLMG5.8.43.D10.1.454.CMB.1.raw
  modified_base (150)..(150): a, c, t, g, unknown or other
  misc_feature (150)..(150): n is a, c, g, or t
  modified_base (251)..(251): a, c, t, g, unknown or other
  misc_feature (251)..(251): n is a, c, g, or t
  modified_base (294)..(294): a, c, t, g, unknown or other
  misc_feature (294)..(294): n is a, c, g, or t
  modified_base (335)..(335): a, c, t, g, unknown or other
  misc_feature (335)..(335): n is a, c, g, or t
tcagctcgcgtgtccacgaccggtgctcgatttagactagcagtaaggggggagaggagcccagcactagaagtcggcggtgtttccattcggtgatcagcactgaacacagaggactcaccatggatttgggctgagctgggttttccncgttgctcttttaagaggtgtccagtgtcaagtgcagttggtggagtctgggggagcgtggtccagcctgggaggtccctgagactctcctgtgcagcctntggattcacctttcagtagctaatgacatgcacgtcgggtccnccaggcctccgaggcaagggtctggagtgggtgctatttantcatatgatggagtaatgaatactagtgacaagtacctccggtaggaaacgggcctaatttccaaccgtactccgtacccgaaggaacgaacctaaacgttacccgaaagtaaccaacgtactaccgtatacgtagaacctaaagtcgaaaccgcgtacccgttaagaacgtaacgtaggaacgggtacgaccgggtattacgggtttacgttttaacgtttccggtaggggtaacggggtaaacggggtactacggttacggtaacggtaagggtacggggtaaccttaccgtaaccgg

SEQ ID NO: 256386 - DNA, 788 bp, Homo sapiens
  misc_feature: GYAE6OF02F6QHC.8.43.D10.1.454.CMB.1.raw
  modified_base (199)..(199): a, c, t, g, unknown or other
  misc_feature (199)..(199): n is a, c, g, or t
  modified_base (304)..(304): a, c, t, g, unknown or other
  misc_feature (304)..(304): n is a, c, g, or t
tcagctcgcgtgtccacgaccggtgctcgatttagactagcagtaaggggggagaggagcccagcactagaagtcggcggtgtttccattcggtgatcagcactgaacacagaggactcaccatggagtttggctgagctggttttcctcgttgcttcttttaagaggtgtccagtgtcaagtgcagttggtgagtcgnggggagcgtggtccagccgtgggacgtccctgacgactcctcctgtcgcagcctgtaggtcttccaccttcagtacgactatgacagtgactacggtcggtcccnccgacggtccgtaccgaggaccgtaagggtcgtgggtacggtgggtacgtacgttagttttacacgttacagttagagtaaggttacggaaggttaataacgtaacgttactaagttacggacctaacggtacccgtccgggtaagggtaccggtcccgttaacgtttaccccgaccgttaccttcccggtaacgaaacgttaacgtacccttaaacgttaacccggaaaaccgtaaccgtaccggtttaaactttacccttaagtacccgttaaccgtaaaccgtaaacgttaccgggaaaaccctcggtaacggttaacgggaaacctaccgttaaacgggacgttaacccgccggtttacgtacggttttaacggttttcggtaccgggttaaacggggtaacgggggtaaaccgttacccgttagggttaacccgtaaagggttaacggtaacccggttaaaccgtagttaaaccccggg

SEQ ID NO: 256387 - DNA, 780 bp, Homo sapiens
  misc_feature: GYAE6OF02HERMB.8.43.D10.1.454.CMB.1.raw
  modified_base (320)..(320): a, c, t, g, unknown or other
  misc_feature (320)..(320): n is a, c, g, or t
  modified_base (385)..(385): a, c, t, g, unknown or other
  misc_feature (385)..(385): n is a, c, g, or t
tcagctcgcgtgtccacgaccggtgctcgatttagactagcagtaagggggggagaggagcccagcactagaagtcggcggtgtttccattcggtgatcagcactgaacacagaggactcaccatggagtttgggctgagcttgggttttcctcgttgcttcttttaagaggtgtccagtgtcaagtgctaggttggtggaggtcgtggggggaggcgtggtccaggccgtggggacggtccctgagtactctcctggtcgcagcctcgtggtacttccaccttcaggtacgctagtgactatcgcacgttggggtcccnccgacgggtcctccgagggcgaacggggttctaggggaggttcggggtaggtacttaagttttanacgtactaagttagtaggagttagggtaaggttaaattagtaaacttacgttaagtcggaactaacggttacccggttccgggtaaggggtaaccggggcccgttaactttacccgaacccgttacgtttaccgtacccgaaagggtaaccaaaccttaacgttaacccgaaaacggtaaacctaccggttaatttaacccgtaataccgttaacgaaacgtaaaacgtaccgaaacgtacgtaccgtaaggaaacgtaaacgtaagggaacggtaaccgtacggtcgttaggttaacggttttacttacggggtaggggtaacgggggtaaacgggtactagggttaccggtaaacggttaggggttaaccggtaaccttaacccggttaacgg

SEQ ID NO: 256388 - DNA, 520 bp, Homo sapiens
  misc_feature: GYAE6OF01BFITM.17.41.D08.1.454.CMB.1.raw
  modified_base (249)..(249): a, c, t, g, unknown or other
  misc_feature (249)..(249): n is a, c, g, or t
tcagcgtagactagcacgaccggtgctcgatttagtcacgcgagaaagggaaaggggagagaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgttttaaaaacntttagcctggtaccaacagaagcctggccaggctcccaggctcctcatctatggtgcatccaccagggccacgtggcatcccagacaggttcagtggcggtgggtctgggacagaattcactctcaccatcaccagtctggacgcctagaagtatttgcttctgtatcactgtcagcaatatggtgtaccaccctcactttcggcggtagggccaagggtggagatcgagcgaacgtggtggctgcacatctgtcttcacttccttcccgc

SEQ ID NO: 256389 - DNA, 677 bp, Homo sapiens
  misc_feature: GYAE6OF01AWDIL.17.41.D08.1.454.CMB.1.raw
  modified_base (319)..(319): a, c, t, g, unknown or other
  misc_feature (319)..(319): n is a, c, g, or t
  modified_base (447)..(447): a, c, t, g, unknown or other
  misc_feature (447)..(447): n is a, c, g, or t
tcagcgtagactagcacgaccggtgctcgatttagtcacgcgagaaagggaaaggggagagaagagctgctcagttaggacccagagggaaccatggaaaccccagcgcagcttctcttcctcctgctactctggctcccagataccaccggagaaattgtgttgacgcagtctccaggcaccctgtccttgtctccgaggggaaacagcccaccctctcctgtaggccagtcaggtagttagtttttaaaaactatttacgcctaggtaccaacagaacgcctggccaggcctcccgaggcctcctcatctagtggtncactcccaccgacgggcccacgtcggaccactacccagaccgtaggttcaggttcgggcgggtgggtcgtgggactagtaacttcactctacaccatccactagtcgtaggacgtccgtagtaagttntttcgcttcgtgttactctacgtgtacagtactaagttagttcggtacgtacccctacccgttcgttaccgggttcgggacgggtacggggtacccgtaaggggttagggaacgtacgtaccggaaacggtaccggtaaacggttcgggtcggtaccgttacggaccctaaccgtacgttccgtttacgttaccctttaccgttacccgtttccccgttccccgtaaccg

SEQ ID NO: 256390 - DNA, 772 bp, Homo sapiens
  misc_feature: GYAE6OF01B8UBW.17.41.D08.1.454.CMB.1.raw
  modified_base (253)..(253): a, c, t, g, unknown or other
  misc_feature (253)..(253): n is a, c, g, or t
tcagcgtagactagcacgaccggtgctcgatttagtcacgcgagaaagggaaaggggagagaagagctgctcagttaggacccagagggaaccatggaaaccccagcgcagcttctcttcctcctgctactctggctcccagataccaccggagaaattgtgttgacgcagtctccaggcaccctgtccttgtctccgaggggaacagccaccctctcctgtagggccagtcagtagttagttttaaaaactntttagccttggtaccaacagaacgcctggccaggcctcccaggcctcctcatctagtggtgctatcccaccgagggcccacgtggaccacgtcccaggaacctagggttcagggttcgggcggttggggtcgtaggggaactaggtaaactttccgaccttcgtaccaccctactaccaccgtaggtccgttacgggacgtccgttaggtaaggttacgtttttacggtaccttacgttacgtttacttactaccgtttacggttcctaaggaccttaaagttacgtttacggggttaccggttaacccgtaccccctttaccgttaacccggttttaccggggccggggtaacgggggtacccggtaaaggggttacggggtacggtaaaccgtacggtaaacgggtacccggtaaacggttacgggtacggggtacccgttacgggtcccgtacccgtaacgttcccgtttacgttaccctttaccgtacccgtttccccgttcccccgtaaccccg

SEQ ID NO: 256391 - DNA, 853 bp, Homo sapiens
  misc_feature: GYAE6OF01AC9UF.17.41.D08.1.454.CMB.1.raw
  modified_base (204)..(204): a, c, t, g, unknown or other
  misc_feature (204)..(204): n is a, c, g, or t
  modified_base (212)..(212): a, c, t, g, unknown or other
  misc_feature (212)..(212): n is a, c, g, or t
  modified_base (249)..(249): a, c, t, g, unknown or other
  misc_feature (249)..(249): n is a, c, g, or t
tcagcgtagactagcacgaccggtgctcgatttagtcacgcgagaaagggaagggaggagaagagctgctcagttaggacccagagggaaccatggaaaccccagcgcagcttctcttcctcctgctactctggctcccagataccgaccggagaaatttgtgttgacgcagtctccaggcacctgtcctgtctccagggaacngccacctntcctgtaggcccagtcaggtagttagttttaaaaacngtttacgcctggtaacccaacaggaacgcccttggcccaagggtcctacccgaggtcctccctacgacttcgtaacgtgggtcgacctaacgttcccgaacccgtacgggccctaacgtgggaccctacgtccccgaagtaaccgtacggtttccgaacgttcggggcccggttaggggtacctagggggaaccctaagggtaacctttacccgacgtttccggacctaacccgtaagttccccgaaaccgtaacgggtttcctacggggtaacgtacccggttaggtaaacgttacggttttaacgtccgttaccgttacggtaacttcccgttaacgttacggtaccgtaacggtaccctaaaggtttacgttacggttaccgggtaaaccctacccccgttacgtttacccggttttacggggaccggggttaacggggtacccggttaagggtaccgggtaacggtaacccggtttaacgaaccgggtaaccgggttaaccgtttacggggtaacggttacccgttacggtaccgaaacccgttacgtaccgtttacgggttacctttaacccgtaccgttcccggttccccgtaacccg

SEQ ID NO: 256392 - DNA, 623 bp, Homo sapiens
  misc_feature: GYAE6OF02JQ0GF.17.41.D08.1.454.CMB.1.raw
  modified_base (208)..(208): a, c, t, g, unknown or other
  misc_feature (208)..(208): n is a, c, g, or t
  modified_base (255)..(255): a, c, t, g, unknown or other
  misc_feature (255)..(255): n is a, c, g, or t
tcagcgtagactagcacgaccggtgctcgatttagtcacgcgagaaagggaaaggggagagaagagctgctcagttaggacccagagggaaccatggaaaccccagcgcagcttctcttcctcctgctactctggctcccagataccaccggagaaattgtgttgacgcagtctccaggcaccctgtccttgtctccgaggggaaacngcccaccctctcctgtacgggccagtcagagttagttttaaaaactntttagcctaggtaccaacagaagcctggccaggcctccgaggcctcctcatctatggtgcactccaccagggccacgtggccactcccagactaggttcaggtcggcggtggtcgtggggacagtaacttcactctacacctatcacctagtctaggacgtccgtagtaagtacttttgacttctagttatctacgttagtctagtacaattagtggtcgtaacctccctacgtaccgtttcgggacggtacgggtaccgtagggttacggaggtacgtacgtaacggacgtaacgtacggtcggtacgtcggacctaccgtacgtcgttacggttaccttcgtaactttcccggttaccccgtaccg

SEQ ID NO: 256393 - DNA, 774 bp, Homo sapiens
  misc_feature: GYAE6OF02I01AD.17.41.D08.1.454.CMB.1.raw
  modified_base (254)..(254): a, c, t, g, unknown or other
  misc_feature (254)..(254): n is a, c, g, or t
tcagcgtagactagcacgaccggtgctcgatttagtcacgcgagaaagggaaaggggaggagaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtacgggccagtcagagtcgttttaaaaaactntttacgccttggttacccaaaactagaaacgccttggacccaagggccttaccccagggtccttcctacgacttctaacttggcggtcaacttcccgaccaggggtacccacgtggccaacttccccgaagtaccaagggtttccaaggttcgggcggtcgggtctacggggacctaggaaactttccaacctcgttacaaccgattacccgaaccaaggttccttagggaaccgtcccgtacggttaaacgtaagttttttcgaccgtttccgtttgggtaactttccgaaaccgtttcggtaccgttaaggaccttaaagttaccgttaggggtttacgtaaccggaaccccccctttggaaccctttttccggggaccggggtaacggggtaccccgtaaagggtccgggtaaagtaaccgttacgaagtaccggtaaactgggttcggtacctaggcctaacccgtaagtttccgcggtttcccgttacctaaacgtttcccgtccccggtaaccc

SEQ ID NO: 256394 - DNA, 536 bp, Homo sapiens
  misc_feature: GYAE6OF02FSIAX.17.41.D08.1.454.CMB.1.raw
  modified_base (247)..(247): a, c, t, g, unknown or other
  misc_feature (247)..(247): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
tcagcgtagactagcacgaccggtgctcgatttagtcacgcgagaaagggaaaggggagagaagagctgctcagttaggacccagagggaaccatggaaaccccagcgcagcttctcttcctcctgctactctggctcccagataccaccggagaaattgtgttgacgcagtctccaggcaccctgtccttgtctccaggggaacagccacctctcctgtagggccagtcagagtgttttaaaaacntttagcctggtaccaacagaagcctggccaggctcccaggctcctnatctatggtncatccacagggccactggcatcccagacaggttcagtggcggtgggtctgggacagtattcgactctcaccatccaccagtcctggacgcctgaagtattttgctctgtactctactgtcagctaatagtgtcgtaccaccctctacgtttcgggcggtagggtaccgaagggtggagacgtacgaagcgaacgtggtggctgcactagtcgtgtcttcacttcctcccgtcc

SEQ ID NO: 256395 - DNA, 530 bp, Homo sapiens
  misc_feature: GYAE6OF02IJK5E.17.41.D08.1.454.CMB.1.raw
  modified_base (267)..(267): a, c, t, g, unknown or other
  misc_feature (267)..(267): n is a, c, g, or t
  modified_base (306)..(306): a, c, t, g, unknown or other
  misc_feature (306)..(306): n is a, c, g, or t
  modified_base (338)..(338): a, c, t, g, unknown or other
  misc_feature (338)..(338): n is a, c, g, or t
  modified_base (392)..(392): a, c, t, g, unknown or other
  misc_feature (392)..(392): n is a, c, g, or t
tcagcgtagactagcacgaccggtgctcgatttagtcacgcgagaaagggaaaggggagagaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtaggccagtcagagtgtttttaaaaaacatttagcctggtaccaanagaagcctggccaggctcccaggctcctcatctatggtncatccaccaggggccactggacatcccagacnggttcagtggcggtggtctgggacagaatcactctcaccatcaccagtctggancctgaagattttgctctgtatcactgtcagacaatatgtggtaccacccctctacgtttcggacggtaggggaccaaggtggaagacgtacgaagacgaactggtggctgcaccatctgtcttacactccttcccgcc

SEQ ID NO: 256396 - DNA, 594 bp, Homo sapiens
  misc_feature: GYAE6OF02FK8LN.17.41.D08.1.454.CMB.1.raw
  modified_base (207)..(207): a, c, t, g, unknown or other
  misc_feature (207)..(207): n is a, c, g, or t
  modified_base (251)..(251): a, c, t, g, unknown or other
  misc_feature (251)..(251): n is a, c, g, or t
  modified_base (343)..(343): a, c, t, g, unknown or other
  misc_feature (343)..(343): n is a, c, g, or t
  modified_base (400)..(400): a, c, t, g, unknown or other
  misc_feature (400)..(400): n is a, c, g, or t
  modified_base (420)..(420): a, c, t, g, unknown or other
  misc_feature (420)..(420): n is a, c, g, or t
tcagcgtagactagcacgaccggtgctcgatttagtcacgcgagaaagggaaaggggagagaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacngccaccctctcctgtagggccagtcagagttgtttttaaaaacntttagcctaggtaccaacagaagcctggccaggctcccaggcctcctcatctatggtgcaatccaccgagggcccactggcactcccagacnggttcagtggcggtggtctgggacagattcactctcaccatcaaccagtctaggacnccgtagaagtattttgcttnttgtatcactgtcacgactaagtagtgggttacgtaccctaccccttcgtaccgtttcgggacgggtacggggtaccgtaagggtcggaagtactacgaacgtacgaacgtacggtcggacctcggacctacgtacgtccttcgttccttaccgtcttcccgttaccccgtacc

SEQ ID NO: 256397 - DNA, 718 bp, Homo sapiens
  misc_feature: GYAE6OF02JOW0E.17.41.D08.1.454.CMB.1.raw
  modified_base (211)..(211): a, c, t, g, unknown or other
  misc_feature (211)..(211): n is a, c, g, or t
  modified_base (258)..(258): a, c, t, g, unknown or other
  misc_feature (258)..(258): n is a, c, g, or t
  modified_base (287)..(287): a, c, t, g, unknown or other
  misc_feature (287)..(287): n is a, c, g, or t
tcagcgtagactagcacgaccggtgctcgatttagtcacgcgagaaagggaaaggggagagaagagctgctcagttaggacccagagggaaccatggaaaccccagcgcagcttctcttcctcctgctactctggctcccagactaccaccggagtaaacttgtgttgacgcagtctccaggcaccctgtccttgtctccgaggggaaacngccaccctctcctgtacgggccagtccagagttcgttttaaaaaacntttacgccctaggtaaccaacaggaaacnccgtaggccaaggtccttccccgaagggtcctccctacaattccctaagtgggtcgtaccaacttcccaccgaagggtcccagtcgggacacttcccgagactaagggttccaggtcgggcgtgggtcctaggggaaccaggtaacgttccaacttcgtcgaacctatccaccgtagttcgtacggacgtaccgtagtaaacgttgttttacgccttacgttacgtaactctaacgtgttacgactactagttcgtacggttacgtaccctacctacttacccggtttcgggaccgggttaccgggtacggtaacgggttcggaacgtaacgtacgtaacgtaccggtaacgttccggtacggtacctacgggaaccctaccgtaagtttccgtcgttacgtttaccgacccgtttcctaaccccggttcg

SEQ ID NO: 256398 - DNA, 531 bp, Homo sapiens
  misc_feature: GYAE6OF01BV9RV.13.35.D02.1.454.CMB.1.raw
  modified_base (278)..(278): a, c, t, g, unknown or other
  misc_feature (278)..(278): n is a, c, g, or t
  modified_base (443)..(443): a, c, t, g, unknown or other
  misc_feature (443)..(443): n is a, c, g, or t
  modified_base (448)..(448): a, c, t, g, unknown or other
  misc_feature (448)..(448): n is a, c, g, or t
  modified_base (502)..(502): a, c, t, g, unknown or other
  misc_feature (502)..(502): n is a, c, g, or t
tcagtcacgtactacacgaccggtgctcgatttagcacacgatagttgggtttgggggggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtctgggggagtttggtacagccagggcggtccctgagactctcctgtataacttctggattcaacttgggtnattatgctatgaactgggtccgccaggctccgagggaaggggctgggagtggggtaggtttcagtttagggagcaattctcatgatgggacaacagaatacgccgcgtcaggtaaaagcagattcaccatctacaagagatgagtccagaagcatccgcctttcngcagntgagtagcctggaacgaccgaggacacgagccatcctattacctgtgctagagngtatgcagtcctacgactgctgtcggggg

SEQ ID NO: 256399 - DNA, 803 bp, Homo sapiens
  misc_feature: GYAE6OF01D7APU.13.35.D02.1.454.CMB.1.raw
  modified_base (282)..(282): a, c, t, g, unknown or other
  misc_feature (282)..(282): n is a, c, g, or t
  modified_base (309)..(309): a, c, t, g, unknown or other
  misc_feature (309)..(309): n is a, c, g, or t
tcagtcacgtactacacgaccggtgctcgatttagcacacgatagttgggtttgggggggagaggagccccagccgtgagattcccaggagtttccacttggtgatcagcactgaacacagaccaccaaccatggagtttgggcttacttgggttttccttgttgcttattttaaaaggtgtccaatgtgagctgcagctggtggagtcgtgggggagtttggtacaggccagggccgtccctgagactctcctgtataacttctggattcaacgttgggtntattatgacttatagaacgtgggtccnccgaggcctaccgagggggaacggggtctaggggaggttaggggttaggtttcgaagttagggacgtactaaatttcctactaagttggaagtacggggaaacctaaaaccgaaggtaaacgttacccggacccggtacgtttaccgttaaagggttaaaaacgggctaaacggtaacttttacccaaacccgttacgttacctaacgaaaggacgtaagttaacggacgttaacccgaaggaaacgccgtaacgttcccgttacccttttcgacgaccgtaagtacgtaggtaacggtaccggaccgttaagggaaaccggtaaccccggggaagtaaccgaacccgtaacgtacccctaagtttaccgttaaacgtttacggttaggttacgtacgttaaggggtaacgtaagtttacgttacggaacccgttaccggttacccgttaaccggtacccgtttacgggtaccggttaggggttcccggggggg

SEQ ID NO: 256400 - DNA, 697 bp, Homo sapiens
  misc_feature: GYAE6OF01A6JYN.13.35.D02.1.454.CMB.1.raw
tcagtcacgtactacacgaccggtgctcgatttagcacacgatagttgggtttgggggggagaggagccccagccgtgagattcccaggagtttccacttggtgatcagcactgaacacagacccaccaaccatggagtttgggcttacttgggttttccttgttgctattttaaaaggtgtccaatgtgagctgcagctggtggagtcgtgggggtaggtttggtacagccgagggccggtccctgagactctcctgtactacttctggattcaacgtttgggtgtattatgctatgaacgtgggtccgccgaggcctaccggaggggaggggcgtgggaggttggggttaggtttcgagtttaggagtctaagttctactatgagtagggaacaaacagaacgtaccgccgtcgtacgtaggtaaaacggctaagtattaccacctatactacgaagtagagtagacgtaccgaagaacgctacttccgtaccgtttcacgaccgtagtacgtaggtacggtaacgtccgtaacggaaacggacccggaacgggtaacccacggaactacctacgttaccttaacgtttacgtcggtaacgtacggtaaggtaaggtaacgttacgttacggaccgttaaccggttacccgtaacccggtaccgtacggttcccggttaggggttacccgggggg

SEQ ID NO: 256401 - DNA, 794 bp, Homo sapiens
  misc_feature: GYAE6OF01BK7TT.13.35.D02.1.454.CMB.1.raw
  modified_base (283)..(283): a, c, t, g, unknown or other
  misc_feature (283)..(283): n is a, c, g, or t
tcagtcacgtactacacgaccggtgctcgatttagcacacgatagttgggtttgggggggagaggagccccagccgtgagattcccaggagtttccacttggtgatcagcactgaacacagacccaccaaccatggagtttgggcttacttgggttttccttgttgctattttaaaaggtgtccaatgtgagctgcagctggtggagtcgtgggggagtttggtacagcgagggcggtccctgagactctcctgtactaacttctggacttcaacttggggtntattatgacttatgactgggtccgcaggctcgaggggaagggctgggagttggggtagtttcgagttaggagtctaattctacgtatggaagtcgggaacaaacgaagaacgtaccggccgtacgttacgtaacggtaaaaggtcaagtacttaccgacctaacttctacaaggtagaacgtaggaacggtaccaaaggaacggtacctaacggttcccgtccccgtttttcgtacggacccgtaaggtaacgtttacggtaacgggttaccgtaccggttaacgggaaaccgggaacccgggtacggggaaccctaaaccgtaccggtaacccttaaacggtttccttaaacggttttacccgtttacgggttaccgggttaaccggttaaagggttaggggttaacgtttacggttaaccgggttacccgttaaccccggttaacccgggttaacccggttaaccccggttggttacccgggggttaacggggggtttccccggggggg

SEQ ID NO: 256402 - DNA, 662 bp, Homo sapiens
  misc_feature: GYAE6OF01A9F6Z.13.35.D02.1.454.CMB.1.raw
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
  modified_base (499)..(499): a, c, t, g, unknown or other
  misc_feature (499)..(499): n is a, c, g, or t
  modified_base (507)..(507): a, c, t, g, unknown or other
  misc_feature (507)..(507): n is a, c, g, or t
tcagtcacgtactacacgaccggtgctcgatttagcacacgatagttgggtttgggggggagaggagccccagccgtgagattcccaggagtttccacttggtgatcagcactgaacacagaccaccaaccatggagttttgggcttacttgggttttccttgttgctattttaaaaggtgtccaatgtgagctgcagctgggtggagtcgtgggggaggtttggtacagccgagggccggtccctgacgactctcctgtattacttcgtggattcaacgttgggtntattntgctagtgaacgtcgggtccgcaggctaccggagggggaagggcgtagggaggttggggttaggtttcgagttaggagtacaatttctcagtgaagtgggaacaaacgagtaactaccggccgtcgtacgtaggtaaaacggcctaagtacttccaacgtatctaacaagagataggactacgaagaacgctagtccgtcctttcgngtacagtntaggtacgtacgctaagggaacacccgggaagaccgagacgacctacgttactaacgtttacgtggtaccgtaagaagggttatacggttaagtcggacgttaaccgtacccgttaacccggtacgttaccggttcggtacgggggttcccgggg

SEQ ID NO: 256403 - DNA, 674 bp, Homo sapiens
  misc_feature: GYAE6OF01C2T1D.13.35.D02.1.454.CMB.1.raw
  modified_base (245)..(245): a, c, t, g, unknown or other
  misc_feature (245)..(245): n is a, c, g, or t
  modified_base (315)..(315): a, c, t, g, unknown or other
  misc_feature (315)..(315): n is a, c, g, or t
  modified_base (392)..(392): a, c, t, g, unknown or other
  misc_feature (392)..(392): n is a, c, g, or t
  modified_base (518)..(518): a, c, t, g, unknown or other
  misc_feature (518)..(518): n is a, c, g, or t
  modified_base (608)..(608): a, c, t, g, unknown or other
  misc_feature (608)..(608): n is a, c, g, or t
tcagtcacgtactacacgaccggtgctcgatttagcacacgatagttgggtttgggggggagaggagccccagccgtgagattcccaggagtttccacttggtgatcagcactgaacacagaccaccaaccatggagtttgggcttacttgggtttttccttgttgcttaattttaaaaggtgtccaatgtgagctgcagctggtggagtcgtgggggagttttggacagccagggccggtcccngagactctctgtactacttctgattcaacgttgggatattatgtctagtagaacgttcgggtccgaccgnggcctaccggaagggggaacggggtcgtggggaaggttggggtttaggtttcgaaggtttaggacgtactaatttcnctataggacgtacgggaacaacgaagtaaacgtaccgccgcgtaacgtaaggtaaaacggcagtaacttccaacctatctacgaagatagtagacgtaccaagacgactcgttaccgtccttttanacgctagtaacgtaggaaccgttacggaccgtaaggaaccggacccggaagggaacctaccgaacgtaccctacgttactacgtttacgngttagacgtaagacgttagttgtcgacttaccgttacctacgtacttcgcggttagggtcccgggg

SEQ ID NO: 256404 - DNA, 563 bp, Homo sapiens
  misc_feature: GYAE6OF02HKARC.13.35.D02.1.454.CMB.1.raw
  modified_base (462)..(462): a, c, t, g, unknown or other
  misc_feature (462)..(462): n is a, c, g, or t
  modified_base (493)..(493): a, c, t, g, unknown or other
  misc_feature (493)..(493): n is a, c, g, or t
  modified_base (497)..(497): a, c, t, g, unknown or other
  misc_feature (497)..(497): n is a, c, g, or t
  modified_base (521)..(521): a, c, t, g, unknown or other
  misc_feature (521)..(521): n is a, c, g, or t
tcagtcacgtactacacgaccggtgctcgatttagcacacgatagttgggtttgggggggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtctgggggaggtttggtacagccagggcggtccctgagactctcctgtcaagcctctgggttcagcttcagtgtatattggatgagcgtgggtccgccagactccgaggggaggggctgggaggtgggtcggccaaacataaaacacaggacggaagtcgaacccataactatggacggactctggtacggaaggggcctattccacatcctccagacgacaacgccaagaactcactatattgacaatcggaccnctgagagacgagacacggctatgtattacgngtgngagagatggagaggtgactaacgngggttacgggcccgggtaaccgttggacctaccggtcactcg

SEQ ID NO: 256405 - DNA, 642 bp, Homo sapiens
  misc_feature: GYAE6OF02IXUZI.13.35.D02.1.454.CMB.1.raw
  modified_base (563)..(563): a, c, t, g, unknown or other
  misc_feature (563)..(563): n is a, c, g, or t
tcagtcacgtactacacgaccggtgctcgatttagcacacgatagttgggtttgggggggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtcgtgggggaggtttggtacagccgaggggcggtccctgagactctcctgtataacttctggattcaacgttgggtgattatgctatgaactgggtccgccaggctccgaggggaagggcgtggaggttgggtaggtttcgagtttaggagactaattctacagtggaagtggggaaccaaacgaagaaattaccggccggtaccgttcgtaaaggtaaaaggccaagtaacgttccaacctatcgtacaaagacgtatagacgtaccaaggaaacgcaagtccgtccttcgtcgactaagctagagtacgccgtaaggaagaccgaggactacacgcctaagtacctacgtttacnggtacgtaccgtaaggacttaagttacgttacgacgttaccgtaccgttaccggaccgttcgtacggtcgggtacgggg

SEQ ID NO: 256406 - DNA, 518 bp, Homo sapiens
  misc_feature: GYAE6OF01AQFIM.14.55.E11.1.454.CMB.1.raw
  modified_base (296)..(296): a, c, t, g, unknown or other
  misc_feature (296)..(296): n is a, c, g, or t
  modified_base (337)..(337): a, c, t, g, unknown or other
  misc_feature (337)..(337): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcgtggtttcgtcgtagctctttaagaggtgtccagtgtcaggtgcagctggtggagtcgtgggggagcgtggtccagcctgggaggtccctgacactctcctgtgcaacgtctggattcagcttcagtagttatggcatgcacgtgggtccnccaggctccgaggcaaggggctgggagtgggtggcagttgngtggtatggacggaagtaataggaaagtatgaccgacgccgtaggaacgggccgattcacatctccagagacaattaccaacaacatgttagtatctgacaaatgaatagcctagacgagccgagacgacggctgtagtattacgtgtagtcaggagagtgggaggggtgtgagtcgtagg

SEQ ID NO: 256407 - DNA, 542 bp, Homo sapiens
  misc_feature: GYAE6OF01AXEUL.14.55.E11.1.454.CMB.1.raw
  modified_base (294)..(294): a, c, t, g, unknown or other
  misc_feature (294)..(294): n is a, c, g, or t
  modified_base (430)..(430): a, c, t, g, unknown or other
  misc_feature (430)..(430): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcgtggtttcgcgtagctctttaagaggtgtccagtgtcaggtgcagctggtggagtctgggggagcgtggtccagcctgggaggtccctgacactctcctgtgcaacgtctggattcagcttcagtagttatggcatgcacgtgggtccnccaggctccaggcaaggggctgggagtggggtgcaggttgtgtggtatggacggtaagtaataggaaagttagtggaccgacggccgtggaaacgggccgattcgaccagtcctaccagagaactaacttcccaanaactatgttagtatctagactaaagtgaatacgaccgtagagacgaccgaggacacgggctgtagtattacgtgtcgtcgagagaggtgggtaggggtggtgtgtcgtaggg

SEQ ID NO: 256408 - DNA, 499 bp, Homo sapiens
  misc_feature: GYAE6OF01BDFM8.14.55.E11.1.454.CMB.1.raw
  modified_base (321)..(321): a, c, t, g, unknown or other
  misc_feature (321)..(321): n is a, c, g, or t
  modified_base (488)..(488): a, c, t, g, unknown or other
  misc_feature (488)..(488): n is a, c, g, or t
tcagcgtctagtaccacgaccggtgctcgatttagcactcgcacgttgggtttgggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtnaaggttcagtggcagtggatctgggacagatttcactctcaccgtcagcagtctgcaacctgaagtattttgctaacttactactgtcaacagagttacacgtaccccctctactttcggcggtagggaccaaggcggagatcagacgaactggtggctgcaccatntcgtcttctac

SEQ ID NO: 256409 - DNA, 508 bp, Homo sapiens
  misc_feature: GYAE6OF01B1CKX.14.55.E11.1.454.CMB.1.raw
  modified_base (321)..(321): a, c, t, g, unknown or other
  misc_feature (321)..(321): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtccctnaaggttcagtggcagtggatcgtgggacagtatttcactctcaccgtcagcagtctgacaacctgaagtatttgactaacttactactgtacaacagtacgttaccacgtaccccctctacgttcggacggacggaccaaggcgagactacgagacgaactggtcgctgacacatctcgtcttctac

SEQ ID NO: 256410 - DNA, 515 bp, Homo sapiens
  misc_feature: GYAE6OF01BU2QK.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagtattttagctaacttactactgtacaacagtagttaccacgtacccccctctaccgtttcggacggacgggaccgaaggcggagatacgagacgtaatggtggctgcctaccatctgtccttctaccg

SEQ ID NO: 256411 - DNA, 591 bp, Homo sapiens
  misc_feature: GYAE6OF01ERT39.14.55.E11.1.454.CMB.1.raw
  modified_base (297)..(297): a, c, t, g, unknown or other
  misc_feature (297)..(297): n is a, c, g, or t
  modified_base (366)..(366): a, c, t, g, unknown or other
  misc_feature (366)..(366): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgacactctcctgtgcaacgtctggattcagcttcagtagttatggcatgcactgggtcccncaggctccgaggcaaggggctgggagtgggtgctagttgtgtggtatggaacggaagtaatagaaagtntgccgaggccgtaggaacgggccgtattccacctatccgtaccagacgaactaacttacccaaactaactagttagtttacgtaactctagactaaagtgaaatacgccgtaggaacgacggacccgaggaccaacgggtcttaggtagttaacgtttacgtgttacggtacgaagggtaggtaacggtgggggaagggggttggtaggtaagtccggtaaaggg

SEQ ID NO: 256412 - DNA, 503 bp, Homo sapiens
  misc_feature: GYAE6OF01BX1RH.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaatggtatcaacagaaaccagggaaagcccctgacctcctgatctatgctgcatccagtttgcacgagtggggtccctcaaggttcagtggcagtggatcgtgggacagatttcactctcaccgtcagcagtctgcaacctgaagtatttgactaacttactactgtacaacagtagttacacgtacccccctctaccgtttcggcggaggaccaagggcggagatcgagacgaagtggtgctgcaccatctgtcttctac

SEQ ID NO: 256413 - DNA, 505 bp, Homo sapiens
  misc_feature: GYAE6OF01AU04M.14.55.E11.1.454.CMB.1.raw
  modified_base (362)..(362): a, c, t, g, unknown or other
  misc_feature (362)..(362): n is a, c, g, or t
  modified_base (435)..(435): a, c, t, g, unknown or other
  misc_feature (435)..(435): n is a, c, g, or t
  modified_base (472)..(472): a, c, t, g, unknown or other
  misc_feature (472)..(472): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgacactctcctgtgcaacgtctggattcagcttcagtagttatggcatgcacgtgggtccgccaggctccgaggcaaggggctggagtgggtggcagttgtgtggtatgacggaagtaatagaagtngccgagccgtgaagggccgattcaccatctacagagacaattaccaagaacacgcagtatctgacaatgaacngcctagagagcagacggacacggctgtagtattacgnggtgggagagagtggaggtacgatgttggtagg

SEQ ID NO: 256414 - DNA, 516 bp, Homo sapiens
  misc_feature: GYAE6OF01A19KV.14.55.E11.1.454.CMB.1.raw
  modified_base (175)..(175): a, c, t, g, unknown or other
  misc_feature (175)..(175): n is a, c, g, or t
  modified_base (295)..(295): a, c, t, g, unknown or other
  misc_feature (295)..(295): n is a, c, g, or t
  modified_base (365)..(365): a, c, t, g, unknown or other
  misc_feature (365)..(365): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcggtggtttcgcgtaggctctttaagaggtntccagtgtcaggtgcagctggtggagtctgggggagcgtggtccagcctgggagtccctgacactctcctgtgcaacgtctggattcagcttcagtagttatggcatgcacgtgggtccnccaggctccgaggcgaaggggctgggagtgggtgcaggttgtgtggtatggacggaagtaatagaaagtntgccgagccgtgaacgggccgattcaccatctaccagagacaacttaccaacaactatgttagtatctagactaaatgaatacgcctagagagccgagacgacggctgtgtattacgtgtgtcagagagtgggaggggtgtgtgtcgtagg

SEQ ID NO: 256415 - DNA, 569 bp, Homo sapiens
  misc_feature: GYAE6OF01CVPEB.14.55.E11.1.454.CMB.1.raw
  modified_base (217)..(217): a, c, t, g, unknown or other
  misc_feature (217)..(217): n is a, c, g, or t
  modified_base (325)..(325): a, c, t, g, unknown or other
  misc_feature (325)..(325): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattaagaactatttaaattggtatcaaacagaaaccagggaaacgcccctagacctcctgatctatgctgcatccagtttgcacgagtggggtccctnaaggttcagtggcagtggatcgtgggactagtatttcactctacgtaccgtcagcagtctcgacaacctgaagtatttgactaacttactactgtacaactagtaacttacacgttacccccctcgtaaccgtttcgggacggtaacgggaccgaagggcggaacgtacgtacgaacggtaccgtaagtggtcggtacgttcggacctacccgtaattccgttacgttccgttccgttaacccg

SEQ ID NO: 256416 - DNA, 490 bp, Homo sapiens
  misc_feature: GYAE6OF01DO87Q.14.55.E11.1.454.CMB.1.raw
  modified_base (278)..(278): a, c, t, g, unknown or other
  misc_feature (278)..(278): n is a, c, g, or t
  modified_base (295)..(295): a, c, t, g, unknown or other
  misc_feature (295)..(295): n is a, c, g, or t
  modified_base (356)..(356): a, c, t, g, unknown or other
  misc_feature (356)..(356): n is a, c, g, or t
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
  modified_base (461)..(461): a, c, t, g, unknown or other
  misc_feature (461)..(461): n is a, c, g, or t
  modified_base (481)..(481): a, c, t, g, unknown or other
  misc_feature (481)..(481): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgacactctcctgtgcaacgtctggattcagcttcagtagttanggcatgcactgggtccncaggctccaggcaaggggctggagtgggtgcagttgtgtggtatgacggataatagaagtngccgagcgtgaagggcatcaccatctcagngacaattccaanaacatgtgtatctgacaaatgaatagcctagagagccgagacacggctgtgtattactgtgtnagagagtgggaggggtgtgngtcgtaagg

SEQ ID NO: 256417 - DNA, 567 bp, Homo sapiens
  misc_feature: GYAE6OF01EYS5J.14.55.E11.1.454.CMB.1.raw
  modified_base (447)..(447): a, c, t, g, unknown or other
  misc_feature (447)..(447): n is a, c, g, or t
  modified_base (464)..(464): a, c, t, g, unknown or other
  misc_feature (464)..(464): n is a, c, g, or t
  modified_base (512)..(512): a, c, t, g, unknown or other
  misc_feature (512)..(512): n is a, c, g, or t
  modified_base (534)..(534): a, c, t, g, unknown or other
  misc_feature (534)..(534): n is a, c, g, or t
tcagcgtctagtaccacgaccggtgctcgatttagcactcgcacgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttgcagtaacaccaagtacaggaatattaacctgtttccccatcgactacgcctttcggcctcgccttaggggtcgactcaccctgccccgattaacgtggacaggaacccttggtcttccggcgagcgggcttttcacccgctttatcgttacttatgtcagcattcgctacttctgatacctcagcatgcctcacagcacaccttnacaggcttacagaaccnctcccctaaccaacacgcataacgcgtacgctcgccgcagcttcggtncattcggtttacgccccgtttnacttcctcccgcctatctagtacgtactgaccg

SEQ ID NO: 256418 - DNA, 531 bp, Homo sapiens
  misc_feature: GYAE6OF01C20QG.14.55.E11.1.454.CMB.1.raw
  modified_base (179)..(179): a, c, t, g, unknown or other
  misc_feature (179)..(179): n is a, c, g, or t
  modified_base (242)..(242): a, c, t, g, unknown or other
  misc_feature (242)..(242): n is a, c, g, or t
  modified_base (373)..(373): a, c, t, g, unknown or other
  misc_feature (373)..(373): n is a, c, g, or t
  modified_base (521)..(521): a, c, t, g, unknown or other
  misc_feature (521)..(521): n is a, c, g, or t
tcagcgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagcgtggtttcgtcgtagctctttaagaggtntccagtgtcaggtgcagctggtggagtcgtgggggagcgtggccagcctgggagtccctgacnctctcctgtgcaacgtctggattcagtcttcagtagttatggcatgcacgtggtccgccaggcctccgaggcaaggggctgggagtgggtgctagttgtgtggtatggaacggtaagtaaataggaaagtntcggacccgacggccgtaggaacgggccgattcacctatctaccagagacaataccaacaacatgtgtatctgacaagtgaatagcgtagagagaccgaggacacggctgtgtattacgtgtagtcaggtagaggtgggaggggttgngagtcgtagg

SEQ ID NO: 256419 - DNA, 520 bp, Homo sapiens
  misc_feature: GYAE6OF01CRP2D.14.55.E11.1.454.CMB.1.raw
  modified_base (172)..(172): a, c, t, g, unknown or other
  misc_feature (172)..(172): n is a, c, g, or t
  modified_base (336)..(336): a, c, t, g, unknown or other
  misc_feature (336)..(336): n is a, c, g, or t
  modified_base (512)..(512): a, c, t, g, unknown or other
  misc_feature (512)..(512): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctgggtggagtcgtgggggagcgtggtccagcctgggaggtccctgacactctcctgtgcaacgtctggattcagcttcagtagttatggcatgcacgtgggtcccgccaggcctccgaggcaagggggctgggaggtggggnggcaggttgtgtggtatgacggaagtaatagaagtatgccgacgccgtgaaggccgatcaccatctccagagacaattccaacaacatgttgtatctgactaaatgaatagacctgagacgaccgaggaacacggctggtgtagttacgtgtgtcagagagtggggaggggtgtgngtcgtagg

SEQ ID NO: 256420 - DNA, 503 bp, Homo sapiens
  misc_feature: GYAE6OF01E1V88.14.55.E11.1.454.CMB.1.raw
  modified_base (296)..(296): a, c, t, g, unknown or other
  misc_feature (296)..(296): n is a, c, g, or t
  modified_base (362)..(362): a, c, t, g, unknown or other
  misc_feature (362)..(362): n is a, c, g, or t
  modified_base (493)..(493): a, c, t, g, unknown or other
  misc_feature (493)..(493): n is a, c, g, or t
  modified_base (495)..(495): a, c, t, g, unknown or other
  misc_feature (495)..(495): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgacactctcctgtgcaacgtctggattcagcttcagtagttatggcatgcactggggtccnccaggctccaggcaagggctggagtgggtggcagttgtgtggtatggacggaagtaatagaaagtntgccgagccgtgaagggccgatcaccatctcagagacaattccaacaacatgttgtatctgacaaatgaatagcctagagagccgaggacacggctgtgtattactgtgtcagagagtgggagggggtggngngtcgtagg

SEQ ID NO: 256421 - DNA, 531 bp, Homo sapiens
  misc_feature: GYAE6OF01AHGPY.14.55.E11.1.454.CMB.1.raw
  modified_base (216)..(216): a, c, t, g, unknown or other
  misc_feature (216)..(216): n is a, c, g, or t
  modified_base (321)..(321): a, c, t, g, unknown or other
  misc_feature (321)..(321): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggnaagtcagagcattaagaactatttaaatggtatcaacagaaaccagggaaacgcccctgacctcctgatctatgctgcatccagtttgcacaggtcgggtccctnaaggttcagtgcagtgatcgtggacagtatttcacttctacaccgtcagcagtctgacaactgaagtatttgactaacttactactcgtacaacagtacgttacaccgtaccccctctacgttccggacggtacggaccgaaggcggagacgtacgaacggacgtaacgtggtcggcgtacgacctaacctatccttcgttccttctacc

SEQ ID NO: 256422 - DNA, 169 bp, Homo sapiens
  misc_feature: GYAE6OF01A2N0N.14.55.E11.1.454.CMB.1.raw
  modified_base (167)..(169): a, c, t, g, unknown or other
  misc_feature (167)..(169): n is a, c, g, or t
tcagcgtctagtaccacgaccggtgctcgatttagcactcgcacgttgggtttggggggagacgagcccagcactggaagtcgccggtgtttccattcggtgatcagcactgaacacagaggactcaccatggagtttgggctgagcgggctggcaaggcgcatagnnn

SEQ ID NO: 256423 - DNA, 564 bp, Homo sapiens
  misc_feature: GYAE6OF01DSS1U.14.55.E11.1.454.CMB.1.raw
  modified_base (279)..(279): a, c, t, g, unknown or other
  misc_feature (279)..(279): n is a, c, g, or t
  modified_base (299)..(299): a, c, t, g, unknown or other
  misc_feature (299)..(299): n is a, c, g, or t
  modified_base (313)..(313): a, c, t, g, unknown or other
  misc_feature (313)..(313): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacgttgccgggacaagtcagagcaattaaagaacttatttaaattggtatacaaacaagaaaccagggaaacncccctgacctctgatctatnctgcatccagtttncacgaggtcggggtccctagaaggttcaggtgcgagtggatcgtgggactagtatttcgactctcgaccgtcacgcagtctcgactaaacctgtaagttatttgactaacttactacgtgtacaatagtaacgttacctaccgtaccccctacgtaccgttccggacgggaacggtaccgaaggacggagtacacgacgtacgaagttggtcggactcgccgtactagttaccttcgttccttcgtacccg

SEQ ID NO: 256424 - DNA, 607 bp, Homo sapiens
  misc_feature: GYAE6OF01AB6R3.14.55.E11.1.454.CMB.1.raw
  modified_base (231)..(231): a, c, t, g, unknown or other
  misc_feature (231)..(231): n is a, c, g, or t
  modified_base (293)..(293): a, c, t, g, unknown or other
  misc_feature (293)..(293): n is a, c, g, or t
  modified_base (450)..(450): a, c, t, g, unknown or other
  misc_feature (450)..(450): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcgtggtttcgcgtagctcttaagagtgtcagtgtcaggtgcagctggtggagtcgtgggggagcgtggtccaggcctgggagtcccngacactctcctgtgcaacgtctggattcagtcttcagtagttatggcatgcacgtgggtccnccaggctccgaggctaaggggctgggagtgggtgctggttgtggtggtatggaacggtaagtaataggaaatgtcgacccgacggccgtaggaacgggtcctaagttcacctagtccgtccgagacgaactaacttaccaaactacgtattaggttntaatccgtagaactaaacgtgtaaactcgcgtagaacggacgccggaggacccgacggtccttggtacgttaacgtttcgtggtttacggaacgtaagggtaggtaacgggttgggggtaacgggggttaggtcggtaaaggttcccggtaaagggg

SEQ ID NO: 256425 - DNA, 520 bp, Homo sapiens
  misc_feature: GYAE6OF01EGY9T.14.55.E11.1.454.CMB.1.raw
  modified_base (298)..(298): a, c, t, g, unknown or other
  misc_feature (298)..(298): n is a, c, g, or t
  modified_base (365)..(365): a, c, t, g, unknown or other
  misc_feature (365)..(365): n is a, c, g, or t
  modified_base (512)..(512): a, c, t, g, unknown or other
  misc_feature (512)..(512): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgacactctcctgtgcaacgtctggattcagcttcagtagttatggcatgcactgggtccnccaggctccaggcaaggggctgggagtgggtgcagttgtgtggtatgacggaagtaataggaaagtntgccgacgccgtgaacgggccgattcaccatctccagagacaattccaacaacatgtttgtatctagacaaatgaatagcctagagacgccggaggacacggctagtagttattcgtgtcgtacagagagtggggagggggtggtgngtcgtagg

SEQ ID NO: 256426 - DNA, 520 bp, Homo sapiens
  misc_feature: GYAE6OF01AU9CS.14.55.E11.1.454.CMB.1.raw
  modified_base (302)..(302): a, c, t, g, unknown or other
  misc_feature (302)..(302): n is a, c, g, or t
  modified_base (370)..(370): a, c, t, g, unknown or other
  misc_feature (370)..(370): n is a, c, g, or t
  modified_base (438)..(438): a, c, t, g, unknown or other
  misc_feature (438)..(438): n is a, c, g, or t
  modified_base (511)..(511): a, c, t, g, unknown or other
  misc_feature (511)..(511): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccaggcctggggaggtccctgacactctcctgtgcaacgtctggattcagcttcagttagttatggcatgcactggggtccncaggctccaggcaaggggctgggagtgggtggcaggttgtgtggtatggacggaagtaatagaaagtntgccgacgccgtggaacgggccgattcaccatctccagagacaattaccaacaacatgttagtatctnacaaatgaatagcctgagagccgaggacacggctgtgtattacgtgtgtcaggagagtgggaggggtggtggngtccgtagg

SEQ ID NO: 256427 - DNA, 567 bp, Homo sapiens
  misc_feature: GYAE6OF01E3OTY.14.55.E11.1.454.CMB.1.raw
  modified_base (256)..(256): a, c, t, g, unknown or other
  misc_feature (256)..(256): n is a, c, g, or t
  modified_base (295)..(295): a, c, t, g, unknown or other
  misc_feature (295)..(295): n is a, c, g, or t
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
  modified_base (359)..(359): a, c, t, g, unknown or other
  misc_feature (359)..(359): n is a, c, g, or t
  modified_base (437)..(437): a, c, t, g, unknown or other
  misc_feature (437)..(437): n is a, c, g, or t
  modified_base (525)..(525): a, c, t, g, unknown or other
  misc_feature (525)..(525): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcggtggtttcgcgtaggctctttaagaggtgtcagtgtcaggtgcagctggtggagtcgtgggggagcgtggtccagcctgggagtccctgacactctcctgtgcaacgtcnggattcagcttcagtgttatggcatgcacgtggggtccnccaggctccgaggcgaaggggctgggagtgggtgacnggttgngtggtatcggaaggaagtaanaggaaagtgtcgccgacgccgtaggaacgggctattaccgactagtctaccaggaacactaattacccaaactaactnttagttacgtaatccgttagactaaagtgaaactcgtcctaggaacgtacggaccgaggacgtacggcgttagtcgttaatcgttggngtacaggaagtggtggggacggggttgtagtcgtcgtaaggg

SEQ ID NO: 256428 - DNA, 600 bp, Homo sapiens
  misc_feature: GYAE6OF01A3UA1.14.55.E11.1.454.CMB.1.raw
  modified_base (256)..(256): a, c, t, g, unknown or other
  misc_feature (256)..(256): n is a, c, g, or t
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
  modified_base (336)..(336): a, c, t, g, unknown or other
  misc_feature (336)..(336): n is a, c, g, or t
  modified_base (338)..(338): a, c, t, g, unknown or other
  misc_feature (338)..(338): n is a, c, g, or t
  modified_base (340)..(340): a, c, t, g, unknown or other
  misc_feature (340)..(340): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagcggtgtttcgcgtaggcgtctttaagaggtgtcagtgtcaggtgcagctggtggagtctgggggagcgtggtccagcctgggaggtccctgacactctcctgngacaacgtctggacttcagcttnagtagttagtggcatgcacgtgggtccncaggctccaggcgaagggctggagtgggngngngtgtgtgtagtagagaagtaagtaagtaagtagtacgtaccgacgtacggtacggaacgggtaccgtacgtaccgacctacgtacctaccgaacgaacgtaactaactaacctaaaccaactagttagttagttacgtacgtacgtaactaacgtaacgtaacgtaacgtacgtagaagacgtacgtaggacggaccgacggtacgtagttagttacgttaggtaggtagggaggtaggtaggtaggtaggtagtagtag

SEQ ID NO: 256429 - DNA, 616 bp, Homo sapiens
  misc_feature: GYAE6OF01AC871.14.55.E11.1.454.CMB.1.raw
  modified_base (312)..(312): a, c, t, g, unknown or other
  misc_feature (312)..(312): n is a, c, g, or t
  modified_base (544)..(544): a, c, t, g, unknown or other
  misc_feature (544)..(544): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcgtggtccaggccgtgggacgtccctgacactctccgtgtgcaacgtctaggattcaggtcttacgagttagttatggcagtgcacgtggggtccnccgaggcctccgaggcgaaggggtctgggagtgggtggctaggtttgtcggtggtactagggaacggtaaagtaagtaggtaaagtcgtcggacccggaacgccggtaagggaacgggaccgtattaccgacctactccgtaccgaagacgaactaacttacccgaaacaactagtgttacgtatcgtagactaaatagaactacgcgtagagacggacgaggaccgtaggngttacgtagttacgttacgtggtagtacgaggaaggtaggtcgggggtagggtaggtacgagtcggtaaggg

SEQ ID NO: 256430 - DNA, 514 bp, Homo sapiens
  misc_feature: GYAE6OF01AG1BF.14.55.E11.1.454.CMB.1.raw
  modified_base (307)..(307): a, c, t, g, unknown or other
  misc_feature (307)..(307): n is a, c, g, or t
  modified_base (388)..(388): a, c, t, g, unknown or other
  misc_feature (388)..(388): n is a, c, g, or t
  modified_base (411)..(411): a, c, t, g, unknown or other
  misc_feature (411)..(411): n is a, c, g, or t
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
  modified_base (428)..(428): a, c, t, g, unknown or other
  misc_feature (428)..(428): n is a, c, g, or t
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
  modified_base (471)..(471): a, c, t, g, unknown or other
  misc_feature (471)..(471): n is a, c, g, or t
  modified_base (474)..(474): a, c, t, g, unknown or other
  misc_feature (474)..(474): n is a, c, g, or t
  modified_base (479)..(479): a, c, t, g, unknown or other
  misc_feature (479)..(479): n is a, c, g, or t
  modified_base (503)..(503): a, c, t, g, unknown or other
  misc_feature (503)..(503): n is a, c, g, or t
  modified_base (509)..(509): a, c, t, g, unknown or other
  misc_feature (509)..(509): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgacactctcctgtgcaacgtctggattcagcttcagtagttatggcatgcacgtgggtccnccgaggcctccgagggcgaagggggctgggaggtgggtggctaggtttgtggtggtagtggaacggaagtaatagaaagtntgccgacgcgtgaggccatcacntcncaganacatccaanacntgttntatctagacaaatgaatgcctagagagcgaggacnggntggtntattactgtgcagtgagtaggggngggtgngtacg

SEQ ID NO: 256431 - DNA, 596 bp, Homo sapiens
  misc_feature: GYAE6OF01BE4W7.14.55.E11.1.454.CMB.1.raw
  modified_base (305)..(305): a, c, t, g, unknown or other
  misc_feature (305)..(305): n is a, c, g, or t
  modified_base (344)..(344): a, c, t, g, unknown or other
  misc_feature (344)..(344): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgacactctcctgtgcaacgtctggattcagcttcagtagttatggcatgcacgtgggtccnccaggctccaggcaaggggctgggagtgggtgcagttgngtgtatgacggaagtaataggaaagtagtcggaccgacgccggtagaacggggccattcaccatctacagagacaacgttaccaacaacatgttgtatcgtgactaaatagtaatacgaccgttaggaacgacggtaccgaagggtacccgacgggtaccttgggttagttaacgtttaacgtgggttacgtaccgaagggtaaggtaggttagggggtaggggggtttcgggtagggtacgttaacccggg

SEQ ID NO: 256432 - DNA, 576 bp, Homo sapiens
  misc_feature: GYAE6OF01A5KVA.14.55.E11.1.454.CMB.1.raw
  modified_base (270)..(270): a, c, t, g, unknown or other
  misc_feature (270)..(270): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatacaacaggaaaccgggaanccctagacctcctgatctatgctgcatccagtttgcacgtacggtcgggtcccgtagaaggttcaggtggcaggtggatcgtagggactagtactttcacttctcaccgtcagcagtctacgactaaccgtagtaagttattttacgactaacttactactagtacaactagtacgttaccaccgtaccccctcgtaccgtttcgggacggacgggaccgaagggcggagtacgtacgaacgaacgtaacgtggtacggtcctacgcctaaccgtacgttacttagttccttccgtacgttccccg

SEQ ID NO: 256433 - DNA, 697 bp, Homo sapiens
  misc_feature: GYAE6OF01C8L2G.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggacaagtcagagctaattaaagaacttaatttaaaattggtatacaaacagaaaaccagggaaacgcccctagacctcctgatctatgctgcatcctagtttgactacgagtcggggtcccgtacgtaaggttcgagtcggacgtaggtaggaatccgtaggggaactagtacgtttcaacttccgtacctaacccgtcaacgtcctacggttaccgtacgacctaaaccgttaggaaacgttagttttaccgaacttaaacctttaccgtaacttcgtactaaaaacgtcggtaacgtttaaccaacccgttacccccccgttaccgttaaccggttttaccggggacgggttaaccggggaaccggaacgggaccggtaacgtaacgtaccgtaacgggtaaaccgtaacgtcgggttacggtacccgtcgtaccccgtaaccttacgtcccgtttacggtttcccgttaccgttacccg

SEQ ID NO: 256434 - DNA, 168 bp, Homo sapiens
  misc_feature: GYAE6OF01EDI7O.14.55.E11.1.454.CMB.1.raw
  modified_base (165)..(168): a, c, t, g, unknown or other
  misc_feature (165)..(168): n is a, c, g, or t
tcagcgtctagtaccacgaccggtgctcgatttagcactcgcacgttgggctctgggagaggagcccagcactggaagtcgccggtgtttccattcggtgatcagcactgaacacagaggactcaccatggagtttgggctgagcgggctggcaaggcgcatagnnnn

SEQ ID NO: 256435 - DNA, 541 bp, Homo sapiens
  misc_feature: GYAE6OF01CCGC5.14.55.E11.1.454.CMB.1.raw
  modified_base (308)..(308): a, c, t, g, unknown or other
  misc_feature (308)..(308): n is a, c, g, or t
  modified_base (535)..(535): a, c, t, g, unknown or other
  misc_feature (535)..(535): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgacactctcctgtgcaacgtctggattcagtcttcagtagttatggcatgcacgtgggtccnccaggctccgaggcaaggggctgggagtgggtggcagttgtgtggtatggacggaagtaataagaaagtagtcgccgacgccgtaggaacgggccgattcaccatcctccagacgacaattccaaacaacatgttgtatctagacaaatgtaatacgcctgagacggccgaaggacacggctaggtagtacttactgtgtacgagagtaggtggggaggggtggtgngtacgg

SEQ ID NO: 256436 - DNA, 556 bp, Homo sapiens
  misc_feature: GYAE6OF01EBLVV.14.55.E11.1.454.CMB.1.raw
  modified_base (305)..(305): a, c, t, g, unknown or other
  misc_feature (305)..(305): n is a, c, g, or t
  modified_base (379)..(379): a, c, t, g, unknown or other
  misc_feature (379)..(379): n is a, c, g, or t
  modified_base (547)..(547): a, c, t, g, unknown or other
  misc_feature (547)..(547): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtccctgacactctcctgtgcaacgtctggattcagtcttcagttagttatggcatgcacgtggggtcccnccaggcctccgaggcgaaggggctgggaggtgggtggctaggttgtgtggtatggacggaagtaataagaagtntcgccgacgcgagaacgggcctatccacatctacgagacgaacaacttacccaaactaactagttgttagtatctagactaaagtgaaatacgcgtagaacgacgaccggaggacgacggtctgtagttacttacgtgtagtcaggagtaggtggggaggggtgtagngtcgtaagg

SEQ ID NO: 256437 - DNA, 523 bp, Homo sapiens
  misc_feature: GYAE6OF01AT31D.14.55.E11.1.454.CMB.1.raw
  modified_base (270)..(270): a, c, t, g, unknown or other
  misc_feature (270)..(270): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcattaagaactatttaaattggtatcaacagaaaccagggaaacncccctgacctcctgatctatgctgcatccagtttgcacgaggttcggggtcccgtcgaaggttcagtcggcaggtggatcgtgggacagtatttcactctcaccgtcacgcagtctgcaacctgaagtattttgactaacttactactgtacaacagacgttacacgtaccccctactaccgttcggcggacggacaaggcgagatacgacgtacgacgtggtcgctcgacctaccactctcgtcttctaccg

SEQ ID NO: 256438 - DNA, 509 bp, Homo sapiens
  misc_feature: GYAE6OF01DA7J4.14.55.E11.1.454.CMB.1.raw
  modified_base (277)..(277): a, c, t, g, unknown or other
  misc_feature (277)..(277): n is a, c, g, or t
  modified_base (305)..(305): a, c, t, g, unknown or other
  misc_feature (305)..(305): n is a, c, g, or t
  modified_base (335)..(335): a, c, t, g, unknown or other
  misc_feature (335)..(335): n is a, c, g, or t
  modified_base (351)..(351): a, c, t, g, unknown or other
  misc_feature (351)..(351): n is a, c, g, or t
  modified_base (370)..(370): a, c, t, g, unknown or other
  misc_feature (370)..(370): n is a, c, g, or t
  modified_base (395)..(395): a, c, t, g, unknown or other
  misc_feature (395)..(395): n is a, c, g, or t
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
  modified_base (496)..(496): a, c, t, g, unknown or other
  misc_feature (496)..(496): n is a, c, g, or t
tcagcgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggaggtccctgacactctcctgtgcaacgtctggattcagcttnagtagttatggcatgcacgtcgggtccncaggctccgaggcaaggggctggagtgggngctagttgtgtggtangacggaagtaatagaagtngcgacgcgtgaagggcatcacatcnccagagacaatccaacacatgttntatctnacaatnaatagcctagagacgcgagacgacggtctgtgtatacgtgtgtcgagaggagtggggaggggtgnggagtcgtaaggg

SEQ ID NO: 256439 - DNA, 764 bp, Homo sapiens
  misc_feature: GYAE6OF01BI887.14.55.E11.1.454.CMB.1.raw
  modified_base (193)..(193): a, c, t, g, unknown or other
  misc_feature (193)..(193): n is a, c, g, or t
  modified_base (325)..(325): a, c, t, g, unknown or other
  misc_feature (325)..(325): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgtttgcttcttttaagaggtgtccagtgtcaggtncagctggtggagtcgtgggggagcgtggtccaggccgtggggacgtccctgaccactctccgtgtcgcaacgtctggatttcgagtcttcgaagttagttatcggactattcgcctacggtcggggtccccnccgagggtcctaccgagggcgaaggggtcctaggggaggtggggtgcgtaggtttgtggttagggttatagggaacggtaaagtaagtaacggtaaagttagtccggacccggtaacggtccggtagggaaccggggcccgtaacgttccgaacccgtacttacccgtacgtaacgaaacgtaacctaaacgttaacccgaaacgtaaccgtaacctttacctttaacgttttaccttaacgtaaacgtacgggaacgtaaccgtaaccgtaacggtaaaacggtaaccggtaaacggtaaccggtaccggggttacgttaggttttaacgttttacggtaggttaacggtaaaacgtacggttaacgaagtttacgtaacgttacgtaaacccgttaaccgttaaggtttaggggtaacggttccgtttacgtacggg

SEQ ID NO: 256440 - DNA, 514 bp, Homo sapiens
  misc_feature: GYAE6OF01A2MR9.14.55.E11.1.454.CMB.1.raw
  modified_base (368)..(368): a, c, t, g, unknown or other
  misc_feature (368)..(368): n is a, c, g, or t
tcagcgtctagtaccacgaccggtgctcgatttagcactcgcacgttgggtttgggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgacactctcctgtgcaacgtctggattcggcttcagtagttatggcatgcactgggtccgccaggctccgaggcaaggggctgggagtgggtggcagttgtgtggtatgacggaagtaatagaaagtntgccgagccgtgaagggccatcaccatctccagagacaattccaacaacatgttgtatctagacaaatgaatagcctagagagccgagacgacgctgtgtattacgtgtgtcagagagtagggagggggtgtaggagtcgaggtag

SEQ ID NO: 256441 - DNA, 527 bp, Homo sapiens
  misc_feature: GYAE6OF01ACBQD.14.55.E11.1.454.CMB.1.raw
  modified_base (269)..(269): a, c, t, g, unknown or other
  misc_feature (269)..(269): n is a, c, g, or t
  modified_base (321)..(321): a, c, t, g, unknown or other
  misc_feature (321)..(321): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcccccctgtctgcatctgtaggagacagagtcaccatcacttgccggcaagtcagagcattaagaactatttaaattggtatcaacagaaaccagggaaancccctgacctcctgatctatgctgcatccagtttgcacagtcgggtcccgtnaaggttcagtggcagtggatcgtgggacagtatttcactctcaccgtcagcagtctgacaacctgaagtatttagactaacttactactgtacaacagtattacacgtaccccctcgtaccgtttcggcggagggaccgaaggcggaagacgtacgaagacgtaacgtggtcggctcgaccacgtactctagtcttcgtcttcccg

SEQ ID NO: 256442 - DNA, 714 bp, Homo sapiens
  misc_feature: GYAE6OF01BRJYO.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgaccactctcctgtgcaacgtctggattcgagtcttcagtagttatggcatgcacgtgggtcccgccgaggcctccgagggccgaagggggtctagggaggtggggtggcgtaggttggtggtggtatagggaacggtaagttaaagtaaggtaaagtgtacgggacccggaacggcccggttagggaaccggggtccgtaacgtttaccgaacccgtacgttaccgtacccgaaggaacgtaactaaaccttacccgaaacctaaacctaatttacgtttacgttacttacgtacggtaacctaaagttagtaaacttaacgtacccgttaggaacggtacggacccgggaacggaaccggtaacgggtccgttaggttaggtttaacgtttacggttacggttaggtaccgaaggtaaggtaagggtaggggggttaaggggggttaggttacgggtacggtcggttaaaggg

SEQ ID NO: 256443 - DNA, 521 bp, Homo sapiens
  misc_feature: GYAE6OF01A24K9.14.55.E11.1.454.CMB.1.raw
  modified_base (297)..(297): a, c, t, g, unknown or other
  misc_feature (297)..(297): n is a, c, g, or t
  modified_base (370)..(370): a, c, t, g, unknown or other
  misc_feature (370)..(370): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgacactctcctgtgcaacgtctggattcagcttcagtagttatggcatgcacgtggggtccnccgaggcctccgaggcaaggggctgggagtgggtgctaggttgtgtggtatggaacggaataagtagaaagtntcgccgacgccgtgaacggccattcaccatcacagagacaatccaacactatgttagtatctagacaatgaatcgcctagagacgcgagacacgtatgtagtacttacgtgtcgtcgagagagtggggtaggggttagtgagtcggtaagg

SEQ ID NO: 256444 - DNA, 532 bp, Homo sapiens
  misc_feature: GYAE6OF01DS9C9.14.55.E11.1.454.CMB.1.raw
  modified_base (300)..(300): a, c, t, g, unknown or other
  misc_feature (300)..(300): n is a, c, g, or t
  modified_base (375)..(375): a, c, t, g, unknown or other
  misc_feature (375)..(375): n is a, c, g, or t
  modified_base (475)..(475): a, c, t, g, unknown or other
  misc_feature (475)..(475): n is a, c, g, or t
  modified_base (479)..(479): a, c, t, g, unknown or other
  misc_feature (479)..(479): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgacactctcctgtgcaacgtctggattcagcttcagttagttatggcatgcacgtgggtcccncaggcctccgaggcgaaggggctgggaggtgggtgctaggttgtgtggtatggaacggaagtaataaggaaagtntcggccgacgccgtaggaacgggccgattcacatctacagagacaacttaccaacaactatgttgtatctagacaaatgaatagctagagagacgagacncggntgtagtattctgtgtcgagagaggtaggggagggggtggtggtgtcgtaaggg

SEQ ID NO: 256445 - DNA, 503 bp, Homo sapiens
  misc_feature: GYAE6OF01EGTRK.14.55.E11.1.454.CMB.1.raw
  modified_base (390)..(390): a, c, t, g, unknown or other
  misc_feature (390)..(390): n is a, c, g, or t
  modified_base (438)..(438): a, c, t, g, unknown or other
  misc_feature (438)..(438): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacaggtggggtccctcgaaggttcagtggcagtggatcgtgggacagtatttcactctcaccgtcagcagtctgcaactgaatntttagctaacttactactgtacaacagtagttaccacgtacccccctntaccgtttcggcggacgggaccaagggcgagatcgagacgatgngacngcacatctgtctcgtac

SEQ ID NO: 256446 - DNA, 579 bp, Homo sapiens
  misc_feature: GYAE6OF01CK277.14.55.E11.1.454.CMB.1.raw
  modified_base (278)..(278): a, c, t, g, unknown or other
  misc_feature (278)..(278): n is a, c, g, or t
tcagcgtctagtaccacgaccggtgctcgatttagcactcgcacgttgggtttggggagtctcagtcaggacacagcatggacatgagggtccccgctcagctcctgtggctcctgctactctggctccgaggtgccagatgtgacatccagatgacccagtctccatccctccctgtctgcatctgtaggagacagagtcaccatcacttgccgggcaagtcagagcaattaaagaacttaatttaaattggtatacaacaagaaaccagggaaacncccctagacctcctgatctatcgctgcatcctaagtttcgctacgtagggtccgggtaccgtacgtaaggttcaggtggcgaggtggactcgtagggactagttagtttccacgttcctaccgtaccgtcgacgtctacgttctacgacctaacgtagtaagttatttacgacttaacgttactacgtagtactaactacgtaacgttacctacccgtaccccctcgttaccgttacggacgggacggaccgaaggcgagacgtacgacgacgagtgcgctacgaccacatctgtcttccg

SEQ ID NO: 256447 - DNA, 520 bp, Homo sapiens
  misc_feature: GYAE6OF01BL9QD.14.55.E11.1.454.CMB.1.raw
  modified_base (370)..(370): a, c, t, g, unknown or other
  misc_feature (370)..(370): n is a, c, g, or t
  modified_base (510)..(510): a, c, t, g, unknown or other
  misc_feature (510)..(510): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgaccactctcctgtgcaacgtctggattcagcttcagtagttatggcatgcacgtgggtccgccaggcctccaggcaaggggctgggagtggggtgcaggttgtgtggtatggaacggaagtaatagaaagtntgccgacgccgtggaagggccgagttcaccatctacagagacaattaccaacaacatgttagtatctagacaaatgaatagctagagagccgagacaggctgtgtagttactgtgtcaaggagagtggggaggggtgtgngtcgtaaggg

SEQ ID NO: 256448 - DNA, 587 bp, Homo sapiens
  misc_feature: GYAE6OF01EW02H.14.55.E11.1.454.CMB.1.raw
  modified_base (297)..(297): a, c, t, g, unknown or other
  misc_feature (297)..(297): n is a, c, g, or t
  modified_base (449)..(449): a, c, t, g, unknown or other
  misc_feature (449)..(449): n is a, c, g, or t
  modified_base (463)..(463): a, c, t, g, unknown or other
  misc_feature (463)..(463): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgacactctctgtgcaacgtctggattcagtcttcagtagttatggcatgcacgtgggtccnccgaggcctccgaggccgaagggggctaggggaggttggggtggcgtaggtttggtggtggtatggaacggtaagtaaataggaaagtatcggaccgacgcggtgaacgggccgatcaccatctaccagagacaacttaccaacacatgttntatctgacaaagtnaaatacgtacctaggaagacggaccgaggaccgacggtccgttagtagttaacgttacgttgttacggtcgaaggtagtacgggttagggggtaggggggttggtacggtaagtccggtaaggg

SEQ ID NO: 256449 - DNA, 536 bp, Homo sapiens
  misc_feature: GYAE6OF01BCTGA.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggcctccaggcgaagggggctgggagtggggtggcaggttgtgtgggtatggacggaagtaatagaaagtatgcccgacggccgtaggaagggccgattcacatctccagacgacaattacccaacaaacatgttagtactctagacaaatgaatagcctagagagccgaggacacggctgtgttacttacgtggtcgtcaggagaggtggggagggggtggtggtgtcgtaaggg

SEQ ID NO: 256450 - DNA, 650 bp, Homo sapiens
  misc_feature: GYAE6OF01BI2QQ.14.55.E11.1.454.CMB.1.raw
  modified_base (180)..(180): a, c, t, g, unknown or other
  misc_feature (180)..(180): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccagccgtgggacgtccctgacactctcctgtgcaacgtctggattcagtcttcagttagttatggcagtgctacgttcgggtcccgccgaggcctccgagggcgaaggggctgggaggtgggtcggcgtaggttggtaggtggtagtaggaacggaaagttaagtaaggaaagttgcggacccgtaacggccggtaggaacgggtccgtaattcccgaacctactaccgtaccgaagaacgtaacctaacttacccaaactaaccgtagtttggttactacttcgtagtaacaaagttgtaaactacgtaccgtaggaacgtacggacccggtaaggaccgtacggtcttacggttagttaacttacgtggttacgacgtaagggaggtaggtagggggtaggggttggtaggtacgtacgg

SEQ ID NO: 256451 - DNA, 757 bp, Homo sapiens
  misc_feature: GYAE6OF01CXJWM.14.55.E11.1.454.CMB.1.raw
  modified_base (172)..(172): a, c, t, g, unknown or other
  misc_feature (172)..(172): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctgggtggagtcgtgggggaggcgtggtccagccgtgggacggtccctgacactctcctagtgcaacgtctggacttcgagtcttcgagttagttatcggcatgccacggtcgggtcccgccgaggcctaccgagggccgaaggggctgggacggtggggtaggcgtaggttggtggttaggtagtaggaacggtaaagtaagtaacggaaagttacggtacggacccggaacggtcccgttaaggggaaccgggtacccgtaacgttacccgaacccgtaacgttaccccgtaccggtaacggaacgaacccgtaaactttaacccgaaaccgtaaccgtagttacgtttacgttacttacgtaagtaaccgtaaagttacggtaaacgttacgaacccggttacggaacgggtaacggaaccgggtaaccgggtaaccgtaccgggtaccggttggtttacgttaacgtttaaccggttaggttacggttacgtaacgggtaagggtaagggttacgggggtaggggggtacgggttacgggtaaggtacccggttaaaggg

SEQ ID NO: 256452 - DNA, 513 bp, Homo sapiens
  misc_feature: GYAE6OF01DFVES.14.55.E11.1.454.CMB.1.raw
  modified_base (178)..(178): a, c, t, g, unknown or other
  misc_feature (178)..(178): n is a, c, g, or t
  modified_base (351)..(351): a, c, t, g, unknown or other
  misc_feature (351)..(351): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
  modified_base (476)..(476): a, c, t, g, unknown or other
  misc_feature (476)..(476): n is a, c, g, or t
tcagcgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggttttcctcgttgcttcttttaagnggtgtccagtgtcaggtgcagctggtgagtctgggggagcgtggtccaggcctggggagtccctgaccactctcctgtgcaacgtctggattcagcttcagtagttatggcatgcacgtgggtccgccaggcctccgaggcgaagggggctgggaggtgggtggctaggttgngtggtatgacggaagtaatagaagtagtgccgacgccgtgaacgggcatcacntcncagnacatccaanacatgtntatcngacaatgaatagctgagagcgagcacggctgtgtagttacgtgngtcgaagtgagtggggaaggggttgagtgtcgtaagg

SEQ ID NO: 256453 - DNA, 661 bp, Homo sapiens
  misc_feature: GYAE6OF01DCJ0A.14.55.E11.1.454.CMB.1.raw
  modified_base (291)..(291): a, c, t, g, unknown or other
  misc_feature (291)..(291): n is a, c, g, or t
  modified_base (411)..(411): a, c, t, g, unknown or other
  misc_feature (411)..(411): n is a, c, g, or t
tcagcgtctagtaccacgaccggtgctcgatttagcactcgcacgttgggtttggggagtctcagtcaggacacagcatggacatgagggtccccgctcagctccgtggggctcctgctactctggctccggaggtgccagatgtgacatccagatcgacccagtcctccatccctccctgtctgcatctgtaggagacagagtcaccatcacgttgccgggacaagtcagagactaattaaagaacttatttaaaagttggtaatacaaacaagaaaccgaggggaaacncccctagacctcctagatctatgctagcactcctagtttcgctacgtacggtcggggtcccgtactaaggttcaggtggcgaggtaggagtcggtagggactaggtactttacaccttcnccgtaccgtcgaacgtctaacgtcgtacgaactaaaccgtagtaaacgttatttacgaaccttaaactttaaccgtacgttcgtaactaacgtagtaacggttaacccaacccgtttaacccccctacgttaccgtttacccgggacgggaaccgggaccggtaaacgggcggtaacgacgtacgaacggtaaccgtaacgtcggtacgggcctgacctaccgattaccgttacgttcccgttctacccg

SEQ ID NO: 256454 - DNA, 579 bp, Homo sapiens
  misc_feature: GYAE6OF01BE3IT.14.55.E11.1.454.CMB.1.raw
  modified_base (304)..(304): a, c, t, g, unknown or other
  misc_feature (304)..(304): n is a, c, g, or t
  modified_base (387)..(387): a, c, t, g, unknown or other
  misc_feature (387)..(387): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgacactctcctgtcgcaacgtctggattcagcttcagttagttatggcagtgccacgtgggtcccnccgaggcctaccgagggcgaagggggctgggaggtggggtgcgtaggttgtggtggtatggaacggaagtaagtaggaaagtntcggacccgtacgtccggtaggaaacgggcccgtagttccacctactcctaccgaagaacgacaacttacccgaagaaccacgcagtactcgtagacaatacgaacacgaccgtagagacgcaggacgacgacggctaggtacgtagttacgtgggtagggagaggagtgggaggtagtattagttggtagg

SEQ ID NO: 256455 - DNA, 510 bp, Homo sapiens
  misc_feature: GYAE6OF01EI0TK.14.55.E11.1.454.CMB.1.raw
  modified_base (503)..(503): a, c, t, g, unknown or other
  misc_feature (503)..(503): n is a, c, g, or t
  modified_base (507)..(507): a, c, t, g, unknown or other
  misc_feature (507)..(507): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaatggtatcaacagaaaccaggaaagcccctgacctcctgatctatgctgcatccagtttgctacgaggtcggggtccctacgaaggttcagtggacaggtggatcgtgggactagtatttcactctcaccgtcagcagtctcgacaactgtaagtatttgactaacttactactgtacaacagtacttacaccgtaccccctctaccgtttcggcggacggaccgaggtcgagatacagacgagtgtgctgacacatctntctntac

SEQ ID NO: 256456 - DNA, 640 bp, Homo sapiens
  misc_feature: GYAE6OF01CFEMY.14.55.E11.1.454.CMB.1.raw
  modified_base (284)..(284): a, c, t, g, unknown or other
  misc_feature (284)..(284): n is a, c, g, or t
  modified_base (305)..(305): a, c, t, g, unknown or other
  misc_feature (305)..(305): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagagatgtccagtgtcaggtgcagctggtggagtcgtgggggagcgtggtccagccgtgggacgtccctgacactctcctgtgctaacgtctggattcagtcttcagtagttanggcagtgcacgttcgggcccncaggcctccgaggcgaaggggctgggagtgggtgctaggtttgtgtaggtagtaggaacggtaaagtaagtaaggtaaagttcgtcggacccggtacggccgggtagggaaccggggtccgtaacgttaccgaccgtactaccgtaccgaaggtaacgtaactaacttaacccaaacgtaactagttagttagtacgttactagaacgtaaagtaagtaagtacgtaccgtagtaacggacggaccggaacggaccgtacggtcgtagttacgttaacgttacgtaggttcgtacgagtaggtaggtaggggtagggggttggtaggtagtacgg

SEQ ID NO: 256457 - DNA, 671 bp, Homo sapiens
  misc_feature: GYAE6OF01EUTIP.14.55.E11.1.454.CMB.1.raw
  modified_base (282)..(282): a, c, t, g, unknown or other
  misc_feature (282)..(282): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagactaattaagaacttaatttaaagttggtaatacaaacaagaaaccaagggaaacncccctagacctcctagactctatcgctgcatcctagtttcgactacgtaggttccggggtacccgttacgaacgggtttcaaggttcggacgtaggtggtacgtcgtaggggactagtactttcgacttcctaccgaccgtacacgtcgtacgtctacgtacctaaaccgtagtaacgttaacttttacgtaaccttaaaccgtttaactaaccgtttacgtaacctaacgtaacgtaacgtttaaccgtaacccgttaccccccgtacgttaccgttaccgggacggtaccgggaaccgaacgggacggaagacgtacgaacgtaccggtaagttcggtcggacgtaccgaccgtaaccgtactaccgtttcgttcgttccgtacccg

SEQ ID NO: 256458 - DNA, 746 bp, Homo sapiens
  misc_feature: GYAE6OF01AR7TN.14.55.E11.1.454.CMB.1.raw
  modified_base (307)..(307): a, c, t, g, unknown or other
  misc_feature (307)..(307): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgacactctcctgtcgcaacgtctggattcagtcttcgagttacgttatggctatgccacgtcgggtcccncgaggcctccgaggcgaaggggctgggaggtgggtgcgtaggttggtggtaggtagtggaacggtaaagttaagtaaggtaaagttagtcgggacccggtaacggtcccggttaagggaaaccgggggtcccgtaacgtttacccgaacccgtaacgttcccgtaacccggaaacggtaaaccggtaaacccttaaaaccgtttaacccccgaaaacgtaaaccgttaacgtttacggtttacgttaaactttccgtaacgtaaacctaaaagttcgtaaaacgtaccggtacccgttaagggaaacggtaaccgggtaacccgggaacgggtaacccgaccgggttacgttaggttacggttaacgtttacgtggttacgtacggaaggtaagggtaggtagggggtagggggttaggtacggtacgtcgggtaaggg

SEQ ID NO: 256459 - DNA, 549 bp, Homo sapiens
  misc_feature: GYAE6OF01E3MNY.14.55.E11.1.454.CMB.1.raw
  modified_base (270)..(270): a, c, t, g, unknown or other
  misc_feature (270)..(270): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactattaaattggtatcaacagaaaccagggaaacncccctgacctcctgatctatgctgcatcctagttttgcacgaggttcggggtccctacgtaaggttcaggtggcaggtggactcgtgggactagtatttcgacttctacgaccgtcagcagtctgactaaccgtagtaagtatttcgactaacttactactcgtacaacagtacgttaccaaccgttaccccctctaccgtttaccggcggacggaccgaacggcggagactacgaagacgtacgtggtcgcgtgaccacctatactcgttctctaccg

SEQ ID NO: 256460 - DNA, 588 bp, Homo sapiens
  misc_feature: GYAE6OF01ELA06.14.55.E11.1.454.CMB.1.raw
  modified_base (268)..(268): a, c, t, g, unknown or other
  misc_feature (268)..(268): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcaattaagaactatttaaatggtatcaacagaaaccagggaancccctgacctcctgatctatgctgcatcctagtttgcacgaggtcggggtaccctacgaaggtttcagtggcagtggatcgtgggacagtatttcacttctcaccgtcagcagtctcgacaacctagtaagtattttagactaaactttactacttacgtacaacgtagtaacgttaaccgaccttacccccctcgttaaccgtttccgggacgggtaacgggaacccgtaaagggccggaaacgtacgtaccgaacggaaccgtaacgtaggtcggaccgtacgaccctacctaacgttcctcgttcccttcgtacccg

SEQ ID NO: 256461 - DNA, 543 bp, Homo sapiens
  misc_feature: GYAE6OF01BNK0H.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaatggtatcaacagaaaccagggaaacgcccctgacctcctgatctatgctgcatccagtttgcacgaggtcggggtcccgtacgaaggttcagtggcaggtggatcgtgggacagtatttcacttctacaccgtcacgcagtctgactaaccgtagtaagtatttcgactaacttactactagtacaactagtagttaccacgtaccccctactaccgtttccggacggacgggaccaagggcggacgacgtacgaagaccgtaacgtggtcggctgacctaccattctgttcttctacc

SEQ ID NO: 256462 - DNA, 711 bp, Homo sapiens
  misc_feature: GYAE6OF01CO05V.14.55.E11.1.454.CMB.1.raw
  modified_base (172)..(172): a, c, t, g, unknown or other
  misc_feature (172)..(172): n is a, c, g, or t
  modified_base (176)..(176): a, c, t, g, unknown or other
  misc_feature (176)..(176): n is a, c, g, or t
  modified_base (322)..(322): a, c, t, g, unknown or other
  misc_feature (322)..(322): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagnggtntccagtgtcaggtgcagcgtggtggagtcgtggggggagcgtggtccaggccgtggggacgtccctgacactctccgtgtgactaacgtcgtggattcgagtcttacaggttagttagtggactagtcgacctacgtcgggtcccnccgaggtcctaccggagggcgaaggggtctggggagggttggggtcggcgtaggtttggtaggttagggtaacgtagggaaacggtaaaagtaaaggtaaggtaaaagttacggtaccggacccgggtaaccgggtcggtaacgggtaaccgggggtaccctaacgtttacccgaaccgtacgtttccgtaacccggaaggtaaccgtaaacccttaaaacgttacccaaaacgtaacgttagttacggttagtactactagaactaaagtcgtaaacgtcgaccgtaggaacgacgaccggaagaccgacggtctaggttattacgtcgtggtactcggaagggtaggtagggttacggggggagggttgaggtacgtacggtaaggg

SEQ ID NO: 256463 - DNA, 520 bp, Homo sapiens
  misc_feature: GYAE6OF01EWUF2.14.55.E11.1.454.CMB.1.raw
  modified_base (371)..(371): a, c, t, g, unknown or other
  misc_feature (371)..(371): n is a, c, g, or t
  modified_base (433)..(433): a, c, t, g, unknown or other
  misc_feature (433)..(433): n is a, c, g, or t
tcagcgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccagcctgggagtccctgacactctcctgtgcaacgtctggattcagcttcagtagttatggcatgcactgggtccgccaggctccaggcaaggggctgggagtgggtggctaggttgtgtggtatgacggaagtaatagaaagtntgccgacgccgtgaagggccgatcacatctcagagacaattaccaacaacatgttgtatctnactaaatgaatagcctagagagcgaggacacggctgtgtattacgtgtgtcagagagtggggagggggtggtggtagtccgtaaggg

SEQ ID NO: 256464 - DNA, 904 bp, Homo sapiens
  misc_feature: GYAE6OF01DL7RA.14.55.E11.1.454.CMB.1.raw
  modified_base (253)..(253): a, c, t, g, unknown or other
  misc_feature (253)..(253): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagccgtgggacgtcctgacnctctctgtgctacgtctggattcagtccttacgagttacgttagtcggactagttcgacgtaccggttcggggtccccgccgaacggggtcccttaccccggaagggacccggtaaacggggggtccgttagggggtaacgggttgggggtacgggtaccggtaagggttttggtgggtaggggtaagttacgggaaacgggtaaaggtttaaagtaaaggtaaaagttcgtaccggacccgggtaaccggtacccgggttaaggggaaccggggtacccgtaacgtttacccgaaccccgttaccgttaacccgttaacccgaaagggtaaaccgtaaacccgttaaaaccgttttacccccgaaaaacgttaaacccgttaaggtttacgttttaacgggttaactttaccccgttaaggtaacccgttaaaaaggttcgtaaaaaccgttacgggttaacccgtaacggggttaaacggaacccgggttaacccggggaaaccgggtaacccggtaacccggggttacccgttttaaggggttaaccgttttaaacgtttaaccgggtttcgggttacggtaaccggtaaagggtaacggttaggggttacgggggggtaagggggtttggtacgggttaaacccggg

SEQ ID NO: 256465 - DNA, 677 bp, Homo sapiens
  misc_feature: GYAE6OF01D6IQC.14.55.E11.1.454.CMB.1.raw
  modified_base (251)..(251): a, c, t, g, unknown or other
  misc_feature (251)..(251): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgcttcttttaagaggttgtccagtgtcaggtgcagcgtgggtggagtcggtggggggagcggtggtccagccgtgggacgtccctgaccnctctcctgtgactaacgtctggacttcgagtccttcagttagttatggactagtgcctacggttcggggtcccgccgacggtcctacccggagggccggaaagggggtcgtaggggagggttggggtggtacgtaggtttggtggtgggttagtagggaaacggtaaagtaaagtaaaggtaaaggtacgtacgggacccggaacggtccggtagggaacgggtccgtacttaccgaacctacgtcctaccgaagaacgaactaacttaaccaaacaactatagttagtactcgtagtactaagtagtaactacgacgtaggaacgacgaccggacggtacgacgggtctaggttacgttacgttacgtggttgtacgaggtaagtagggtagggggtagggggttagtaggtcgtacggtaaggg

SEQ ID NO: 256466 - DNA, 556 bp, Homo sapiens
  misc_feature: GYAE6OF01CDGYR.14.55.E11.1.454.CMB.1.raw
  modified_base (172)..(172): a, c, t, g, unknown or other
  misc_feature (172)..(172): n is a, c, g, or t
  modified_base (240)..(240): a, c, t, g, unknown or other
  misc_feature (240)..(240): n is a, c, g, or t
  modified_base (301)..(301): a, c, t, g, unknown or other
  misc_feature (301)..(301): n is a, c, g, or t
  modified_base (336)..(336): a, c, t, g, unknown or other
  misc_feature (336)..(336): n is a, c, g, or t
  modified_base (376)..(376): a, c, t, g, unknown or other
  misc_feature (376)..(376): n is a, c, g, or t
  modified_base (404)..(404): a, c, t, g, unknown or other
  misc_feature (404)..(404): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttctttaagnggtgtccagtgtcaggtgcagctggtggagtcgtgggggagcgtggtccagcctgggagtccctgacnctctcctgtcgcaacgtctggattcagtcttcagttagttatggcatgcacgtcgggtccncaggctccgagggcaaggggctagggagttggggngctaggttggtgtggtatgaacggaataataggaaagttncgaccgagcgtaggaagggccattcacntactcagagaactaactaccaacaacatgttagtatctagacaaatgaatacgctagaacgtagaccggagacgacggtcgtagttgtactttacgtagtcggtacgaagtaggacggttaggggtaggggtagtagtacgttcgtaaaggg

SEQ ID NO: 256467 - DNA, 627 bp, Homo sapiens
  misc_feature: GYAE6OF01ETMBW.14.55.E11.1.454.CMB.1.raw
  modified_base (377)..(377): a, c, t, g, unknown or other
  misc_feature (377)..(377): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtggggggagcgtggtccagcctgggagtccctgacactctcctgtgcaacgtctggattcagtcttcagtagttatggcatgcacgtgggtccgccaggcctccgaggcgaaggggctgggagtgggtgctaggttgtggtggtatggaacggtaagtaataaggaaagtntcggacccgaacggcccggtaggaacgggtcccgtaattaccgaaccctatccgtaccgaaggaacgaacctaaacttaacccaaactaaactagttagtttagttaactcgtagaactaaagtacgtaaactacgccgtaggaacggacggacccggaaggaccgacggtcgttacgtagttacgttacgtgttacgtacaaggtaggtaggtaggggtacgggggttggtcggtagttccggtaaggg

SEQ ID NO: 256468 - DNA, 621 bp, Homo sapiens
  misc_feature: GYAE6OF01DVF9F.14.55.E11.1.454.CMB.1.raw
  modified_base (181)..(181): a, c, t, g, unknown or other
  misc_feature (181)..(181): n is a, c, g, or t
  modified_base (312)..(312): a, c, t, g, unknown or other
  misc_feature (312)..(312): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagctgggttttcctcgttgcttcttttaagnggtgtccagtgtcaggtgcagctggtggagtcgtgggggagcgtggtccagccgtgggagtccctgacactctcctgtgcaacgtctggattcagtcttcagttagttatggctatgctacgtcgggtccnccgaggcctccgaggcgaaggggctgggagtgggagcgtaggttggtggtgggtataggaacggtaaagtaaagtaaggaaagttgtcggacccggacggccggtaggaacggggtccgtacgttaccgaccgtacgttccgtacccgaagaacgtaacctaaaccttacccaaactaacgtattgttagtaactcgtagaactaaatagaatacggtcctaggagacgacggacggaccacggtactaggttagttacttacgtggtcgtacgaggagtagggtaggggaggggttgtagtcgtacgg

SEQ ID NO: 256469 - DNA, 533 bp, Homo sapiens
  misc_feature: GYAE6OF01CBJS4.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatatatgctgcatccagttttgcacaggtcggggtccctcgtaaggttcagtggcagtggatcgtagggacagtatttacgactctcaccgtcagcagtctgcaacctgaagtatttcgactaacttactactagtacaacagtacgttaacacgtaccccctctacgttcggacggacgggacaacggcggagactacgaggtacgaacgtggtcggcgtcgacacctactctcggttcttcgtaccg

SEQ ID NO: 256470 - DNA, 613 bp, Homo sapiens
  misc_feature: GYAE6OF01B3EI1.14.55.E11.1.454.CMB.1.raw
  modified_base (308)..(308): a, c, t, g, unknown or other
  misc_feature (308)..(308): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggacgtccctgacactctcctgtgcaacgtctggattcagcttcagtagttatggcatgcacgtcggggtccnccgaggcctccgaggcgaaggggctgggagtggggtggcgtaggttgtgtggtatggacggtaaagtaataagaaagtagtcggaccgacggcccggtaggaacggggtcccgtaagttcccaaccgtatcccgtacccgaagaacgaacctaaacttacccaaactaactattacggttagtacttctagactaaagtagtaatacgcctaggagacggaccgaaggacgacgggcttaggtagttacgttacgtggtcgtacgaaggagtaggtggggaagggggttggtggtacgtaccggg

SEQ ID NO: 256471 - DNA, 547 bp, Homo sapiens
  misc_feature: GYAE6OF01BZWD3.14.55.E11.1.454.CMB.1.raw
  modified_base (325)..(325): a, c, t, g, unknown or other
  misc_feature (325)..(325): n is a, c, g, or t
  modified_base (410)..(410): a, c, t, g, unknown or other
  misc_feature (410)..(410): n is a, c, g, or t
  modified_base (436)..(436): a, c, t, g, unknown or other
  misc_feature (436)..(436): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcattaagactatttaaatggtatcaacagaaaccaggaaacgcccctgacctcctgatctatgctgcatccagtttgcacgtaggtcggggtacccgtanaagggttcaggtggcaggtggaactcgtagggaactagtacttttcacttcctcgaccgtcagcagtctagcaaccgtgaagttntttagactaacttactactgtacaanacgtacgttacaccgtaccccctagtaccgtcggacggacggacgaaggacggatacgacgacgaacgtagtcggtcgactcgacctactacgtacttcgttctgtacccg

SEQ ID NO: 256472 - DNA, 544 bp, Homo sapiens
  misc_feature: GYAE6OF01B480C.14.55.E11.1.454.CMB.1.raw
  modified_base (271)..(271): a, c, t, g, unknown or other
  misc_feature (271)..(271): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaacncccctagacctcctgatctatgctgcatccagtttgacacgaggtcggggtcccgtagaaggttcaggtggcaggtggatcgtgggacaggtactttcacttctcaccgtcacgcagtctgacctaacgtagaagtatttcgactaacttactactgtacaactagtagttaccaccgttaccccctctaccgtttcgggacgggtacggaccgaagggcggagactacgacgacgacgtggtcggctcgactacctatctcgtctcgtaccg

SEQ ID NO: 256473 - DNA, 562 bp, Homo sapiens
  misc_feature: GYAE6OF01C9DVM.14.55.E11.1.454.CMB.1.raw
  modified_base (246)..(246): a, c, t, g, unknown or other
  misc_feature (246)..(246): n is a, c, g, or t
  modified_base (387)..(387): a, c, t, g, unknown or other
  misc_feature (387)..(387): n is a, c, g, or t
tcagcgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggagtccctgacnctctcctgtgcaacgtctggattcggcttcagtagttatggcatgctacgtggggtcccgccgaggcctccgagggccgaagggggctgggaggtggggtggctaggttgtggtggtatggaacggaagtaatagaaagtntcgaccgacgccggtgaacgggccatcaccactctccagagacaacttaccaacaactatgttgtatctagactaatagaatacgacctagacgaggacccgaggacgacggctgtgttattacgtggtgtacgaggagaggtggggtagggggtggtaggacgtccgtaggtag

SEQ ID NO: 256474 - DNA, 618 bp, Homo sapiens
  misc_feature: GYAE6OF01DD308.14.55.E11.1.454.CMB.1.raw
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
  modified_base (381)..(381): a, c, t, g, unknown or other
  misc_feature (381)..(381): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtggggggagcgtggtccagccgtgggagtcccctgacactctcctgtgcaacgtctggattcagtcttcagtagttanggcatgcacgtgggtccnccgaggcctccgaggcgaaggggctgggagtgggtgctaggttgtggtggtatggaacggtaagtaataaggaaagttntcggacccgacggtccggtaggaacgggtccgtattaccacctatcctaccgaagacgaacctaacttacccaactaactagttgttacgttattcgtagaactaaagtacgtaatacgacctaggacgacgaccggaggaccgacggtcgtaggttagttaacgtttacgtggttacggtacgaaggtaaggtagggttgggggtacggggggttggtacggacgttcggtaaggg

SEQ ID NO: 256475 - DNA, 660 bp, Homo sapiens
  misc_feature: GYAE6OF01EKG7V.14.55.E11.1.454.CMB.1.raw
  modified_base (387)..(387): a, c, t, g, unknown or other
  misc_feature (387)..(387): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcgtggttttcctcgttgctctttaagaggtgtccagtgtcaggtgcagctggtggagtcgtgggggagcgtggtccagccgtgggacgtccctgacactctcctgtcgcaacgtctggattcagtcttcagttagttatggctatcgctacgtcgggtcccacgtaggcctccgaggcgaaggggtctgggaggtgggtgctaggttgtggtggtatggaacggtaagtaagtaagtaaagtntacggccggtaacgtccggtagggaacgggtccgtattaccgacctactcgtacccgaaggaacgtaactaacgttacccaaactaaactagttacgtttagtacttacgtacgaactaaagtacggtaatacggtaccttaacgggaacgtacggaccggaacggtactaaccgggtcttaggtagtttaacgttacgttggtacgtaccgtaaggtaaggttacgggtacggggggttaagggggttggtacgttacggtaccggtagggg

SEQ ID NO: 256476 - DNA, 659 bp, Homo sapiens
  misc_feature: GYAE6OF01BWRLO.14.55.E11.1.454.CMB.1.raw
  modified_base (172)..(172): a, c, t, g, unknown or other
  misc_feature (172)..(172): n is a, c, g, or t
  modified_base (308)..(308): a, c, t, g, unknown or other
  misc_feature (308)..(308): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagngtgtccagtgtcaggtgcagctggtggagtcgtgggggagcgtggtccaggccgtgggacggtccctgacctactctccgtagtgcaacgtctggattcagtcttcagtagttatggcatgctacgtcgggtaccnccaggctcgaggcgaaggggctgggaggtgggtgcgtaggttggtggtggtatgggaacggtaaagtaagtaaggaaagtagtcggaccggacggtaccgtaggaacggggccgtaattccgaacctagtcctaccgaagtaacgaacctaaacgttaaccgaaactaacgtattagttagtactacgtagtaactaaagtcgaaatccgaccgtaggaacgacggtaccggaacggaaccgtacgggttacgtacggtttacgttacgtttaacgtggttagtaaccggaaggtaacggtacgggttaggggggtacgggggttggtaacggttaccgttcggtaaaggg

SEQ ID NO: 256477 - DNA, 542 bp, Homo sapiens
  misc_feature: GYAE6OF01AZ8UH.14.55.E11.1.454.CMB.1.raw
  modified_base (172)..(172): a, c, t, g, unknown or other
  misc_feature (172)..(172): n is a, c, g, or t
  modified_base (240)..(240): a, c, t, g, unknown or other
  misc_feature (240)..(240): n is a, c, g, or t
  modified_base (373)..(373): a, c, t, g, unknown or other
  misc_feature (373)..(373): n is a, c, g, or t
  modified_base (533)..(533): a, c, t, g, unknown or other
  misc_feature (533)..(533): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtctgggggagcgtggtccagcctgggaggtccctgacnctctcctgtgcaacgtctggattcagcttcagtagttatggcatgcacgtgggtcccgcaggcctccaggccgaaggggctgggaggtgggtggcaggttgtgtggtatggaacggtaagtaataggaaagtntcggaccgacgccggtaggaacgggccgtattcactatctcagacacaataccaacaacattgttgtatcgtagactaatgaagtacgccgttagagacgaccggaggaccgacggctgtagtattacgtgtagtcgagtagagtagggaggggtgtggngtcgtaggg

SEQ ID NO: 256478 - DNA, 623 bp, Homo sapiens
  misc_feature: GYAE6OF01C6QNH.14.55.E11.1.454.CMB.1.raw
  modified_base (180)..(180): a, c, t, g, unknown or other
  misc_feature (180)..(180): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccagcctgggagtccctgacactctcctgtgcaacgtctggattcagcttcagtagttatggcatgcacgtgggtccgcaggctccgaggcgaaggggctgggaggtggggtggctaggtttggtggtggtagtggaacgggaagtaaataggaaagtgtggacccgacgtcccggtaggacggggccgtattccacctatacgtccaagacgtaacaacttacccaaacaaactatagttagtaactcgtagaactaaagtagtaaacgtagtaccgtaggaacgtaacggccggaacgggtaaccgacgggtcgttagggttacgttaacgtttacgttggttacgtacgaagtaggtagggtagggggtagggggttggtggtacgtaacggg

SEQ ID NO: 256479 - DNA, 717 bp, Homo sapiens
  misc_feature: GYAE6OF01AL9FC.14.55.E11.1.454.CMB.1.raw
  modified_base (176)..(176): a, c, t, g, unknown or other
  misc_feature (176)..(176): n is a, c, g, or t
  modified_base (210)..(210): a, c, t, g, unknown or other
  misc_feature (210)..(210): n is a, c, g, or t
  modified_base (314)..(314): a, c, t, g, unknown or other
  misc_feature (314)..(314): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccagtggaggtttgggctgagcttgggttttcctcgttgcttcttttaagnggtgtccagtgtcaggtgcagctggtggagtcgngggggagcgtggtccagccgtggggacgtccctgaccacttctcctgtcgactaacgtctggatttcagtcttcagttagttatggcatgcacggtggggcccnccaggcctccggaggcgaaggggtctagggagttggggtgcgtaggttgtggtgtatgggaaacggtaatagtaagaagtgtacgccggacgcggtagggaacgggtccgtattaccacgtatcctaccgaaggaaccgtaaccgtaaactttaccccgaaacctaaacgtacgtttacggtttacgttaacctacgttaacgtaaacgtaaacgttaaggtaaacgttacggtaacccgttagggaaacggtaccggtaacccgggaacgggtaacccggtaccgggtacggttaacggttaacggttaaccgttttacgttagggttaacggtaccggtaaaggtaacggtagggttaagggggtacggggggtaggttacggtacggtaccgttaacggg

SEQ ID NO: 256480 - DNA, 526 bp, Homo sapiens
  misc_feature: GYAE6OF01EIUO5.14.55.E11.1.454.CMB.1.raw
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
  modified_base (513)..(513): a, c, t, g, unknown or other
  misc_feature (513)..(513): n is a, c, g, or t
  modified_base (521)..(521): a, c, t, g, unknown or other
  misc_feature (521)..(521): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggnaagtcagngcattaagaactatttaaatggtatcaacagaaaccagggaaagcccctgacctcctgatctatgctgcatccagtttgcactaggtcggggtcccgtacgaaggttcaggtggcaggtggatcgtgggacagtattcactctcacgtcagcagtctgctaacctgtaagtattttagactaacttactactgtacaacagtagttacaccgtaccccctcgtacgtttcggacggacgggacaagggcggaagatacgagaacgtaacgtgtcggctgaccactactntcgtcttntaccg

SEQ ID NO: 256481 - DNA, 784 bp, Homo sapiens
  misc_feature: GYAE6OF01A8D18.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagctaattaagaactaatttaaattggtatacaacaagaaaccaggaaacgcccctagaccctcctgatctatgctgcatcctagtttcgactacgtacggttcgggtacccgtcgtaaacgggtttcgaaggttcgggccgtaaggttcgggtaagttaccggttaggggaaaccttagggttaaactttttcccgaaacctttcccgttaccgtaacccggttcctaacggtaccttaccggttacgtacggtacccgtaaaccgttaaggtaaacgtttaacgttttacggtaaacctttaaaccgttttaacccttaacgtttacgtaaccgtaaaccgtaacggttaacgttaacccgtaacccggttaaccccccccgttacgttaaccccggtttaccggggtaccggggaaccggggaacccgtaaacggggaccggtaaacgggtaaccgttaaccggaacggtaaacccggtaacggttacgggtcggtacccggttacgaaccccgtaacccgttaacgttaccgtttcggttaccctttcggttaacc

SEQ ID NO: 256482 - DNA, 562 bp, Homo sapiens
  misc_feature: GYAE6OF01DU8FL.14.55.E11.1.454.CMB.1.raw
  modified_base (276)..(276): a, c, t, g, unknown or other
  misc_feature (276)..(276): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcccccctgtctgcatctgtaggagacagagtcaccatcacttgccggacaagtcagagcattaagaacttaatttaaattggtaatcaaacagaaaaccagggaaacnccctagacctcctgatctatgctgcatcctagtttgacacgaggtcgggtaccctagtaaggttcagtggcaggtgatcgtgggacagtattcactctacacgtcagcagtctcgacaactgaagttatttcgactaacttactactacgtacaacgtagtacgttaccgtaaccttaccccctagttaccgtttcggacgggaacggtaccgaggacggacgtacgtcaacggacgtaacgtgtcggtcgcgacctacgtacttactcgttcttcgtcttccccg

SEQ ID NO: 256483 - DNA, 570 bp, Homo sapiens
  misc_feature: GYAE6OF01D3Z8U.14.55.E11.1.454.CMB.1.raw
  modified_base (396)..(396): a, c, t, g, unknown or other
  misc_feature (396)..(396): n is a, c, g, or t
  modified_base (507)..(507): a, c, t, g, unknown or other
  misc_feature (507)..(507): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttggccgggacaagtcagagcaattaagaactaatttaaattggtatcaacagaaaccagggaaacgcccctagaccctcctgatcgtatgctgccagtccagttttcgacacgtaggtcggggtcccgtagtaaacggtttcaggtggactaggtcggatcggtggacagtattcactctacaccgtnagcagtctagactacgtagaagtatttgactaacttactatacgtacaacgatacgttaaccaccgttaccccctataccgttcgggacggacgggaccgaacgggcgganacgtacgaaggacgtacgtggtcggcctcgacccgtactaacgttcgtacgttcttctacccg

SEQ ID NO: 256484 - DNA, 678 bp, Homo sapiens
  misc_feature: GYAE6OF01ER6YW.14.55.E11.1.454.CMB.1.raw
  modified_base (245)..(245): a, c, t, g, unknown or other
  misc_feature (245)..(245): n is a, c, g, or t
  modified_base (288)..(288): a, c, t, g, unknown or other
  misc_feature (288)..(288): n is a, c, g, or t
  modified_base (307)..(307): a, c, t, g, unknown or other
  misc_feature (307)..(307): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtccctgaccnctctcctgtcgccaacgtctggattcagtcttcagttagttanggcatgcacgtgggtcccncgaggcctccgaggccgaaggggctgggacgtggggtcggctaggtttggtggttgggtaatcgggaaacgggtaaagttaagtaaggaaaagttagtcggacccggacggtccggtaggaacggggcccgtacttacccgaacctacgtcctaccgtaagaacgaacctaaacgttaacccaaactaaacctagttagtttacgttacttacgttacgaacctaaagtaacgtaaacgttacggacccgttaaggaacggacggacccggaacgggaccgtaccgggtaccgttaggtagttacgttagttcggtaggtacgaggaaggtaggttaggggagggggttaggtcggtacgtccggtaaggg

SEQ ID NO: 256485 - DNA, 877 bp, Homo sapiens
  misc_feature: GYAE6OF01BQTPB.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgaccactctcctgtcgacaacgttctggattcagtccttacgaggttagttatggactatcgcctacggttcggggtccccgaccgacgggtccctacccgaagggaccggaaggggggtcctaggggacgggttgggggtcgacgttagggttggtaggttacgggtaagtagggaaacgggtaaagtttaaagtaaaggtaaacggttacgtcggacccgggtaaccggtcccgggttaagggaaaccggggtcccgtaacgttacccgtaacccgtaacgttacccgtaacccgtaaacggtaaacgtaaacctaaaaccgtttaaccccgaaaaccctaaaccgttaaacgtttacggttttaacggttaaccgtttaaccgttacggtaaaccttaaaagtttaacggttaaaacgttaaccgggtacccgttaacgggaaacgggtaaccgggtaaccccgggtaaacggggtaaacccggtaacccggggtacgtttaccgggtttaacggtttaaacggttttaccgttagggttacggttaaccggtaaagggtaaagggttaacggggttagggggggtaacggggggggttagggttaacgggttaacggttacccgggttaaagggg

SEQ ID NO: 256486 - DNA, 675 bp, Homo sapiens
  misc_feature: GYAE6OF01CCFDN.14.55.E11.1.454.CMB.1.raw
  modified_base (505)..(505): a, c, t, g, unknown or other
  misc_feature (505)..(505): n is a, c, g, or t
tcagcgtctagtaccacgaccggtgctcgatttagcactcgcacgttgggtttgggggaggcgtggtccagcctgggaggtccctgacactctcctgtgcaacgtctggattcagcttcagtagttatggcatgcactgggtccgccaggctccaggcaaggggctggagtgggtgcagttgtgtggtatgacggaagtaatagaaagtatgccgacgccgtgaagggccgattcaccatctccagagacatccaacaacatgttgtatctagacaaatgaatagcctagagacgccgaggaccacggctgtagtattactgtgtacagagagtgggaggggtgtgacgtcgagtatgattgtagtactacgtacgacggttcgtgggtacgtcgtggggacccgaagggtaaccgacgggttaccacccgttctaccctaccgacgtcccgtacccaccgtaaaccgggcccctaacggttcccggttccccgtttccccccgngggtccccctaacccccttaccccgttacccgaaacggtccgtacccgtacccgttaccgggtcgggggaccctaaccgaccgggtccccgggtacccggttcggggacccttccggtacccggttcgtaaccgaacgtacccttacgtttacccgtacgtcggacccgg

SEQ ID NO: 256487 - DNA, 577 bp, Homo sapiens
  misc_feature: GYAE6OF01COBOL.14.55.E11.1.454.CMB.1.raw
  modified_base (220)..(220): a, c, t, g, unknown or other
  misc_feature (220)..(220): n is a, c, g, or t
  modified_base (282)..(282): a, c, t, g, unknown or other
  misc_feature (282)..(282): n is a, c, g, or t
  modified_base (524)..(524): a, c, t, g, unknown or other
  misc_feature (524)..(524): n is a, c, g, or t
tcagcgtctagtaccacgaccggtgctcgatttagcactcgcacgttgggtttggggagtctcagtcaggacacagcatggacatggagggtccccgctcagctcctggggctcctgctactctggctccgaggtgccagatgtgacatccagatgacccagtctccatcctccctgtctgcatctgtaggagacagagtcaccatcacttggccggganaagtcagagcaattaagaacttatttaaaattggtatacaaacaagaaaccgaagggaaacncccctagacctctagactctatcgctgcaatccagtttcgacagtacggttcggggtaccctagtaacggttcaaggtcggacaggtaggactcggtagggaactagtactttacgacttcgtaccacgtcaagcagtctacgactaaccgtagtaacgttatttcgacttaacttactatacgtacaatagtaacgttacaccgtacccctctacgttcggacggtacgacgaaggcgganacgtcgaacgacgtaagtcggtagacgtagactacattactcgtcttctaccg

SEQ ID NO: 256488 - DNA, 887 bp, Homo sapiens
  misc_feature: GYAE6OF01BMLB7.14.55.E11.1.454.CMB.1.raw
  modified_base (313)..(313): a, c, t, g, unknown or other
  misc_feature (313)..(313): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtggtggagtcgtgggggagcgtggtccaggccgtgggacggtccctagacctacgtcctccgtgtcgactaacgtctggactttcagtcctttacgaaggttagtttanggtctaagttcgacctaacggttcggggtaccccgccgaacggggtccctacccgaaggggaccggaaaaggggggtccgttaggggtaaggggttcggggtcgggtaccttaaggggtttggttaggggttacggggttaaagttacgggggtaaaccggggttaaaaagggttaaaacgtttaaaggggtaaaaacgggtttaacgtaccggggtaccccggtaaaccgggtcccgggttaacggggaaaacggggggtcccccgttaacgttttaccccggaaacccgtaaccgtttacccgtaacccggtaaagggaaccgtaaaccgtaaaacctttaaccccgaaaaccgtaaacgtaaacgttttcggttaacgtttaaccgtttacgtaacgttaaccgtaaaagttaacggtaaacgttaccggtacccgttagggaacggtaccggacccgggtaaacgggtaacccgaccgggttacgttacggttacggtttaactttacgtaggttcggtacgaaggtaacgtagggttacggggtaggggttacggtagtacggtaccgg

SEQ ID NO: 256489 - DNA, 708 bp, Homo sapiens
  misc_feature: GYAE6OF01BAA1K.14.55.E11.1.454.CMB.1.raw
  modified_base (246)..(246): a, c, t, g, unknown or other
  misc_feature (246)..(246): n is a, c, g, or t
  modified_base (305)..(305): a, c, t, g, unknown or other
  misc_feature (305)..(305): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagtcttgggttttcctcgtttgcttcttttaagaggtgtccagtgtcaggtgcagctggtggagtcgtgggggagcgtggtccagccgtgggacgtccctgacnctctctgtgcaacgtctggacttcagtcttcgagtagttatggcatgcacgtgggtccncgaggcctcgaggcgaaggggctagggaggtgggtgcgtaggttgtggttggtagtggaacggtaagtaagtaaggaaagtgtacggacccgacggtcccggtagggaacgggtcccgtacgttaccgaacccgtacgtcctacccgaaggaaccgtaaccgtaaaacctttaacccgaaaacctaaaccttaacgttacggtttacgttacgttaccttaaggaaacctaaagttacggtaaaacttacggaacccgttagggaacgggtaaccggtacccgggaaacggaccgtaaccgggtacgtttgggttaacggttacgtttacgttggttaacggtacgaagggtaaggtagggttagggggtacgggggttggtacggtacgttaccggtaaggg

SEQ ID NO: 256490 - DNA, 773 bp, Homo sapiens
  misc_feature: GYAE6OF01CSLU8.14.55.E11.1.454.CMB.1.raw
  modified_base (178)..(178): a, c, t, g, unknown or other
  misc_feature (178)..(178): n is a, c, g, or t
  modified_base (246)..(246): a, c, t, g, unknown or other
  misc_feature (246)..(246): n is a, c, g, or t
  modified_base (706)..(706): a, c, t, g, unknown or other
  misc_feature (706)..(706): n is a, c, g, or t
tcagcgtctagtaccacgaccggtgctcgatttagcactcgcacgttgggctcgtgggggagaggagcccagcactagaagtcgggcggtgtttccattcggtgatcagcactgaacacagaggactcaccatggagtttgggctgagcgttgggtttcctgttgcttcttttaaagngtgtccagtgtcaggtgctagctggtggagtcgtgggggagtcgtggtccaggccgtgggacgtcccngactctctcctgtcgtacaagtcgtggtatcgagtcttacgtagttagttagcggactatcgactacggttcggtccgacgacggtcctaccggagggacggtaacggggtcgttaggggacgggttcggggtcggtacgtaggtttcgggtggttacgggttaaacgtaggggtaaacggtaaaagtaaaacggtaaacggtaaaggttactccgggaacccgacggtaccggtaggggaaaccgggtcccttaacgttacccgacccgtaacgttaccgtaaccgaaaggtaaccgtaaacttaaaccgtttaacccgaaaacttacgttaggttcgttaacgtttacctacgtaagtaaaccgtaaagttaacgaaacgttagtacccgttaaggaacggtaccgggtaaccgggacggaaccgtacggtcgttacggttaacggttaacttacggnggttaacggtacggtaagggtacgtagggtacggggggtagggttaccgtgttaaccggtctaaggg

SEQ ID NO: 256491 - DNA, 643 bp, Homo sapiens
  misc_feature: GYAE6OF01EZFCW.14.55.E11.1.454.CMB.1.raw
  modified_base (290)..(290): a, c, t, g, unknown or other
  misc_feature (290)..(290): n is a, c, g, or t
  modified_base (313)..(313): a, c, t, g, unknown or other
  misc_feature (313)..(313): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtggggggagcgtggtccagccgtgggacgtccctgaccactctcctgtcgctaacgtctggattcagtcttcgagttagttanggcagtcgctacgtggggtcccnccgaggcctaccgagggccgaagggggtctaggggagtggggtgcgtaggttggtggtggtatggaacggtaagttaaagtaaggaaagtgtcgacccggtaacggccgtagggaacgggtccgtattaccaccatcctaccgaagtaacgaacctaacttacccaaactaactagttgtttagtactacgtacgaactaaagtgtaaatacgaccgtaggaacggacgaccggaaggaaccgacgggtcttaggttacgttaacgtttacgtaggttagtacgaggtaagtagggtagggggtagggggttggtagtagtccgtaaggg

SEQ ID NO: 256492 - DNA, 580 bp, Homo sapiens
  misc_feature: GYAE6OF01AWYHO.14.55.E11.1.454.CMB.1.raw
  modified_base (251)..(251): a, c, t, g, unknown or other
  misc_feature (251)..(251): n is a, c, g, or t
  modified_base (313)..(313): a, c, t, g, unknown or other
  misc_feature (313)..(313): n is a, c, g, or t
  modified_base (546)..(546): a, c, t, g, unknown or other
  misc_feature (546)..(546): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagccgtgggagtccctgaccnctctcctgtgcaacgtctggattcagcttcagtagttatggcagtgctacgtcggggtcccnccaggcctccgaggcgaaggggctgggagtggggtgcgtaggttgtggtggtagtggaacggtaagtaagtagaaagttagtcggaccgacgccggtaggaacgggcctagttccacgactccgtaccaagacgtaacctaaacgttacccaaactaacgtattacgtacgtactctagactaagtcgaatacgctagagacgaccggagcacggtctagtgtacttagtcgngtacgagaggtagtggggtagggtgtgtgtacgg

SEQ ID NO: 256493 - DNA, 669 bp, Homo sapiens
  misc_feature: GYAE6OF01DAC1C.14.55.E11.1.454.CMB.1.raw
  modified_base (155)..(155): a, c, t, g, unknown or other
  misc_feature (155)..(155): n is a, c, g, or t
  modified_base (285)..(285): a, c, t, g, unknown or other
  misc_feature (285)..(285): n is a, c, g, or t
  modified_base (312)..(312): a, c, t, g, unknown or other
  misc_feature (312)..(312): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttggctgagctgggttttccncgttgctcttttaagaggtgtccagtgtcaggtgcagctggtggagtcgtgggggagcgtggtccagccgtgggacgtccctgacactctcctgtcgctaacgtctggattcagtcttacagttagttancggactagtcgactacgtcgggtcccncgaggtctccgaaggccgaaaggggtcttagggaggttcgggtcggcgtaggtttcgtaggttaggtaacgtgggaaaccgggttaaagtaaacgtaaggtaaagttacgtacggacccggtacggcccggttaaggaaacgggtccgtaacttccgaacgtacgtccgtaccaaggtaacgaaactaacttaacccaaactaaactagtttacgttacgttaactcgtagaaccgtaaagtgtaacgtacgaccgtagtaagacgaccggagacgtacggtctacgttagtaagttcgtagtacgtacgaggaagttagggtacggggtagggttaggtcgtagtccggttaaggg

SEQ ID NO: 256494 - DNA, 709 bp, Homo sapiens
  misc_feature: GYAE6OF01A1IV2.14.55.E11.1.454.CMB.1.raw
  modified_base (355)..(355): a, c, t, g, unknown or other
  misc_feature (355)..(355): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggagcgtggtccaggccgtggggacgtccctgaccactctcctgtcgcaacgtctggattcagtcttcagttagttatggctagtgctacgtggggtcccacgaggcctccgaggcgaaggggctgggagtgggtgcgtagttgngtggtatggaacggaagtaataggaaagtcgtcggacccgtaggcccggtaggaaccgggtccgtacgttaccaccgtacgtccgtaccgaagacggtaacctaaacgttaacccaaactaaacctagttacgtttacggtaacttcgtaacgaacctaaagtcgtaaacgtacgtacccgtaggaaacggtaccggaacccgggtaacggaaccggtaaccgggttcgttacgggtttaaggtttaaccgtttaacggttacgggttacggtacggtaaacgggtaagggtacgggtttaggggggaacggggggtttaggtaacgggttaacggttacccgggttaaagggg

SEQ ID NO: 256495 - DNA, 594 bp, Homo sapiens
  misc_feature: GYAE6OF01EAU9Z.14.55.E11.1.454.CMB.1.raw
  modified_base (243)..(243): a, c, t, g, unknown or other
  misc_feature (243)..(243): n is a, c, g, or t
  modified_base (376)..(376): a, c, t, g, unknown or other
  misc_feature (376)..(376): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggacgtccctgaccnctctcctgtcgcaacgtctggacttcagtcttcaagttagttatggcattgcctacgtcggggtcccgaccgaggtcctaccggagggaccgaagggggtcctgggaggtgggtggctaggttgtggtggtanggaacggaaataagtaaggaaagtgtacggaccggacgccggtaggaacgggcctagttaccacctatcgaccgagacgaactaactaccaacactattgtatatctacgataatagaatacgcctagagacgaccgaggaccgcggtcgttagtagttaagttcgttaggtgtacgaagtaggaggtgggggtaggggtagtagtacgtcggtaagg

SEQ ID NO: 256496 - DNA, 777 bp, Homo sapiens
  misc_feature: GYAE6OF01CO1XC.14.55.E11.1.454.CMB.1.raw
  modified_base (183)..(183): a, c, t, g, unknown or other
  misc_feature (183)..(183): n is a, c, g, or t
  modified_base (216)..(216): a, c, t, g, unknown or other
  misc_feature (216)..(216): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (320)..(320): a, c, t, g, unknown or other
  misc_feature (320)..(320): n is a, c, g, or t
  modified_base (376)..(376): a, c, t, g, unknown or other
  misc_feature (376)..(376): n is a, c, g, or t
tcagcgtctagtaccacgaccggtgctcgatttagcactcgcacgttgggctctgggagaggagcccagcactagaagtcggcggtgtttccattcggtgatcagcactgaacacagagactcacatggagtttgggctgagtcttgggtttttcctcggttgcttacgttttaaagaggttntccagttgtcaggtgcagcgtgggtggagtcgngggggagcgtggtccagccgtgggacgtcctgacnctctcngtcgcacgtctggattcgagcttacgagttagttatcggctagtgcctacggtcgggtacccnccgaggcctaccgagggcgaagggggtcttggggagtggggtcgggacaggtttgnggtacggttaatcgggaacggtaaagtaaagtaaggaaagtgtcggacccggtacggcccggttaggaaccggggtcccgtaattacccgaaccgtacttccgtacccgaaaggaacggtaacctaaacttacccaaacaaaccttagtttacggttacgttaatccgttaagaaaccgtaaagttaagaaacgttacggtacccgttaggaaacgggtacccggaacccgggtaacgggtacccggtaaaccgggttccgtttagggttaaccgtttaacggttttaaccggttagggttacggtttaacccgggtaaagggtaagggttacgggggtttaaggggggggtagggggggtttaaccggtagggttaaacccggttaccgggttaaagggg

SEQ ID NO: 256497 - DNA, 674 bp, Homo sapiens
  misc_feature: GYAE6OF01EZQ38.14.55.E11.1.454.CMB.1.raw
  modified_base (254)..(254): a, c, t, g, unknown or other
  misc_feature (254)..(254): n is a, c, g, or t
tcagcgtctagtaccacgaccggtgctcgatttagcactcgcacgttgggctctggggagaggagcccagcactagaagtcggcggtgtttccattcggtgatcagcactgaacacagaggactcaccatggagtttgggctgagcttggggtttttcctcgttgcttacgtttttaaagaggttgtccagttgtcaggtgcagctggtggagtcgtgggggagcgtggtccagccgtggggacgtccctgacnctctcctaggtcacaacgtctggattcagcttacgtagttagttagtggcagttggcacgttcggggtcccacgacggcctccgaggccggaaggggcgtgggaggtggggtgacgtaggttgtggtaggtagtggaaacggtaataagtaaggtaaagtgtacgtaccgacggtaccgtagggaacgggtcctagttacccaccgtatccgtacgagaacgtaactaacttacccgaaactaacgtgttacgttagtactagtacgaaactaagtgtaaacgtacgtacccgtaggaacgtaacgaccggaacggtaccggtaacggtccgttagtacgtttaagttaaccgtgggttacgtacgaaggtagggtaggtaggggggtaggggttaggtacgtaaccgtccgggtaaagg

SEQ ID NO: 256498 - DNA, 606 bp, Homo sapiens
  misc_feature: GYAE6OF01EWSEZ.14.55.E11.1.454.CMB.1.raw
  modified_base (298)..(298): a, c, t, g, unknown or other
  misc_feature (298)..(298): n is a, c, g, or t
  modified_base (486)..(486): a, c, t, g, unknown or other
  misc_feature (486)..(486): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcggggggaggcgtggtccagcctgggaggtccctgagactctcctgtgcagcctctggattcaccgtcagtagttctggcatgcacgtgggtccnccaggcctccgaggcgaagggggctgggagtttggggtagggagtttatagtcatatgataggaaactaataaagctagtgacaagaccttccggtagaacgggccgtattccgaacctatcctaccaagacgactaccgttaccgaaggaaccacgtactagtactctcgaactaaagtacgaaacncgtacctaggaacgagacgtaggaacggacacgggactaggttacgttaagttaccgtggtacggtaacggtaaaggtacgggttacgggggtaccggttacggtccgtcgggtcccggg

SEQ ID NO: 256499 - DNA, 666 bp, Homo sapiens
  misc_feature: GYAE6OF01C4XNW.14.55.E11.1.454.CMB.1.raw
  modified_base (317)..(317): a, c, t, g, unknown or other
  misc_feature (317)..(317): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtggtggagtcgtgggggagcgtggtccagccgtgggacggtccctgaccacttctccgtgtgcaacgttctggacttcagtctttcgagttagttatggccagtcgctacgtcgggtcccnccgtaggcctaccgaggccgaagggggtcttgggaggtgggtggctaggttggtaggtggtactgggaacggtaagtaaagtaaggaaagtgtcgacccggaggtccggtaggaacgggtccgattccgacctacgtcctaccgagtaacgaaccgtaacttacccaaactaacgtagttacgttatacgttaccgtagtaacctaaagttcgaaacgttacgaccgttagaacggacggaccggtaacgggaccacgggtacttaggtacgttacgttacgtaggtacgtacgagggtaaggtacggttagggggtaggggttagggtacggtacgtcggttaaaggg

SEQ ID NO: 256500 - DNA, 855 bp, Homo sapiens
  misc_feature: GYAE6OF01DL7A1.14.55.E11.1.454.CMB.1.raw
  modified_base (286)..(286): a, c, t, g, unknown or other
  misc_feature (286)..(286): n is a, c, g, or t
  modified_base (316)..(316): a, c, t, g, unknown or other
  misc_feature (316)..(316): n is a, c, g, or t
  modified_base (329)..(329): a, c, t, g, unknown or other
  misc_feature (329)..(329): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtcccctgactactctcctgtcgcaacgtcgtggacttcagtcttnagttagtatggcatgctacgtcgggtcccngacggctaccggnggaccgaaggggctgggaggtgggtcggcgtaggttgtggtcggtagtacggaacggtaaaagttaataacggaaaacggtgttaccgggacccgtaacgggtacccgggtaaggggtaaaccggggtacccgtaaccgtttaaccgaacccgtaagttcccgttacccgaaagtaaccggttaaacctaaacgtttaaccccgaaaaccccgtaaacgtacggtttacgtttaacgttaaccgttaccggttaacggtaactaaaaacggttaacggtaaaaccgttaacccggtacccggtaacggtaaaccggggtaaccgggacccgggttaaaaccgggggaaacccgttacccgggggtaacgttttaaccggggtttaacgggttttaaaccgttttaacgggttacgggttaaccgggtttaaaccggtaaagggggttaaacccgggggttaaggggggtttaagggggggtaaacgggggggggtttcccggttaaagggtttaaacccccggggg

SEQ ID NO: 256501 - DNA, 793 bp, Homo sapiens
  misc_feature: GYAE6OF01A6CWZ.14.55.E11.1.454.CMB.1.raw
  modified_base (144)..(144): a, c, t, g, unknown or other
  misc_feature (144)..(144): n is a, c, g, or t
  modified_base (195)..(195): a, c, t, g, unknown or other
  misc_feature (195)..(195): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagaggtntgacatccagatcgacccagtctccatcctccctgtctgcatctgtagganacagacgtccaacctatctacgttcggaccgggacaaagtccaaggagactaaatttaaacgaaactttaattttaaaagttggttaactaaccgtaaaccgaaggtaaaaacccgaggggtaaaaaccgtccccccgtaggtaaccccttaccgttagtaacgttccttaacgttcggcctcggtacctacgtttaccgttaagttttcgaccgtaacggtacggggttaccgggggttcccttacggttaaacggtttcgaggttcgggactaggtggaacttcggtaacggtactacgtacgttttccgacctaccgtacgtaaccgtcgtacgtacgtacgtaccgtcgtaccctaaccgtagttaacttacgtttacgaacttttaaaccgtaccgttaactcggtaacctaacggtaacgttaccggtttaaaccctacccgttacccccgtacgtttaacccgggtttcgggacgggtaaaccgggaccggtaagggtacccggtaaagtccgttaaaccggaacggtaccgtaacggtcgggttacgcgtaccgactaaaccctcttacgttcgttaccgttcgtacccg

SEQ ID NO: 256502 - DNA, 765 bp, Homo sapiens
  misc_feature: GYAE6OF01CPEJL.14.55.E11.1.454.CMB.1.raw
  modified_base (336)..(336): a, c, t, g, unknown or other
  misc_feature (336)..(336): n is a, c, g, or t
  modified_base (359)..(359): a, c, t, g, unknown or other
  misc_feature (359)..(359): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcacatggagtttggctgagcttgggttttcctcgttgcttcttttaaggaggttgtccagtgtcgtaggtgcagtcgtggtggaggtcggtgggggaggcgtcggtccgagtccggtggggacggttccctggaacctccgttccgtccgtggtacgacctaacggttcgtaggtacttcgagtcttacagttagttagtggacngtcggaccgacggttcgggcccncggtacggccgtacgacgggacggaaggggtccgtgggaggtggggtcggtatagggtttggtaggtacggtaatacggggaaacggtaaaagttaagaaggtaaaggtcgtacgggtaaccggtacggtaccgggtaagggtaaccggggtaccgtaacgttccgaacccgtagtacccgtaccgtaacgggaacctaaacgtaaactaacccgtaaaacgtaaaccgtagttacggtttatacgttacgtaaggtaactaaagttaaccgtaagtaaccgacgtaaggaacgacggaccggaacggtaaccggtacgtacgttgttaacgtaagttagttggttacgacgtaggtaaacgggtgggttacgggggagggggttacgtagggtacggttaacggg

SEQ ID NO: 256503 - DNA, 685 bp, Homo sapiens
  misc_feature: GYAE6OF01DC1JA.14.55.E11.1.454.CMB.1.raw
  modified_base (191)..(191): a, c, t, g, unknown or other
  misc_feature (191)..(191): n is a, c, g, or t
  modified_base (217)..(217): a, c, t, g, unknown or other
  misc_feature (217)..(217): n is a, c, g, or t
  modified_base (275)..(275): a, c, t, g, unknown or other
  misc_feature (275)..(275): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacgttgccgggnaagtcagagcattaagaacttaatttaaattggtatacaaacagaaaccagggaaacncccctagacctcctgactctatcgctgcacgttcctagtttcgctacgaggtcggggttacccgtagtaacggttcaggtcggactaggttggaatcggtaggactagtactttacacttcctaccgtaccgtacgagctagttcctcggacctaaccgtgtaaacgttacgttttacgaccttaaacgtttacctaacgttacgtaaccaaccgtaaggtaacgtttaaccccgacccgtttaacccccccgttaacgttacccggtttaccggggaaccgggtaaccggggaccgtaaggggtaccgggtaacggtaccgttacgaacggtaaaccggtacggttacggtcgggtaccgttcggacctacccgtaacttcccgtttaggttcccttccgttaacccgg

SEQ ID NO: 256504 - DNA, 828 bp, Homo sapiens
  misc_feature: GYAE6OF01C8ITB.14.55.E11.1.454.CMB.1.raw
  modified_base (265)..(265): a, c, t, g, unknown or other
  misc_feature (265)..(265): n is a, c, g, or t
  modified_base (280)..(280): a, c, t, g, unknown or other
  misc_feature (280)..(280): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtgggtggagtcggtgggggagcgtggtaccagccgtgggagtccctggacactctcctgtgctaacgtcnggacttcgagtcttnagttgtatggctatgcctacgtcgggccgccgaggcctaccgagggtacgaaggggtccttagggggcggttggggtacggtactagggtttggtacggttaggggtaagttcggggaaagggtaaaaggtttaaggtaaaggaaaacggttgttaccggggaccccggtaaacgggtccccgggtttaagggaaacgggggttcccgtaaacgttacccgaaacccgtacgttaccccgtaacccggaaggtaaaccgtaacctaaaccgtttaacccaaaactaacccgtaagtttaccggtttacggttaacttaccgtaaggtaacctaaaagttacgggtaaacttaacggtaccccgggttaaggaaaccggaccgggaaacccgggtaaggaaacccgggtacgggtccggtttaaaccggttaggtttaaacccgtttacggtacggtttcggtaaaccggtaaggttaaaggggttcgggttaaggggggggacggggggtttagttaacgggtaacccgggttcggttaaaacggggg

SEQ ID NO: 256505 - DNA, 737 bp, Homo sapiens
  misc_feature: GYAE6OF01DNVVH.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccagtggtagtttgggctgagtcgttgggttttcctcgttgcttacgttttaaggaggttgtccagtgtcgaggtgcaggcgtgggtggaggtcggtgggggaggtcggtggtccaggccgtggggacgtccctgacctactccgtccgtgtcgacctaacggttcgtaggtacttcgaggttctttacgaggttagttacgtggctagtggccgtacggtcgggtcccaccgacggtcctaccggaggcggaaggggtcgtggggagggttcggggtggtacgttaggtttggtaggttacggtagtaacgggtaaaggtaaaagtttaaggtaaacggtaaaggttcgtaccgggaacccggtaacggtccggggtaacgggaaaccgggtcccgttaacgttacccgaccgtacgtaccgtaccgaaagtaacgaacctaaactaccgaaactagtacttagttatactacgtagtaactaagtagtaactacgtacgtagaacgacgaccggaaggacgtacggtgttaggtaagttaccgttacgtaggtacgtcggaagggtaggtaggggtacggggtaggggttagtcggtaaggtcgtaaggg

SEQ ID NO: 256506 - DNA, 557 bp, Homo sapiens
  misc_feature: GYAE6OF01CQIZS.14.55.E11.1.454.CMB.1.raw
  modified_base (528)..(528): a, c, t, g, unknown or other
  misc_feature (528)..(528): n is a, c, g, or t
  modified_base (532)..(532): a, c, t, g, unknown or other
  misc_feature (532)..(532): n is a, c, g, or t
  modified_base (535)..(557): a, c, t, g, unknown or other
  misc_feature (535)..(557): n is a, c, g, or t
tcagcgtctagtaccacgaccggtgctcgatttagcactcgcacgttgggtttgggtctcattggccttcaggttcaggggcacctctggcccgacttgcagcatgggctccctggaggacggtgccctggtcccaggcagcgctggcccctgctgctgctgggtctggccatcggtcgcccagtcggcctggctcgccgtacccgaagtgggttcgaccgaaccggaccgaaaacgggcccgggggaaccccacgggaaccccgtgggaaccgcccgttaccggtaacgggttagggaaacgccgacggtacccggaacttcccgaacggtccgtcgggaccggacgtcccggtgggtacggggggacctaacgggtaccgaaccgggaccccgaaaccgggaccccaaaaccccccgttacggtcgtaccctaaccgttcccgtccccggtttacccccgcccgttacccgtacgtaaccggaccgtccggtaggaccggccggttcgaggacgaacggtcgaacngtancgnnnnnnnnnnnnnnnnnnnnnnn

SEQ ID NO: 256507 - DNA, 704 bp, Homo sapiens
  misc_feature: GYAE6OF01EEUNU.14.55.E11.1.454.CMB.1.raw
  modified_base (302)..(302): a, c, t, g, unknown or other
  misc_feature (302)..(302): n is a, c, g, or t
tcagcgtctagtaccacgaccggtgctcgatttagcactcgcacgttgggtttggggagtctcagtcaggacacagcatggacatgagggtccccgctcagctccgtggggctcctgctactctggctccgaggtgccagatgtgacatccagatcgacccagtcctccactccctccctgtctgcatctgtaggagacagacgtcaccatcacgttcggccggacaagtcaagacgactaattaaagtaactttaattttaaagtggtaactaccgaaacaacgaaaccgaagggaaaccncccctagacccctcctgactcgtagtgtcctgacctactccgtagtttcgacctaacgtacgggttccggggtacccttacggtaacggttccgaggtcgggtactaaggttcggaacgttcggtacggggactaacgttacttttaccgacttccgtaccgtaccgtacgacgtactacggttctacgacctaaccgttaagtaacgttacgtttacgtaaccttaacctttaaccgtacgttacgtaacctaacgtaacgttacgttaacccgtacccgttaaccccctacgttaccgtttaccgggaccgggtaacggaaccggacgggacgtacgtacgtaacgacgtacgtaggtcgtcgcgtacgacctacgtacttccgtcgttccgtctacccg

SEQ ID NO: 256508 - DNA, 700 bp, Homo sapiens
  misc_feature: GYAE6OF01DM73U.14.55.E11.1.454.CMB.1.raw
  modified_base (416)..(416): a, c, t, g, unknown or other
  misc_feature (416)..(416): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcactgccggcaagtcagagcattaagaactaatttaaattggtatacaacagaaaccagggaaagccccctgaacctcctgatctaatgctgcatccagttttcgactacgtaggtcggggtcccgtagaacggttcaaggtggacagtggatcgtggacagtactttcactctacaccgtacagcaacgtctacgctaaacctgaaagtnttttaggacttaaaccgtttatttaaccgtcgttactaactaagtaactttaacctaaagtttaacccccgtttaacgaaacccggttttaccggaacccgtaaacggggtaacccgtaaaggggtaaccggtaaaacggttaaacccgtaaaaaccggtaaccgtttaacggggttaacgggtacccgtttaacgggaacccctaaaccccgtaaacgttttcccgtttaaggttacccggttttaaccttaaacccggtttccccgtttaaacccccccggg

SEQ ID NO: 256509 - DNA, 609 bp, Homo sapiens
  misc_feature: GYAE6OF01BMYWR.14.55.E11.1.454.CMB.1.raw
  modified_base (192)..(192): a, c, t, g, unknown or other
  misc_feature (192)..(192): n is a, c, g, or t
  modified_base (279)..(279): a, c, t, g, unknown or other
  misc_feature (279)..(279): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccggacaagtcagagctaattaagaacttatttaaattggtaatacaacgaagaaaccaggggaaacncccctagaccctcctgatctatgctgcatcctagtttgacacgtacggttcggggtccctataagggttcaggtcggcaggtggtatcgtgggaactagtactttcaccttcgtaccacgtacagctagtctacgtacctaacgtagtaagtacgtttacgaccttaaaccttactacttacgtaactaacgacgttaacgttaaccgaccccgttaccccctcgttaccgtttaccgggaccggacgggaaccgacggtacggagtacgtagacgaacggtacgtggtcggtaccagacctaccgtagttcctacgttcgttctacccg

SEQ ID NO: 256510 - DNA, 667 bp, Homo sapiens
  misc_feature: GYAE6OF01CZ7KJ.14.55.E11.1.454.CMB.1.raw
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcgaggtgcagctggtggagtcgtgggggagcggtggtccaggccgtggggacggtcccctgacctactcctccgtgtcgactaacgtctggtattcagtcttactagttagttatggctagtgacacgtcggggtccgccgaggtcctcggagggacggaaggggtcgtgggagggtggggtaggcgttaggtttggtcggtagggtatagggtaacggaaagtaaagtaaggtaaaagtgtcggaccgacggccgtagggaacggccgtactaccacctactctaccgaagaacgaactaactaccaaacctaagtacgttgtttacgtattaccgtagtaactaaagttagtaacgtacgacttaggaacgtacggacggtaacggaacccgacggtacgttagttacgttaacgtttacgttggtagtacgaggtaaggtaggtaggggtagggggttgtaggtaacgg

SEQ ID NO: 256511 - DNA, 696 bp, Homo sapiens
  misc_feature: GYAE6OF01BMS9O.14.55.E11.1.454.CMB.1.raw
  modified_base (172)..(172): a, c, t, g, unknown or other
  misc_feature (172)..(172): n is a, c, g, or t
  modified_base (387)..(387): a, c, t, g, unknown or other
  misc_feature (387)..(387): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccagccgtgggacgtcccctgaccactctcctgtcgcaacgtctggattcagcttcagttagttatggcatgcacgtgggtcccgccgaggcctccgagggcgaagggggctgggaggtgggtggctaggttgtggtggtagtggaacggtaagtaagtagaaagttntcggcccggacgcccggttaggaacgggtccgtaacgttccgacctagtcctaccgaaggaacgtaacctaaacgttacccaaaccgtaaactagttacgtttaggtattcgttacgaactaaagtagaactacggtaccttaggaacggtaacggacccggaacgggtaacccgtaccgggtacgttagggttacgtttaacgtttaccggtttaggtttacggttaccggaagggtaacggggtaggggtttaggggggtaacgggggggtttagggtacgggttaacggttaccgggttaaagggg

SEQ ID NO: 256512 - DNA, 568 bp, Homo sapiens
  misc_feature: GYAE6OF01D9UXL.14.55.E11.1.454.CMB.1.raw
  modified_base (179)..(179): a, c, t, g, unknown or other
  misc_feature (179)..(179): n is a, c, g, or t
  modified_base (197)..(197): a, c, t, g, unknown or other
  misc_feature (197)..(197): n is a, c, g, or t
  modified_base (250)..(250): a, c, t, g, unknown or other
  misc_feature (250)..(250): n is a, c, g, or t
  modified_base (310)..(310): a, c, t, g, unknown or other
  misc_feature (310)..(310): n is a, c, g, or t
  modified_base (353)..(353): a, c, t, g, unknown or other
  misc_feature (353)..(353): n is a, c, g, or t
  modified_base (382)..(382): a, c, t, g, unknown or other
  misc_feature (382)..(382): n is a, c, g, or t
  modified_base (414)..(414): a, c, t, g, unknown or other
  misc_feature (414)..(414): n is a, c, g, or t
  modified_base (444)..(444): a, c, t, g, unknown or other
  misc_feature (444)..(444): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagctgggttttcctgttgctcttttaagnggtgtccagtgtcaggtncagctggtggagtcgtggggggagcgtggtccagccgtgggacgtccctgacnctctcctgtgcaacgtctggacttcagtcttcagtagttatggcatgctacgtgggtccnccaggcctcgaggcgaaggggctgggagtgggtgctaggttgnggtggtatggacgtaagtaataggaaatntcggaccgacgcgtaggaacgggccatcaccntctcagacgacaactccaaacactatgttntactctagactaatgaactacgaccgtaggagacggaccgacggacgacggtcgtaggtacgttattacgtggtcgtcgtaaggacggtaggtagggggtagggggtcggtaggtcgtaacggg

SEQ ID NO: 256513 - DNA, 714 bp, Homo sapiens
  misc_feature: GYAE6OF01AFO0Q.14.55.E11.1.454.CMB.1.raw
  modified_base (309)..(309): a, c, t, g, unknown or other
  misc_feature (309)..(309): n is a, c, g, or t
  modified_base (334)..(334): a, c, t, g, unknown or other
  misc_feature (334)..(334): n is a, c, g, or t
tcagcgtctagtaccacgaccggtgctcgatttagcactcgcacgttgggctctgggagaggagcccagcactagaagtcggcggtgtttccattcggtgatcagcactgaacacagagactcaccatggagtttggctgagcttgggttttcctcgttgcttcttttaagaggtgtccagtgtcaggtgcagcgtgggtggagtcggtgggggaggcggtggtccgagccgtggggacggttcccctgacctaccttctccgtggtcgacctaaccgttctggatttcgagtctttcgagttagttanggctagtcgcgtacgtcgggtcccnccgaggtcctccggaggcgaaggggctagggtaggtgggtaggctaggtttggcggttaggtactagggaacggtaaagttaaagtaaggtaaagttgccggacccggaccggtccggtagggaaccgggccgtacgttaccgaaccgtacgttcccaccgaagaacgtaacctaaaccttaacccaaactaaacgtacgttgtttagttaacttccgtacgtaactaaagtacgtaaacgtacggaccgtaggaacgacgggaccggaacggtaccgtaccggtacgtttacggtacgttaacgtttcgtaggttacgtacggaagggtaaggttgggtacgggggtagggttaggtacgttcggtaccggttaagggg

SEQ ID NO: 256514 - DNA, 688 bp, Homo sapiens
  misc_feature: GYAE6OF01DYV0M.14.55.E11.1.454.CMB.1.raw
  modified_base (194)..(194): a, c, t, g, unknown or other
  misc_feature (194)..(194): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccggaggtgccagatgtgacatccagatgacccagtctccatccctccctgtctgcatctgtagganacagagtcaccatcacttgccgggacaagtcagagacaattaaagaacttaattttaaaagttggtaatacaaaacaacgaaaaccgaacggggaaaacgccccgtagtacccctcctagtactactatcgctagctatccgtagtttcgacctacgtacgggttccgggggttaccctaggtaaacggtttcgaaggttcgggactagggttacggacgttcggtaggggaactaggttacttttaccgacctttccgtaccgtaccgttacgacgtcgtaacgtctacggaacctaacgtaggtaagttacgtttacgtaacttaacttactactacgtaactaacgtaagtacgttaaccgtaccgttacccccgtacgtaccggttccgggacggaccggtaaccggaaggacgtaagactacggaacgtaacggtaagtcggtcgacgtacgaccgtaaccttacgttaccgtacttcgttcctacccg

SEQ ID NO: 256515 - DNA, 718 bp, Homo sapiens
  misc_feature: GYAE6OF01BP3IE.14.55.E11.1.454.CMB.1.raw
  modified_base (203)..(203): a, c, t, g, unknown or other
  misc_feature (203)..(203): n is a, c, g, or t
tcagcgtctagtaccacgaccggtgctcgatttagcactcgcacgttggggtttgggggagtctcagtcaggacacagcatggacatgagggtccccgctcagctccgtgggggctcctgctactctggctccgaggtgtcagatgtgacatccagatcgacccagtcctccacttccctccctgtctgcatcgtggtagganacgagacgtaccacctatcctacgttcggacccgggactaaaggtccaaggacgtactaagttaaaagaaactttaattttaaagttcgtaatacaaaacgaaggaaaaccgaagggaacctccccgagtaccctaccgtagtactctatacgtctgactacttcgtagttgacctaacggtcgggttccgggtacccgtagtaacggttcgaacggtgggactagggtgtacgtcggtacgggaacttagtactttccgaaccttcgtaccgtacccgtacgtacggtaccgtagtacctacggtaaccctaaacggtaggttaaacgttacgtttacgttaaccttaaccgtttaactacgttacgtaactaacgtaagttaaccgtaacctaaccccgttacccctacgttaccgggttaccggacgggtaaccggacgtaacgggcgtaacgacgtacgacggacgtacgtggtcgtcgagtaccacgtactcttactcgttccgttcccg

SEQ ID NO: 256516 - DNA, 890 bp, Homo sapiens
  misc_feature: GYAE6OF01A1RO0.14.55.E11.1.454.CMB.1.raw
  modified_base (425)..(425): a, c, t, g, unknown or other
  misc_feature (425)..(425): n is a, c, g, or t
tcagcgtctagtaccacgaccggtgctcgatttagcactcgcacgttggctcgtgggagaggagcccagcactagaagtcggcggtgtttccattcggtgatcagcactgaacacagaggactcaccagtggagtttgggctggagcttgggttttcctcgttgcttactttaagaggtgtccagtgtcaggtgcagctggtggagtcgtgggggagtcgtggtccaggtccgtgggacgtccccgtggaccacttcgttccgtggttagaccgtaacgttcgtacgggaatttcggacggtcctttcgtaagttaggtttaacgttcgggcctaatcggtccgtaaccgttcgggggttcccgaccctaacgggtcctcccggaggggtaccggaacggggtcgttagggaaggtttcgggggnggtaccgttagggtttggtacgggttggttaaggtaccgggtaaacgggtaaagttaaaggtaacgggtaaaaggtcgttaccggacccgggtaaccggtacccggttagggggtaaacgggaccccgtaagtttacccgtaaccaagttcccgttaacccgaaagttaacgggaaacccttaaacggtaacccctaaaaccggtaaacgttactttacgggtttaccttaagtaacgttacggaacccttaaagtaacccgttaaagtttcggacccgtttaagggaaaccgttaacgggacccggtaaacgggacccggtaaacgtcccgggttaaggttttaaaccgttaacccgggttattttaccgggggactttaaacgggaaaccgggttaacgtttacggggttaaggggggaacccgggggtttaggtaacggtaaccgttcgggtttaaaagggg

SEQ ID NO: 256517 - DNA, 850 bp, Homo sapiens
  misc_feature: GYAE6OF01C0VWV.14.55.E11.1.454.CMB.1.raw
  modified_base (842)..(842): a, c, t, g, unknown or other
  misc_feature (842)..(842): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccagtggagtttgggctgagtcgttgggttttcctcgttgcttcgttttaagaggtgtccagtgtcgaggtgcagcgtggtaggagtcggtgggggagcggtggtccaggtccgtggggacgtccccgtagacctacgtccgtccgtgtacgcgtaacgtcgtggactttacgagtccttacgaggttagttacgtggacctagttcggacctacggttccggggtccccgacccgtaagggtccccgttacccggaacggggaaccgggtaaacgggggggtcccgttaaggggggtacggggttagggggggttccgggtaccgtttaaggggtttttcgggttaggggtttacggggttaaaacggtaacgggggtaaaacggggtaaaaaaggtttaaaagtaaaaggggttaaaaacggttacggttaccgggaaccccggtaaccgggttacccggggtaacgggaaacccggggtaccgtaacgtttaccccgaaccccgttacgttacccgtaacccggaaggtaaaccgtaaacctaacgtttaacccgaaaacgtaaccgtaagttcgtttaacgttattacgtaacgtaactaaagtacgtaacgtaccgacgttagacgacggacgtacggacgtacgtcgttaggtacgttattacggtgtaccgtagaacggtgtaagggtggggaggggttgnggtaacgg

SEQ ID NO: 256518 - DNA, 769 bp, Homo sapiens
  misc_feature: GYAE6OF01C5MYS.14.55.E11.1.454.CMB.1.raw
  modified_base (166)..(166): a, c, t, g, unknown or other
  misc_feature (166)..(166): n is a, c, g, or t
  modified_base (336)..(336): a, c, t, g, unknown or other
  misc_feature (336)..(336): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagcttgggtttttccncggtttgcttcttttaaggaggttgtccagtgtcaggtgcagcgtggtggagtcgtgggggagcgtggtccaggccgtggggacgtcccctgacctactcgtccgtgtacgcaacgtctggattcacgtcttcgagttagttagtggctagtcgacgtacgtgggtcccncgacggcctaccgaggacgaggggctgggacgtgggtgcgtaggtttgtggtaggtacgaggacggtaaagttaagtaagtaaagtgtacgggaccggtaacggtaccggttagggaaacgggtccgtaacgttacccgaaccgtacgtaccgtacccgaaggtaacgtaaaccgtaaacctttaacccaaaaccgttaaaccgtaagttttacgggtttaacttacgtttaccgtaagggtaaacctaaagttaacggttaaacgttaaccggtacccgttaaggaaaccggtacggaacccgggaacggacccgaacgggttaccggttaggttaccggtttaacgtttacgggtcggttacgtaacggtaacggtaagggtagggtttacgggggggaagggggtttcggtagtaaccgggtttaacggg

SEQ ID NO: 256519 - DNA, 618 bp, Homo sapiens
  misc_feature: GYAE6OF01BZ0RW.14.55.E11.1.454.CMB.1.raw
  modified_base (191)..(191): a, c, t, g, unknown or other
  misc_feature (191)..(191): n is a, c, g, or t
  modified_base (367)..(367): a, c, t, g, unknown or other
  misc_feature (367)..(367): n is a, c, g, or t
  modified_base (465)..(465): a, c, t, g, unknown or other
  misc_feature (465)..(465): n is a, c, g, or t
  modified_base (502)..(502): a, c, t, g, unknown or other
  misc_feature (502)..(502): n is a, c, g, or t
  modified_base (509)..(509): a, c, t, g, unknown or other
  misc_feature (509)..(509): n is a, c, g, or t
  modified_base (569)..(569): a, c, t, g, unknown or other
  misc_feature (569)..(569): n is a, c, g, or t
  modified_base (599)..(599): a, c, t, g, unknown or other
  misc_feature (599)..(599): n is a, c, g, or t
  modified_base (607)..(607): a, c, t, g, unknown or other
  misc_feature (607)..(607): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctgttgcttcttttaagaggtgtccagtgtcaggtncagctggtggagtcgtgggggagcgtggtccaggccgtggggacgttccctgacctctctcctgtgcaacgttctggattcagtcttcgtagttagttatggctatcggactacgttcgggtcccaccgaggtcctaccggaggccgtaaagggggtcttggggaggttacggggngcgttaggtttggtgttgggtaagtgggaaacggtaaagtaaagtacggtaaagcgtacggacccgcggtaccggtaggaacgggtcctattccaacnctaccgtcgaagtacgaacttaactcgaaactaagtnttgttanacttgtagaactaatagaactacgacgtagaagacgaccggagacgcgtattgtaacgtnttacgtgtcggacaaggtcgaggtaggggngggtatanacgtcgtaagg

SEQ ID NO: 256520 - DNA, 751 bp, Homo sapiens
  misc_feature: GYAE6OF01A6S2L.14.55.E11.1.454.CMB.1.raw
  modified_base (241)..(241): a, c, t, g, unknown or other
  misc_feature (241)..(241): n is a, c, g, or t
  modified_base (261)..(261): a, c, t, g, unknown or other
  misc_feature (261)..(261): n is a, c, g, or t
  modified_base (275)..(275): a, c, t, g, unknown or other
  misc_feature (275)..(275): n is a, c, g, or t
  modified_base (308)..(308): a, c, t, g, unknown or other
  misc_feature (308)..(308): n is a, c, g, or t
  modified_base (419)..(419): a, c, t, g, unknown or other
  misc_feature (419)..(419): n is a, c, g, or t
tcagcgtctagtaccacgaccggtgctcgatttagcactcgcacgttgggctcgtgggagaggagcccagcactagaagtcggcggtgtttccattcggtgatcagcactgaaccacagaggactcaccatggtagtttgggctgagcttgggttttcctcgttgcttcttttaagagtgtccagtgtcaggtgcagctggtggagtcgtgggggagcgtggtccagccgtgggagtcccngagctctcctgtgcagcctntggattccaccttnagtacctatcgctagtgccacgtcggggtcccnccgacggtccctccgagggtccgggacggggtctaggggagggttggggtggaccgtattataacgtcgaactagtaggaatacgggtaaaacttaagtaacggacccgtnttaacgtcggacccgtaccggttacccgggttaggaaaccggggtcccgttaacgttacccaacccgtaaccgttaccctaacccgaaggtaaccgaaccttaaaaccgttaacccgaaaagaaccccgtaacgaccgtaagttacgtaacgtaacggaacctaaaacgtacggaaaacctaacggtcccggtaaggaacggtaacggtaccggtaacggaaaccgggacccggtaaaccgggtcgtttaggtttacggttaaacgtttcgggtagggttacggggtaaaggaggttaaaccggggtaagggtaaccgggttagttaaaggg

SEQ ID NO: 256521 - DNA, 755 bp, Homo sapiens
  misc_feature: GYAE6OF01AF3QC.14.55.E11.1.454.CMB.1.raw
  modified_base (255)..(255): a, c, t, g, unknown or other
  misc_feature (255)..(255): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcgttgggtttttccctcggttgtcttctttttaagaggttcgtccagttgtcgaggtgcagctgggtggagtcgtgggggagcggtggtaccgagccgtgggacgttcccngacctactctccgtgtcactaaccgtcgtggatttcacgtcttacgtagttacgttagtggctaagtcgacgacgttcggggtcccaccgacggtcctaccgaggaccggaaggggcgtgggacggtggggtacgcgtaggtttggtcggtcggtaagtcgggtaaacggtaaaggttaagtaaagggtaaaggttcgtaccgggacccggtaacggtaccgggtaacgggtaaacgggtccccggttaattaccgaacccgtacgtaccgtaccgtaagtaacggtaccaaactttaacccaaactaacctgtttaacggttattacgtaccgtagaaacgttaacgtacggtaaacttaccgggtctaacgggaacggaacgggttacccgaaggggtaaccctaggtacccgttggtttaacgtaacgtttcgtggtacgtaccggtaagtacggtagggttacggggtacggggtaggttgtaccgtagggttagg

SEQ ID NO: 256522 - DNA, 658 bp, Homo sapiens
  misc_feature: GYAE6OF01DQKJ4.14.55.E11.1.454.CMB.1.raw
  modified_base (186)..(186): a, c, t, g, unknown or other
  misc_feature (186)..(186): n is a, c, g, or t
  modified_base (372)..(372): a, c, t, g, unknown or other
  misc_feature (372)..(372): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagtcgttgggtttttcctcgttgcttctttttaagnggttgtccagtgtcaggtgcagcgtggtggagtcgtgggggagcgtggtccagccgtgggacgtccctgaccacctctccgtgtcgacgtaacgttcgtggtaaaaaaaattcgtagtcttactagttagttagtgcagtgcgacgtcggtccgccgacggccgtccgaggcggaagggtcgtggnggtgggtcggcgtagttgtggtggtagtaggaggtaaagtaagtaagaagtagtacgaccggacggcggtaggacgggaccgtacgtacgacctactccgtacgagaacgaactaactaccaactaacgtagttagttagtactctagactaaagtacgtaacgtacgtacgtagacgacggaccggaacggacgacggtcgttaggttacggtttaacgttacgttggttcgtacggtaggtaaggtacgggtaggggtagggggttgggtaggtacggtaacgg

SEQ ID NO: 256523 - DNA, 586 bp, Homo sapiens
  misc_feature: GYAE6OF01BCIY2.14.55.E11.1.454.CMB.1.raw
  modified_base (165)..(165): a, c, t, g, unknown or other
  misc_feature (165)..(165): n is a, c, g, or t
  modified_base (313)..(313): a, c, t, g, unknown or other
  misc_feature (313)..(313): n is a, c, g, or t
  modified_base (382)..(382): a, c, t, g, unknown or other
  misc_feature (382)..(382): n is a, c, g, or t
tcagcgtctagtaccacgaccggtgctcgatttagcactcgcacgttgggtttggggatctctgggagaggagcccagcactagaagtcggcggtgtttccattcggtgatcagcactgaacacagaggactcaccatggagtttgggctgagctgggttttccncgttgctcttttaagaggtgtccagtgtcaggtgcagctggtggagtcgtgggggagcgtggtccagcctgggacggtccctgacactctcctgtgcaacgtctggattcagtcttacgagttagttatggcatgcacgtgggtcccncaggcctcgaggcgaaggggctgggagtgggtcgctagttgtgtggtatgacggtaagtatagaaagtncggccgagccgtagaacgggccattcacctatctaccgagacgaacgtaacttaccaaacaactattagttagtactcgtagactaaatagaactacgacctagacgacgtccggaaggaccgacgggtacgttaggtaggttaatttacggtggttacgtacgtaaggtaggaagggttaggggacgggggttgtggtaacgg

SEQ ID NO: 256524 - DNA, 774 bp, Homo sapiens
  misc_feature: GYAE6OF01CHIE4.14.55.E11.1.454.CMB.1.raw
  modified_base (182)..(182): a, c, t, g, unknown or other
  misc_feature (182)..(182): n is a, c, g, or t
  modified_base (304)..(304): a, c, t, g, unknown or other
  misc_feature (304)..(304): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagcttgggttttcctcgttgcttcttttaagnggtgtccagtgtcaggtgcagctggtggagtcgtgggggagcgtggtccagccgtgggacgtccctgacctactctcctgtcgacctaacgtctggtacttcacgtcttacagttagttacnggcagtcgctacggtcgggtcccacgacggtcctaccggagggaccgtaaggggtccgtaggggacggttaggggtacgtacgttaaggggttttggtacggttaggggttaacgtaccggggaaaagggttaaaagtttaaaagtaaacgggttaaaagtcggtaccgggaaccccgggtaaccggacccgggttaaggggaaaccggggttcccgttaacgttcccgaaccccgtaacttaccccggttaaacgaagtaaccggtaaaccctaaccttaacccgaaacgtaacgttacgttacgtttaacgtactacgtaacgtaacgtaaacgtagtaacgtcggtaccgtaggaacgacggaccggaacggtaccgacgggtctaggttacgttaacgttcttaggttacgaacggtaaggtaaggtaggggtaacggggtggggtaatacgggtacgttaacggg

SEQ ID NO: 256525 - DNA, 694 bp, Homo sapiens
  misc_feature: GYAE6OF01CL86Q.14.55.E11.1.454.CMB.1.raw
tcagcgtctagtaccacgaccggtgctcgatttagcactcgcacgttgggctctgggagaggagccccagcactagaagtcggcggtgtttccattcggtgatcagcactgaacacagaggactcaccatggagtttggctgagcgttgggtttccttcgttgtcttcttttaagtaggtgtccagtgtcgaggtgcagcgtgggtggagtcggtgggggagggcgtggtccgacgccgtgggtacggtcccgtcgaccgtaccttccttcccgtgtcgtaccaacgttcgtggtattccgagtctttcgaagttagttagtgctatcggctaccggtccgggtcccgcccgtaggcctaccgaggtaggacggggtcgtggagggtgggtcggctggttgtggtaggttagtacggaaggtaaagtaaataaggaaagttcgtcggacccgacggtaccggtagggaacgggtccgtaacgttaccaccgtaacgtctacccgaagaacgtaacctaaacttaccaactaaacgtagttagttacgttactcgtagaactaagtacgtaagtaccgtcggtagacgacgacggacgtacgacgtgttagttcgtaagtttacgtggttacgtacggaaaggtagggttagggtcgggggtaagggggtgttaaacggtccgttacgggtaagg

SEQ ID NO: 256526 - DNA, 532 bp, Homo sapiens
  misc_feature: GYAE6OF01DY5V5.14.55.E11.1.454.CMB.1.raw
  modified_base (281)..(281): a, c, t, g, unknown or other
  misc_feature (281)..(281): n is a, c, g, or t
  modified_base (303)..(303): a, c, t, g, unknown or other
  misc_feature (303)..(303): n is a, c, g, or t
  modified_base (378)..(378): a, c, t, g, unknown or other
  misc_feature (378)..(378): n is a, c, g, or t
  modified_base (421)..(421): a, c, t, g, unknown or other
  misc_feature (421)..(421): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtggggggagcgtggtccagcctgggagtccctgacactctcctgtgcaacgtctggattcagcttcagtagttanggcatgccacgtcggggtcccnccgaggcctccgagggcaaggggctgggagtgggtgctaggttgtggtggtatggaacggaagtaatagaaagtntcgccgacgccggtaggaacgggtccattcaccatctacaganacaacttccaacactatgttagtactctagacaaagtgaaactgacctgagcgcgaggacnggtntgtgtagtcgtgtgtcgagagaggtgggagggtgtcgagtcgtagg

SEQ ID NO: 256527 - DNA, 773 bp, Homo sapiens
  misc_feature: GYAE6OF01AHAQC.14.55.E11.1.454.CMB.1.raw
  modified_base (216)..(216): a, c, t, g, unknown or other
  misc_feature (216)..(216): n is a, c, g, or t
  modified_base (269)..(269): a, c, t, g, unknown or other
  misc_feature (269)..(269): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggnaagtcagagcattaagaacttatttaaatggtatcaacagaaaccagggaacncccctgacctcctgactctatgctgctattcctagtttcgaccacgtacgggttccggggttaccccgtacgtaaacggggtttcaagggttcgggtaccgtaagggttcggggtaacttccgggttagggggaaccctaacgggtttaactttttcccaacccgtttccccgttaaccggtaacccccggttaccgaaccggtaccgttaaccggttccgtttaccggacccttaaaacccggttacggtaaacggtttacgtttttacggtaaacctttaaaccgtttaaccttaccttacggtaacctaaacgtaaccgttaacgtttaaccctaacccggttacccccccttacgttacccgtttaccgggaccgggtaaccggggaacccgtaacggggaccggtagtaaccggtacgaacgggtaccggtaaacgttcggtacggtaccgtacggacccgtaccgttacttaccgttaccggttccttacgttacccg

SEQ ID NO: 256528 - DNA, 740 bp, Homo sapiens
  misc_feature: GYAE6OF01AEK8Q.14.55.E11.1.454.CMB.1.raw
  modified_base (255)..(255): a, c, t, g, unknown or other
  misc_feature (255)..(255): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagcgtggttttcctcgtagctctttaagaggtgtccagtgtcaggtgcaggctggtggagtcgtgggggagcgtggtccaggtccgtgggacggtccctgaccnctctcctgtcgactaacgtcgtaggtacttcacggtaccttgaaggtttagttacgtgggctaacgttggccgtaccggttcggccccgcgacggtcctaccggagggaccggtaaggggcgttgggagggttcgggtagggcgttagggttggtagggtttaggtagtaagggtaacggtaaagttaaggttaaagggaaacgtttgtaccggacccgggtaccggttccgggtaacgggaacgggtaccgtaacgttaccgtaaccgtacgttacccgtacgaaggtaaccgtaactaacgtaacctaaacgacttaagttcgttagtacttacgtaacgtactaaaagtacgtaacgtaccgtacggtagtacggacggaaccgggaacgacggtaccggtagttacggttacgtttacgttacgtggtttacggacgttaaggtacgggtagggtagggggtcgggtaggtacgtaacggg

SEQ ID NO: 256529 - DNA, 698 bp, Homo sapiens
  misc_feature: GYAE6OF01DZZG1.14.55.E11.1.454.CMB.1.raw
  modified_base (198)..(198): a, c, t, g, unknown or other
  misc_feature (198)..(198): n is a, c, g, or t
  modified_base (306)..(306): a, c, t, g, unknown or other
  misc_feature (306)..(306): n is a, c, g, or t
  modified_base (329)..(329): a, c, t, g, unknown or other
  misc_feature (329)..(329): n is a, c, g, or t
tcagcgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagcgtgggttttcctcgttggcttcttttaagaggtgtccagtgtcaggtncagcgtgggtggaggtcggtgggggagcgtggtccagcccgtggggacgtccctgacctactctcctgtgacctacgtctaggattccgagtcttcaagttagttagnggtcatcggctacgtcgggcccncgacggtcctaccggaggcgggaagggtcgtagggtggtggggtcggtactagggtttggtggtacgggtaatagggaacggtaaagttaaagtaaaggaaagttaccgtcggacccggtaacggtacccgtaggggaaaccggtccgtacttaccgaccctacgtcgtaccgagaacgtaaccaacgttaacccaaacgtaacttacgttagttgttaactacgtataactaaagtagtaacgtaacgtaccggtaaggaacgtacgggaccgacggaaccgtacgtcgttcgtagtttacgttaacggtgttacgtgtaaggtaaggagggtagggtagggggtagtacggttgtacgggttaacgg

SEQ ID NO: 256530 - DNA, 666 bp, Homo sapiens
  misc_feature: GYAE6OF01B9MB3.14.55.E11.1.454.CMB.1.raw
  modified_base (355)..(355): a, c, t, g, unknown or other
  misc_feature (355)..(355): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctgggtggagtcgtggggggaggcgtggtccagcctggggacggtccctgaccactctcctgtgctaacgtctggattcagtcttcagttagttatggctatcgctacgtcggggtcccgccgaggcctccgagggccgaagggggctgggaggttggggnggctaggttggtggttggtagtggaacggtaagtaaagtaaggaaaagtgtacgacccggacggcccggtagggaaacggggtccgtacgttccaacccacttaccgtaccgaagaacgtaactaaacttacccaaaactaacctaagttagtttacgtacttacgtacgaactaaagtagaaacgtacggtacccgttaggaacggaacgggtccggaacggaaccgtaccgggtcttaggttacgtagtttaccgtgttcggtacgaggtagagggtgggggaggggttgggtggtacgtcggtaaggg

SEQ ID NO: 256531 - DNA, 699 bp, Homo sapiens
  misc_feature: GYAE6OF01AVBXR.14.55.E11.1.454.CMB.1.raw
  modified_base (296)..(296): a, c, t, g, unknown or other
  misc_feature (296)..(296): n is a, c, g, or t
tcagcgtctagtaccacgaccggtgctcgatttagcactcgcacgttgggtttggggagtctcagtcaggacacagcatggacatgagggtccccgctcagctcctgggggctcctgctactctggctccgaggtgccagatgtgacatccagatgacccagtcctccatccctcctgtctgcatctggtaggagacagagtcaccatctacgttggccgggacaagtcagagactaattaaagtaacttaatttaaagttggtaattaccaaacaacgaaaccgaagggaaaccnccccgtagaccctcctgactctatcgctgactactcctagtttcacgtacgtacgggttccggggtaccctacggtaacggttacgtaggtcggcgtaggtgtagtcggtaggactagttactttcactctaccgtacgtcgacgctacgtcgtacgactaaccgtagtaacgttacgtttacgaaccttaaaccgttaccttaacgttccgtaaccgtaaacgacggtttaaccttaacccgtaacccgttacccccccttacggtttaacccgttcgggaaccgggtaaccgggacccggtaagggaccggtacgaacgtaccgaacggtacccggtaacggttcggtccggtacgtaccgaccgtaccgttacgttaccttcgttccgttccgttacccg

SEQ ID NO: 256532 - DNA, 655 bp, Homo sapiens
  misc_feature: GYAE6OF01AWPM7.14.55.E11.1.454.CMB.1.raw
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (276)..(276): a, c, t, g, unknown or other
  misc_feature (276)..(276): n is a, c, g, or t
  modified_base (306)..(306): a, c, t, g, unknown or other
  misc_feature (306)..(306): n is a, c, g, or t
  modified_base (361)..(361): a, c, t, g, unknown or other
  misc_feature (361)..(361): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgcttcgttttaagaggttgtccagtgtcaggtgcagcgtggtggagtcgtgggggagcgtggtccagccgtgggacgtccctgacnctctctgtncacgtctggattcagtcttnagttagttatggcagtgcacgtcgggtccnccgaggcctcgaggcgaaggggctgggaggtgggtgcgtaggttggtggtggtanggaacggtaagtaaataggaaagtgtcggaccgtacggccggtaggaacgggttcaacgttccaaccgtatccgtaacgaagtaacgaacctaaacttaacccaaactaacgtagttacggtttacgtaacttcgtacgaactaaagtagtaaacgttacgaccgttaggaacggacggaccggaacggaccgtaccggtacgttggttacgttaacgttcgtaggttaggtaaccgaagggtaaggtagggttagggggtagggggttagtacggaacggttcggttaagggg

SEQ ID NO: 256533 - DNA, 685 bp, Homo sapiens
  misc_feature: GYAE6OF01BXU4R.14.55.E11.1.454.CMB.1.raw
  modified_base (317)..(317): a, c, t, g, unknown or other
  misc_feature (317)..(317): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgaccacttctcgtgtgacaacgtcgtggtacttcgagtcttacgagttagttagtggctagtgacctacggtcggggtcccnccgacggcctaccggaggacggaaggggtctaggggaggttggggtcgacgttaggtttggtggttaggtaagtagggaaacggtaaagttaaagtaaaggtaaaacgtgtccggacccggtacggccggtaagggaaccgggtccgtaacgttaccaaccgtactccgtaccgaagaacgaacctaaccttaacccaaacgtaactagttagtttacgttacgtcgtaagaactaaagtagaacgttacgaccgtaggaggacgacggaacggacgacggtcgttaggttagttaacgttacgtggttacgtacgaggtaaggtagggtacgggggtagggggttagtggtaaccgttcggtaaggg

SEQ ID NO: 256534 - DNA, 595 bp, Homo sapiens
  misc_feature: GYAE6OF01DQ24B.14.55.E11.1.454.CMB.1.raw
  modified_base (218)..(218): a, c, t, g, unknown or other
  misc_feature (218)..(218): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggnaagtcagagcaattaagaacttatttaaattggtatacaacaagaaaccgagggaacgcccctgacctcctgatctatgctgcatctagtttgcacgtaggtcgggtcccgtagtaggttcgagtggacaggtggattcgtacggaactagtactttcacttctccgaccgtcgacgctacgtctacgactacctagtaacgtattttacgactaacttactacttacgtactaacgtagtacgttaacctacccgttaccccctacgttaccgtttaccgggcggtaacggggaccgaacgggacggtacgacgtacgaacggtaccgtaacgtcggtcggtacgtcgacctactactcgtacgtcttcgtacccg

SEQ ID NO: 256535 - DNA, 954 bp, Homo sapiens
  misc_feature: GYAE6OF01C1OJ0.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttggctgagcgttgggttttcctcgttgcttcttttaagaggtgtccagtgtcgagggtgcgagtcgtgggtggacggttcgggtggggggcggtcggtcgggtccgacggtcccggtagggggtaccggttccctacggaacctaccgttccgttcccgtgggttacgaccgttaaaccggttcgtagggttaactttccggacgttacgtttacggtaaggtttaacgtttaggtcggtactaagtcggttaccgtaccgggttccgggtacccgacccggaccggtacccgtaccggaacggggaccgggaacggggtcgtagggggtaggtcgggggtacggtcggttagggtttggtttcggtaagggttacgtaacggggaaaagggtaaaggtttaaaaggtaaacggtaaaagtttacggtaccggtacccggggtaaccggacccgggttaaagggaaccgggtccgtaacgttacccaccgtaactacccgtaccggaagtaaccgtaaaccgttaaaccttaacccgaaacgttaaacggttacgtttacggttaacgttaaccgttaacgttaacggaaaccgttaaaagtaacgtaaaccggttaccggtaacccgtaagggtaaaccgggaacggaaccccggggtaacgggtaacccgtaaggggttaaccctttacgggtttaaacgttacgtttaaccgggtacgggtttaacggtaacgggaaacgggttaaggggaacgggggttttgggggggtaaacggggtttaggggtaacgttaaccccgggttaagggttaaggg

SEQ ID NO: 256536 - DNA, 649 bp, Homo sapiens
  misc_feature: GYAE6OF01DN0M6.14.55.E11.1.454.CMB.1.raw
  modified_base (409)..(409): a, c, t, g, unknown or other
  misc_feature (409)..(409): n is a, c, g, or t
tcagcgtctagtaccacgaccggtgctcgatttagcactcgcacgttgggctctgggagaggagcccagcactagaagtcggcggtgtttccatttcggtgatcagcactgaacacagaggactcaccatggagtttgggctgagcgttgggttttcctcgttgcttcttttaagaggtgtccagtgtcaggtgcagctggtggagtcgtgggggagcgtggtccagccgtgggacggtccctgacactcgtcctgtgcaacgtctgacttcagtcttcagttattagtggctagtcgcctacggtcgggtcccgccaggcctcccgaggccggaaggggctggggacggtgggtagcgtaggttggtggttaggtacgtagggaacggtaagtaaataaggtaaagtntcggaccgacggtaccggtaggaacggcgtacttacacccgattccgtaccagtaacgtaacgtaacttacccaataaccgtagtttagttagtacttacgtacgaactaaacgtagtaactacggccgttaggaacgtacgaccgggacgaacgtacggtcgttagttagttacgtttacgtggttacgtcgaaggtggtacgggttggggacggggttgggtaactcggttgtaaggg

SEQ ID NO: 256537 - DNA, 762 bp, Homo sapiens
  misc_feature: GYAE6OF01C20OE.14.55.E11.1.454.CMB.1.raw
  modified_base (312)..(312): a, c, t, g, unknown or other
  misc_feature (312)..(312): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagtcttgggttttcctcgttgctttacgttttaaaggaggttcgtccagttgtcaggtgcagcgtggtggagtcgtgggggagtcgtggtccagtccgtggggacgtccctgacctccttctccgtgacgtccaacgtcgtgtacttcgagtccttagtagttagttagnggcagtcgccgacggttccgggtccgaccacggtcctaccggagggtacggaacgggtcgtgggtagggttgggtcggtacgtaggttgggtgttagggttagaagggtaacggtaaaagttaaagtaaacggtaaagttgtacgacccggtacggtacccggtaggaaccggggtcctaacgttacccaaccgtacgtacccgtaccgaaaggtaacctaaacgtaacctacccgaaacctaacgttatttaccgttagtaacttaccgtaagtaacctaaaagttgtaaactacggtccgtaaggaacggtaccggtaaccgggacggtaacggtacggttaccttagggtttacgtaaacgtttcggtagggtacctaaagggtacggtaagggtagggttacgggggggttagggttaggttaccggtaaggttacgggtaaaggg

SEQ ID NO: 256538 - DNA, 704 bp, Homo sapiens
  misc_feature: GYAE6OF01C910Q.14.55.E11.1.454.CMB.1.raw
  modified_base (692)..(692): a, c, t, g, unknown or other
  misc_feature (692)..(692): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtcccagccgtgggatcgtccgtgactactctcgtgcgacctacgtcgtaggtattacgacgtccttacgtagttagttagtggcctagtcgaccgtacggtccgggtcccgaccgacggtcctaccggagggaccggtaggggtcgtgggtaggttggggcgtacgtaggtttgggtggtacggtagtacggaaacggtaaagttaaagtaaaggtaaagtacgtacggaccggtacggtccggtaagggaaccgggtactactaccacgtactccgtacgaagtaacgtaactaacttaaccaaaactaacgtagtttacgtttaagtactcgtaacaaacttaaagttaaggtaaacttcggaccgttaaggaacggtcggtaacggaaccggtaacgacggttcgtagttaacgttacttaggtcggtagtacgaaggtcggtaagggtgggggttaggggngttacgtaacgg

SEQ ID NO: 256539 - DNA, 648 bp, Homo sapiens
  misc_feature: GYAE6OF01AK5MV.14.55.E11.1.454.CMB.1.raw
  modified_base (171)..(171): a, c, t, g, unknown or other
  misc_feature (171)..(171): n is a, c, g, or t
  modified_base (173)..(173): a, c, t, g, unknown or other
  misc_feature (173)..(173): n is a, c, g, or t
  modified_base (419)..(419): a, c, t, g, unknown or other
  misc_feature (419)..(419): n is a, c, g, or t
  modified_base (481)..(481): a, c, t, g, unknown or other
  misc_feature (481)..(481): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcggtgtttcgcgtagctcttaagagtncngtgtcaggtgcagctggtgagtcgtggggagtcgtggtaccagcccgttgggacgtcccgtgacctcgtctccgtgtcgacctaacgtctggacttcgacgtctacgtagttacgttagtggctaagttcgccgtacgtttccggggccctccggaacggtcctcccggaggaccgaacggggtctggggacgtgggtacggctagttggtagtcgtagtgaacggtaagtaagtacgtaaaggtnttacggaccgtaacggcggttaacggaacggggtcctattccgaactctcttcgaacggtanacctaacgttaccaaacgtactaactggtttatactcgtagtaactaagtacgtaagtccgacgttagaaggccgcggaacggtctaacggtgttacgtaagttaccgttacgtcgggtatgggaccgaggtgtaggggttaccgggagttactacggttcgtaagg

SEQ ID NO: 256540 - DNA, 762 bp, Homo sapiens
  misc_feature: GYAE6OF01CQJAL.14.55.E11.1.454.CMB.1.raw
  modified_base (172)..(172): a, c, t, g, unknown or other
  misc_feature (172)..(172): n is a, c, g, or t
  modified_base (176)..(176): a, c, t, g, unknown or other
  misc_feature (176)..(176): n is a, c, g, or t
  modified_base (368)..(368): a, c, t, g, unknown or other
  misc_feature (368)..(368): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggtttcctcgttgcttctttaagnggtntccagtgtcaggtgcagcgtgggtggagtcgtgggggagtcggtggtccaggccgtggggacgtccctgacactctccgtgtgaccaagtctggacttcgagtcttcgagtagttagtcggactagtggtcctaccggtccgggtcccgaccgtacgggtccacccggagggacgaacgggggtcgtagggngggtcggggtgtacggttaggtttttggacggttagtacgggtaaaggtaaaagttaagtaaggtaaaggtagttacggacccgggaacggtacccgggtaagggaaccggggacccttacgttacccgaacccgtacgttccgtaaccgtaaagggaacctaaacctaaaacgtttaaccccaaaacgtaaccgttaagttacggttaacgttaactttacgtaaacggtaacgtaaaacgttacgtaaacgtaacggtacccggtaagaacgggtaccgaacccgggtaaggacccgtaagggtaccgttaggtacgttacgttacgtggttacgtacgaggtaggtagggtgggggtaacggggttagagtaacggtcggtaggttaacgg

SEQ ID NO: 256541 - DNA, 648 bp, Homo sapiens
  misc_feature: GYAE6OF01DKBUN.14.55.E11.1.454.CMB.1.raw
  modified_base (178)..(178): a, c, t, g, unknown or other
  misc_feature (178)..(178): n is a, c, g, or t
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (306)..(306): a, c, t, g, unknown or other
  misc_feature (306)..(306): n is a, c, g, or t
  modified_base (393)..(393): a, c, t, g, unknown or other
  misc_feature (393)..(393): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgcttcttttaagaggtntccagtgtcaggtgcagctggtggagtcgtgggggagcgtggtccagcctgggacgtccctgacnctctcctgtcncaagtctggattcagtcttcagttagttatggctatcgctacgtcgggtccnccgtaggcctccgaggacgaaggggtcctagggaggtcgggtgctaggttgtggtggtactagggaacggtaagtaataagaaagtntcggaccgaggtccggtaaggaaccgggtcctacttaccactactaccgtacgaagtaacgtaacctaaacttacccaaacgtaacgtagttcggttagtacttacgtagaactaatagtaactagtaccgtagacggacgtaccggaggtaaccgtacggtcgttacggttagttaacgtttaccgtggttacgtacggtaaggaggtaacgggtagggggtaggggttagtacggtaacggttccggtaaggg

SEQ ID NO: 256542 - DNA, 671 bp, Homo sapiens
  misc_feature: GYAE6OF01CV8OE.14.55.E11.1.454.CMB.1.raw
  modified_base (171)..(171): a, c, t, g, unknown or other
  misc_feature (171)..(171): n is a, c, g, or t
  modified_base (274)..(274): a, c, t, g, unknown or other
  misc_feature (274)..(274): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttggctgagctggttttcctcgttgcttcttttaagnggtgtccagtgtcaggtgcagcgtgggtggaggtcggtggggggagcggtggtcccaggtccgtggggacgtccctagactctctcgtgtcgacgacgttcgngtattcagtcttacgagttagtatggctatggctacggttcggccacgaggcctccggaacgggtccgaagggggctaggggagggttggggtagcggttagtttcggtggttaggtaagttacgggaaggtaaagttaaaggtaaggtaaaagttcggtccggaacccggaacggtccgggttaacgggaaacgggtcccgtacgttaccaaccgtacgtcctaccgaaacgacgtaactaccgttaaaccaaccgtaatagttcgttatacgtactacaagtaatacgaagtaccgtacgtaaggacggacgaccggagtacggacgtcgtagttacgtagtacgtgtacgtagaggtaggagggttcggggaggttggaacggtagtcggtaag

SEQ ID NO: 256543 - DNA, 610 bp, Homo sapiens
  misc_feature: GYAE6OF01A9RY3.14.55.E11.1.454.CMB.1.raw
  modified_base (248)..(248): a, c, t, g, unknown or other
  misc_feature (248)..(248): n is a, c, g, or t
  modified_base (492)..(492): a, c, t, g, unknown or other
  misc_feature (492)..(492): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtggtggagtcgtgggggaggcgtggtccaggccgtggggacgtccctgaccnctctcctgtgcaacgtctggattcagcttcagtagttatggcatgcacgtcgggtcccgccgaggcctccgaggcggaaggggctgggaggtggggtggcgtaggttggtggtggtagtggaacggtaagtaagtaagaaagtagtacggccggaacggtccggtaggaacgggccgtacttccaaccgtactcctaccgaagacgaactaactacccaaacaactattcgttagtactcgtanaacgtaatagaatacgctaggacgacgacggacgaacgccggtacgttgtagttagttacgtggttacgtacgacggaggtacggttgggggaggggttaggcgtaggtcggtaaggg

SEQ ID NO: 256544 - DNA, 657 bp, Homo sapiens
  misc_feature: GYAE6OF01DR2A0.14.55.E11.1.454.CMB.1.raw
  modified_base (174)..(174): a, c, t, g, unknown or other
  misc_feature (174)..(174): n is a, c, g, or t
  modified_base (252)..(252): a, c, t, g, unknown or other
  misc_feature (252)..(252): n is a, c, g, or t
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (310)..(310): a, c, t, g, unknown or other
  misc_feature (310)..(310): n is a, c, g, or t
  modified_base (347)..(347): a, c, t, g, unknown or other
  misc_feature (347)..(347): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgcttcttttaagnggtgtccagtgtcaggtgcagctggtggagtcgtggggggagcgtggtccagccgtggggacgtccctgacactctcnggtcgcaacgtctggattccagtcttnagtagttanggcatgcgtacgtcggggtccnccgaggctaccgagggtcaagggggctgggaggtggnggctagttgtgtggtatgaacggaagtaataggaaagttgcggacccgaggtaccggtaggaaacgggtccgaagttcccacctagttcccaccgaaggacgtaacaacgttacccaaactaacgtattcgttagtaacttccgtagtaactaaagtacgtaactacggtacctggaacggtacggacccggtacgggaaccgtaccgggtacgttacggttacgttaacgtttaccgtaggttacgtacgtaagggtacggtagggtacggggggtagggggttaggttacgacggttcggtaaagggg

SEQ ID NO: 256545 - DNA, 754 bp, Homo sapiens
  misc_feature: GYAE6OF01DQ14H.14.55.E11.1.454.CMB.1.raw
  modified_base (180)..(180): a, c, t, g, unknown or other
  misc_feature (180)..(180): n is a, c, g, or t
  modified_base (393)..(393): a, c, t, g, unknown or other
  misc_feature (393)..(393): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccagtggagtttgggctgagtcgttgggttttcctcgttgcttacgttttaaagnggttgtcctagtgtcgaggtgcaggtcgtgggtggagtcggtgggggagtcgtggtccaggtccgtgggacgtccctgacctctcctccgtgtcgccaacgttcgtggattcgagtcttacgtaggttagttagtggctagtggaccgtacggttcgggtcccgcgtacggccgtaccggaggtccggaaggggtcgtgggagggttcggggnggtcgttaggttggtggtaggtaagtggaaacggtaaagttaaggtaaagaagttcgacggacccgtaaggtccggtaaagggacgggtacccgtagttacccacgtaccgtacgtaccgaagtaacgaacctaaccgttaccaaacgtaacgtaacgtttacgtttagttactacggttaacgtaacgtaaagttacgtaaacgtaccgtaccggttaggaaccggtacggtaccccggaaaggtcccggtaacggtgttacggttagtttaaccgttcggttacggtaggttacccggagggttaacgggtacgggttagggggtaacgggttagggtaacgcgggtttcgtaaagggg

SEQ ID NO: 256546 - DNA, 733 bp, Homo sapiens
  misc_feature: GYAE6OF01AUK7C.14.55.E11.1.454.CMB.1.raw
  modified_base (176)..(176): a, c, t, g, unknown or other
  misc_feature (176)..(176): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagtcttgggttttcctcgttgcttcgttttaagnggtgtccagtgtcgaggtgcagcgtggtggagtcggtgggggaggtcgtggtccgagccgtgggacggtcctgactctctcgtgtcgcgtacgtctggtacttacgacgtccttagtaagttacgttagtggtacctagtcgccgtacggtttccggggcccgaccgacggtcccgtccggaggtccggaacggggtcgtgggtaggtgggtacggtcgttaggttggtcggtaggtaagtggaaacggtaagtaaagtaaggtaaagtacgtcggaacccggtacggtccgtagggaccgggtaccttaagtcccggtaactacgttaccgaccgtaaaggtaaccctaaacgtaaccgtttaaccccaaacgtaacgttacggtttacgtttaagtacgttaccgtagaaactttaagaacggtaaacttccggacgtaggaccggtaacgaccggtaagacccggtacgtagttcgttaaacggttcttcgtagggtacctaggaacgggtaggttggggtaacggggtggggtacgttaagcggttggtaagg

SEQ ID NO: 256547 - DNA, 822 bp, Homo sapiens
  misc_feature: GYAE6OF01CHU4K.14.55.E11.1.454.CMB.1.raw
tcagcgtctagtaccacgaccggtgctcgatttagcactcgcacgttggggtttggggagctctgggagaggagcccagcactagaagtcggcggtgttccattcggtgatcagcactgaacacagaggactcaaccatggagtttgggctggagtcgttgggttttcctcgttgcttcttttaagaggtgtccagtgtcaggttgcagcgtgggtagggaggtcggtggggggacggtcggtggtccaggtccgttggggtacggtccctggaacctcgtctccgtgtgcgtaacgtcgtggtattcgagtcttacaggttacgttatcggactagtcgctacggttcgggtcccgccgaggtcccgttacgacgggtacggaacggggggtcttaggggtaacggtgggggtacgaccggttagggttttcggtacggggtttagggtaacgttacgggaaacgggtaaaagttaaaggttaaagggaaaacggtttaccgtggggtacccccggtaaacgggtccccgggttaaggggaaacccggggtcccgtttaagtttaccccgaacccgtaacgttccccgttaacccggaaaggtaaacgtaaccctaaactttacccaaaaccgtaactagtttcggtttaataacgttcgtagaacctaaaagttaggaaaccgtttcggaaccgttaggaaacgggaccgaccgggtaaagggacccgtacggtaggttacgtttaggttaacctttacggtgtaccgtaacggaaggtacgggtaggttagggggggtaggggttggtacggtaacggg

SEQ ID NO: 256548 - DNA, 662 bp, Homo sapiens
  misc_feature: GYAE6OF01CEF83.14.55.E11.1.454.CMB.1.raw
  modified_base (287)..(287): a, c, t, g, unknown or other
  misc_feature (287)..(287): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtggggggagcgtggtccaggcctggggagtccctgaccactctcctgtcgacaacgtctggattcagtcttcagtagttanggcatcgactacgtcggtccgccaggcctcgaggcgaaggggctgggaggtgggtggctaggttggtgtggtatggaacggtaagtaaagtaggaaaagtgtcggacccgacggtcccggtagggaacggggtcccgtattcccaccgtatcccgtaccgaagtaacgaactaaaccttacccaaactaaacgttagttagtttacgtaaccttacgtagtaacctaaagttagaacttaccggaccgtaggaacggaaggtacccggaacggtaccggtacggtcgttaggttacgtttaacgttacgttaggttacgtcgaaggtaggtagggtagggggtagggggttggtaacgtcggttccgtaaagggg

SEQ ID NO: 256549 - DNA, 682 bp, Homo sapiens
  misc_feature: GYAE6OF01EWP44.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggacggtccctgaccactctcctgtgcaacgtctggattcagtcttcagttagttatggcatgcacgtcggggtcccgccaggtccctaccggacgtacgggaacggggtcgtagggagggttgggggtcgacgtaggtttggtggtaggttagtcgggaaacggaaagttaagtaaggaaagtatcggaccgaaccggtccggtaggaaccggggaccgtacgttaccgaaccgtacgtacctaccgagaacgaacgtaacttaacccgaaaccaaactaagttcgtttagttactacgttcgaactaaagtaacgtaaagtaacgtaccgtaggaagtaacggaccggaacggaaccgaccggtacgttaggttagttacgtacgtttttttggacgttacgaggaaggtaggtagggggtaggggttagggtaggtacgtcggtaacggg

SEQ ID NO: 256550 - DNA, 937 bp, Homo sapiens
  misc_feature: GYAE6OF01C0GEZ.14.55.E11.1.454.CMB.1.raw
  modified_base (198)..(198): a, c, t, g, unknown or other
  misc_feature (198)..(198): n is a, c, g, or t
tcagcgtctagtaccacgaccggtgctcgatttagcactcgcacgttgggtttggggagtctcagtcaggacacagcatggacatggagggtccccgctcagctccgtggggctcctgctactctggctccgaggtgccagatgtgacatccagatcgacccagtcctccactccctccctgtctgcatctgtagganacaggataccaccagtcctacgttcggaccgggcaagtcagagactaagttaaacgtaacttaattttaaagttcgggtaataaccgaaaacaaacggaaaaacccgagggggaaaacccgtcccctaacggtaaccccgttaccgtaggtacttacttagttcgacgttcgacctactaccgttaggtttacgactaacgtaggttccggggtacccctagtaacgggtcaggtcggtacgtaggtcggtaactcggtaaggtacgtaaacgttacgttttaccaccgtttaccgtaccggtaaccgttcgaacgtccgtaacgttcgtaccggtaacctaaaccggtttaggtaaacgtttacgttttaccgggaaaccctttaaaaccggttttaccgtaccgttaacgggttaacccctaaaacggttaacccggttttaaacccgtttaaaccccggttaaccccccccggtttaaaccccccccgttttacggggttttaacccccggggtttaaacccgggggacccgggggtaaaccccggggtttaaaccccgggtaaacggggggaaccccggggtttaaacgaaaccgtttaaaacccggggaaccggggtttaaaaccgaacccgggtttttacggggccgtttaacccggttacgggaaaccccttaaaccccgggtttcgttaaccccgttttcgggttaccccttaacggttttaaccccccgg

SEQ ID NO: 256551 - DNA, 750 bp, Homo sapiens
  misc_feature: GYAE6OF01A22ID.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttcgccgggacaagtcagagactattaaagaacttaatttaaaattggtaatacaaacaacgaaaaccgaagggaaaccgcccctcgaaccctcctagtactctatgctcgctactcctagtttcgctacgtaggtcgggtcccgtactaacgggttcgaggtcggacgtacggtggtaacgttcggtacggggtactaaggtacttttccgtaccttcccgtaccgtacccgtacgacggtccgtacgttccgtacggtaccctaaccgttacggtaaacgtttacttttaccgaacctttaaaccttaaccttacgttacgtaaaccgtaaccgtaacgttaacggtttaaccctaacccccggttaacccccccgttacgttaacccggtttacccgggacggggtaaaccgggacccggtaaacggggaccggtaacggtaaacgacccggtaacggtaaccggtaaacgttcgggtccgggaccgtacggacccctaacccttaccgttcgtttccggttacgtttcccgttacccg

SEQ ID NO: 256552 - DNA, 763 bp, Homo sapiens
  misc_feature: GYAE6OF01BWRFK.14.55.E11.1.454.CMB.1.raw
tcagcgtctagtaccacgaccggtgctcgatttagcactcgcacgttgggtttgggggctctgggagaggagcccagcactagaagtcggcggtgtttccattcggtgatcagcactgaacacagaggactcacagtggagtttggctgagtcgttgggttttcctcgtttgcttacgtttttaaaggaggttgtccaggttgttcgaggtcgcaggtcgtgggtggagtcggtggggggacgtcggtggtaccgaggccggttaggggacggtcccctggacctacctcgtccgtgtcgacgtaacgtctaggtattcagtcttacgagttagttagtggacagttcgaccgtacggtcggtccgaccgtacggtccgtaccggaggacggaacggggtcgttagggaggttggggtcgtcgttagggtttcggtggtagggttaacggtaagggaaaggtaaagttaaaggtaaaggaaacgtttcggacgggacccggtaccggtacgggtagggaaaccgggtccgtaacgtacccgtaaccgtacgtccgtaaccgaagaaccgtaaactaaccgtaacctaaacgtaagttacgttcgttaacgtacttaacgtaagaaacgttaaagaacgtaacgtaccgtacggtagaacgacgggacccgaacggaccgtacgtgtttacggtaacgttacgtacgtggttacgagtaagggtacggtaggggtcggggtagggtacgtacggtagttacggg

SEQ ID NO: 256553 - DNA, 716 bp, Homo sapiens
  misc_feature: GYAE6OF01BA2QY.14.55.E11.1.454.CMB.1.raw
  modified_base (306)..(306): a, c, t, g, unknown or other
  misc_feature (306)..(306): n is a, c, g, or t
tcagcgtctagtaccacgaccggtgctcgatttagcactcgcacgttgggctcgtgggagaggagcccagcactagaagtcggcggtgtttccattcggtgatcagcactgaacacagaggactcaccagtggagtttggctgagtcgttgggttttcctcgttgcttcgttttaagaggtgtccgagtgtcgaggtgcgagcgtgggtggagtcggtgggggagtcgtggtcgagccgtgggacgtcctgaccactctcgtgtgacgtaacgtcgtaggtattcgagtcttacgagttagttagnggctagtgacctacggtccggtcccgccgacggtcctcgagggtcgaaggggtctagggaggtggggtgacgtaggttgtggtggtaagtaggaaacggtaaagttaaagtaaaggtaaagtacgtacgggacccggacggtaccgggtaggaacgggtccgtaacgttccgaaccgtacgtacgtaccgaagaacgtaaaccgtaaccttaaccgaaaccgtaacgttacgtacggttttactaacgttacgtaacggaactaaaggtaacgaaagtacgtacccgtaggtaaccgacgggtaaccggacggaaccgtacggtacgttaggtacttaacgttgtcggtacggtacgagggtaagtaggggtacggggtaggggttagtacggtaccgttggtaaacggg

SEQ ID NO: 256554 - DNA, 629 bp, Homo sapiens
  misc_feature: GYAE6OF01B22NL.14.55.E11.1.454.CMB.1.raw
  modified_base (173)..(173): a, c, t, g, unknown or other
  misc_feature (173)..(173): n is a, c, g, or t
  modified_base (191)..(191): a, c, t, g, unknown or other
  misc_feature (191)..(191): n is a, c, g, or t
  modified_base (305)..(305): a, c, t, g, unknown or other
  misc_feature (305)..(305): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagnggtgtccagtgtcaggtncagctggtggagtcgtgggggagcgtggtccagccgtgggacgtccctgaccactctcctgtcgcaacgtctggattcagcttcagtagttatggcagtgcacgtcgggtcccnccaggtcctaccgaggcgaaggggctgggaggtgggtggcaggtttgtggtggtatggaacggaagtaataaggaaagtgtcggcccggaacggtcccggtagggaacgggcccgtagttaccgacctagttcctaccgaagtaacgaacctaaacgtttaccccaaacaaacttagttacgtttagtaacttaccgtgaacctaaagtgtaaacgtacgtacccgtaggacggtaacgcccgggaaggtaccgacgggcttaggtgttaacgttacgtgttggtcaggaggtaggtggggaggggttgtaggagtcgtaaggg

SEQ ID NO: 256555 - DNA, 886 bp, Homo sapiens
  misc_feature: GYAE6OF01CV1LC.14.55.E11.1.454.CMB.1.raw
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
  modified_base (261)..(261): a, c, t, g, unknown or other
  misc_feature (261)..(261): n is a, c, g, or t
  modified_base (270)..(270): a, c, t, g, unknown or other
  misc_feature (270)..(270): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtcccngacnctctctgngactacgtntggattcagtcttagagttagttagcggactagtcggccgtacggttccggggtcccaccggtaacgggtcccttacccgggaaggggtacccgggtaaaggggggtccgtagggggtaacgggttcgggggttacgggtaccggtttagggtttttcggggttaggggtttaggggttaaacggttacggggtaaaacgggttaaaaggttaaaaggttaaaacggggtaaaaggtttacggtacccggggaacccccgggtaaccgggttaccccggggttaaggggaaacccgggggttacccttaaacgtttaccccgaaaccccgttaacgttaccccgtaaacccggtaaaggtaaacccggtaaacccttaaacccgtttaaaccccgaaaaaccgtaaaccgtttaagttttacgggttttaacgtaacgtttacccgtaagtaaaccgttaaaagttacggtaaacgttcggaacccgttagggaacggaccgggtaaccggaacggaccgtaccgggttcgttacggttacgttaacgtttacggtgggttaccgtacggaggtaaacgggtaggggtaggggggtaaggggttcgtaggtaacgg

SEQ ID NO: 256556 - DNA, 810 bp, Homo sapiens
  misc_feature: GYAE6OF01BMZ3I.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtggtggagtcgtgggggacgcgtcggtccagtccgtgggacgttcccctagacctacctcctcctggtacgctaacggtccgtggtaactttcgaacggtcctttacaaggtttagttagtcgggttatcggcctaccggttcgggggtaccccgccgtaacggccgttccgaaggggaccgaacggggggtcgttggggaaggttcggggggtcggtccgttaagggtttcgggtttggttacgggttaacgtaggggaaaccgggttaaaaggttaaacgtaaaggtaaaagggttactaccggggacccgggtaacccggaccggttaacgggaccgggggtacccctacgtttacccaacccgttacgtaccgtaccgaaacggtaaacgtaacctaaacgttacccaaaacgtaactacgtttacggtttaacgtacttacggtacgtaacgtaaacgttaggtaaacgtacgtacccggtagggtaacggtaccggacggtaacggacgtaccgggtcgttaccggttagttacgttagtcggtaacgtcgaagggtagtagggttaggggtagggggttacgtaggtacgttacggtaggttaacgg

SEQ ID NO: 256557 - DNA, 748 bp, Homo sapiens
  misc_feature: GYAE6OF01DIQVL.14.55.E11.1.454.CMB.1.raw
  modified_base (173)..(173): a, c, t, g, unknown or other
  misc_feature (173)..(173): n is a, c, g, or t
  modified_base (247)..(247): a, c, t, g, unknown or other
  misc_feature (247)..(247): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagnggtgtccagtgtcaggtgcagctggtggagtcgtgggggagcgtgtccagcctgggagtccctgacactctccngtgcaacgtgtggattcagcttcgagttagttatggcatcgacgtacgttcggggtccgacccaggcccgtacccgagggccgtaagggggcttggggaaggttcggggttaggctaaggtttcggtaggttgggttaacgtgggaaacggggtaaagttaaataaggaaaaggtttcgcgggacccgtaacggcccgggttagggaaaccggggtccgtaactttcccgaaccctacgttcccttacccgaagtaaggaaccctaaactttaccccgaaacctaaacgtatttacggtttagttaaccgtacgttacgaaccgttaaaagttaggtaaacgttaaccgggaccgttaagggaaacggcccggtaaacccgggacgggtaacccggaaccgggttacgttggtttaacggttaacgttttaccgtaggttacgttacgaaagggtagtaggtacgggggtaggggttggtaaggtcgtaaccggttaaggg

SEQ ID NO: 256558 - DNA, 715 bp, Homo sapiens
  misc_feature: GYAE6OF01AYSNA.14.55.E11.1.454.CMB.1.raw
  modified_base (176)..(176): a, c, t, g, unknown or other
  misc_feature (176)..(176): n is a, c, g, or t
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
  modified_base (322)..(322): a, c, t, g, unknown or other
  misc_feature (322)..(322): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagtcttgggttttcctcgttgcttcgttttaagnggttgtccagtgtcgaggtgcagctgggtggagtcgtgggggagcgtggtccaggccgtgggacgtccngacctctctcgtgngcaagtctggacttcgagtcttacgagttagttagtggtctagtgtaccacgtcggggtcccnccgacggccgtccgaggccggaacggggtcgtgggtacggtggggtaggcgtagggttaggtggttaggtacgtagggaaccggtaagttaacgtaaagggtaaagtacgtacggacccgggtaacggtacccgggtaagggtaaccgggtaccgtacgtttaccgaaccgtaacgtccgtaccgtaacgaacgtaacctaaaccgtacccgtaaacgtaaaccgttagttacgtttaacgtacgtttccgtaagaaccgtaaataacggtaaagtaccgtacgtaagtaacggaggaccccggtaaggacctaaggtcgtagttacgttacgtagttcggtacgtcgaggtagaggttaggggacggggttagggtagtcggttacggacgg

SEQ ID NO: 256559 - DNA, 707 bp, Homo sapiens
  misc_feature: GYAE6OF01CTZXK.14.55.E11.1.454.CMB.1.raw
  modified_base (229)..(229): a, c, t, g, unknown or other
  misc_feature (229)..(229): n is a, c, g, or t
  modified_base (305)..(305): a, c, t, g, unknown or other
  misc_feature (305)..(305): n is a, c, g, or t
tcagcgtctagtaccacgaccggtgctcgatttagcactcgcacgttgggtttggggagtctcagtcaggacacagcatggacatgagggtccccgctcagctccgtggggctcctgctactctggctccgaggtgccagatgtgacatccagatgacccagtctccatccctccctgtctgccatctgtaggagacagacgtccaaccatctacgttcggccgggtanaaagtcagagacgtaattaaacgaacttaattttaaagttggtaactacaaacgaacgtaaaaccgaagggaaccnccccctagaccctcctaggtacttactatcgacctgacctctcctagtttcgaccgtaagtacgggtccgggtacccgtaagtaacggttcaggtcggacgtaggtggacttcggacgggtaatagttattactacttcgaccgtacgtacacgtactacgtctacgacgtaacgtagtaagttctttacgaacctaaccgtttactaaccgttacgtaaccgtaacgtacgttaaccgttaacccgaccccgttacccccgtacggtttaccggttaccgggaaccgggttaaccgggaccgtaaacgggccgtaacgacgtaacggacgtaaccggtaacgtcgggtacgtccgtaccggtacctaccgttattaccggttcgttaccttcggttacccg

SEQ ID NO: 256560 - DNA, 676 bp, Homo sapiens
  misc_feature: GYAE6OF01ET8NB.14.55.E11.1.454.CMB.1.raw
  modified_base (174)..(174): a, c, t, g, unknown or other
  misc_feature (174)..(174): n is a, c, g, or t
  modified_base (465)..(465): a, c, t, g, unknown or other
  misc_feature (465)..(465): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgcttcttttaagnggtgtccagtgtcaggtgcagcgtggtggagtcgtgggggagcgtggtccagccgtgggacgtccctgacctctctcctgtcgcaacgttcgtggtattcgagtccttcgaagttagttatggactagtcggcctacgtcggggtccccacgacggcctcccggaggcgaagggggtctggggacggtggggtgcgtaggtttggtaggtaggtaacgtgggaaacggtaagtaagtaaggaaagttgtcgggaccgtacggccgtaggaacgggtcctacgttccaaccnctcgtacgaagacgaactaacgttacccaactaacgtattggttactatacgtagaacgtaaagtagtaagtagaccgtaggaacgtacggaccggaaggaccgtcggtaccgttaggttaagtttaacgttacggttgggtacgtacgagggtaacggtaggggttacggggggtagggggttagttacggtcggttaccggtaaagggg

SEQ ID NO: 256561 - DNA, 694 bp, Homo sapiens
  misc_feature: GYAE6OF01CWNY0.14.55.E11.1.454.CMB.1.raw
  modified_base (115)..(115): a, c, t, g, unknown or other
  misc_feature (115)..(115): n is a, c, g, or t
  modified_base (162)..(162): a, c, t, g, unknown or other
  misc_feature (162)..(162): n is a, c, g, or t
  modified_base (180)..(180): a, c, t, g, unknown or other
  misc_feature (180)..(180): n is a, c, g, or t
  modified_base (355)..(355): a, c, t, g, unknown or other
  misc_feature (355)..(355): n is a, c, g, or t
  modified_base (572)..(572): a, c, t, g, unknown or other
  misc_feature (572)..(572): n is a, c, g, or t
tcagcgtctagtaccacgaccggtgctcgatttagcactcgcacgttgggctctgggagaggagcccagcactagaagtcggcggtgtttccattcggtgatcagcactgaacanagaggactcaccagtggtaggtttgggctgagtcgttgggttttccncgttgcttcgttttaagnggtgtccagtgtcaggtgcagtcgtgggtggagtcggtgggggagcggtggtccaggtccgtggggacgtccctggacctacgttcctccgtggtcgacctaacgtcgtgggtacttcgacgtccttagtagttaggtttagaggctaagtcggacctacggttcggggaccccncgacgggcctaccggagggtacggaaggggtcttaggggaggtggggtcgacgtagggtttggtaggtacggttagaggaacggtaaagtaagtaggaagtcgtcgaccgacggtaccggaggaacgggcctactcgacctacgtcgtaccgaaggaacaactaaactaccgaaactaacgtattcgttagactctaaggacctaaagtgtaaaccnggtaccgtaggaacggacgtaccggaacgacggtcgtaccgtaggttacgttaatccggtggttaccaggtaggaacgggttagggtacggggaggggttagacgggtaacctgggtaaggg

SEQ ID NO: 256562 - DNA, 639 bp, Homo sapiens
  misc_feature: GYAE6OF01DJWTK.14.55.E11.1.454.CMB.1.raw
  modified_base (173)..(173): a, c, t, g, unknown or other
  misc_feature (173)..(173): n is a, c, g, or t
  modified_base (240)..(240): a, c, t, g, unknown or other
  misc_feature (240)..(240): n is a, c, g, or t
  modified_base (244)..(244): a, c, t, g, unknown or other
  misc_feature (244)..(244): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagnggtgtccagtgtcaggtgcagctggtggagtcgtggggggagcgtggtccagcctggggacgtcccngacnctctcctgtgcaacgtctggattcagtcttacgagttagttatggcatgctacgtcgggtcccgccagggcctaccgaggcgaaggggctgggaggtgggtggcgtaggttgtggtggtatggaacggtaagtaagtagaaagtatggaccgacggcggtaggaacggggccgtaattaccacctactcctaccgaagtacgaactaaacttacccaaactaactagttgtttagttactcgtagacctaaagtagtaactacgaccgtaggacgacggaccggacggaaccgacgggtctaggttagttaagtttaccgttaggttacggttacgaacggtagggtagggttacgggggtaggggggttaggttacggtacgttccggtaaggg

SEQ ID NO: 256563 - DNA, 653 bp, Homo sapiens
  misc_feature: GYAE6OF01CBB87.14.55.E11.1.454.CMB.1.raw
  modified_base (228)..(228): a, c, t, g, unknown or other
  misc_feature (228)..(228): n is a, c, g, or t
  modified_base (296)..(296): a, c, t, g, unknown or other
  misc_feature (296)..(296): n is a, c, g, or t
  modified_base (360)..(360): a, c, t, g, unknown or other
  misc_feature (360)..(360): n is a, c, g, or t
  modified_base (539)..(539): a, c, t, g, unknown or other
  misc_feature (539)..(539): n is a, c, g, or t
  modified_base (644)..(644): a, c, t, g, unknown or other
  misc_feature (644)..(644): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacttggccgggacaagtcaagancaattaagaacttattaaagttgtatacaaacaagaaaaccgagggaaacgccctagacctaccgtanatcaatgactcgacattcctagtttagacacgtaggtcgggggttacccaggtaaaccggtttnaggttcggactaggttggtaacttcgtaggggaactaagttactttaccgaacttcggttacccaccggtacaacgctaacgttcgacgtaccaaccgtaggtaaacgttattttacgaactaacgtttaacctacgtagaaccctaagaacgtacgttaacacccggttaaccccctntaaccgtttcgggacggtaagggaccaaggtacggaacgagtaccgaaggtaacaaccggtggtaccgggactacggacctaccgaacttacgtgtttacccgtntttaacccg

SEQ ID NO: 256564 - DNA, 744 bp, Homo sapiens
  misc_feature: GYAE6OF01BML5M.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtcctccactcctccctgtctgcatctgtaggagacagagtacaccagtctacgttcggccgggacaagtcagtacgacgtaattaaagtaacttaattttaaacgttaggtaactaaccaaaaccgaaacggtaaaaacccggaacggggtaaaacccgtccccccgtagtaaccccttacccgtaggtacttacctaagtcgtccgttacgtacctaacttacccgttaaggtttcgaccgtaacggtcggggttacccgggtcccgtaacgtaacggttcgagggtcggacgtggtacgtagtacggtagggaactagtttacttccgacctcctaccgtaccgtcaggacctagttctacgtactaaccgtagtaacgtttactttacggtaaccttaaccgttacttacgtacgtaacaaccgtaacgttaccgttaacccgtaacccccttaccccgtacgttaccggttaccggggacggtaaccggaccgaacggggcgtaacgcgtaaccgtaggtaaccggtatacggtcggtacctacggactaccgttacgtccgttacttccgtctacccg

SEQ ID NO: 256565 - DNA, 737 bp, Homo sapiens
  misc_feature: GYAE6OF01CNXIR.14.55.E11.1.454.CMB.1.raw
  modified_base (177)..(177): a, c, t, g, unknown or other
  misc_feature (177)..(177): n is a, c, g, or t
  modified_base (242)..(242): a, c, t, g, unknown or other
  misc_feature (242)..(242): n is a, c, g, or t
  modified_base (307)..(307): a, c, t, g, unknown or other
  misc_feature (307)..(307): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagaggtntccagtgtcaggtgcagctggtgagtcgtgggggagcgtggtccagccgtgggaggtccctgacnctctctgtgcaagtctggattcagtcttcagttagttagtggctatgcctacgtcggggtacccnccgaggtcctaccgagggtaccgaaggggtctggggaggtggggtgggactaggtttggtggtaggtagtagggaacggtaaaggtaagtaaggaaagttgtacggaccgggaccggtaccggtagggaacggggtccctaacgtttcccgaaccctacgtccctacccgaaggtaaccgaaaccgttaaaccgttaccccaaaccgtaaacttacgttacgtttacgttaacttacgttacgaaacctaaagttaacgaaacgtaacggtacccgttaaggaacggtaacgggacccggagggaacccgtacgggtcgttacggtttacgttaacgtttacggtaggtttacggtaccgtaaagggtaacggtagggttaacggggggaggggggttagttacgggtaaccgttaccgggttaaagggg

SEQ ID NO: 256566 - DNA, 663 bp, Homo sapiens
  misc_feature: GYAE6OF01BWTWR.14.55.E11.1.454.CMB.1.raw
  modified_base (174)..(174): a, c, t, g, unknown or other
  misc_feature (174)..(174): n is a, c, g, or t
  modified_base (178)..(178): a, c, t, g, unknown or other
  misc_feature (178)..(178): n is a, c, g, or t
  modified_base (246)..(246): a, c, t, g, unknown or other
  misc_feature (246)..(246): n is a, c, g, or t
  modified_base (318)..(318): a, c, t, g, unknown or other
  misc_feature (318)..(318): n is a, c, g, or t
  modified_base (376)..(376): a, c, t, g, unknown or other
  misc_feature (376)..(376): n is a, c, g, or t
tcagcgtctagtaccacgaccggtgctcgatttagcactcgcacgttgggctctggggagaggagcccagcactagaagtcggcggtgtttccattcggtgatcagcactgaacacagaggactcaccatggagtttgggctgagcttgggttttcctgttgcttcttttaagnggtntccagtgtcaggtgcagctggtggagtcgtggggggagcgtggtccaggcctgggacgtccctgaccnctctcctgtgacaacgtctggtattcagtcttcagttacctagtcgactagtcgacctacgtcggggtcccnccgaggtccctacggagggtccggaggggcgtgggaggtggggtgacgtattagtacncgaatgttagacgtaggtaactaagtcggactctaagccgacccgtacgtaccggtaggaaccgggcctacgttaccacctatacccgtacgaagaaccgaactaaccttaaccgaaacgaaccgacgtacgtaagttactcgtagaacctaaacgtaacggaacacgacccgttaaggagaacgtacgtaggaccggaccgtaccggtcgtttaggtacgtttaggttacggttcggggtaagggtaacggtacgggtaaggttacggggtaaggttcggtaaagg

SEQ ID NO: 256567 - DNA, 874 bp, Homo sapiens
  misc_feature: GYAE6OF01CLFQ9.14.55.E11.1.454.CMB.1.raw
  modified_base (181)..(181): a, c, t, g, unknown or other
  misc_feature (181)..(181): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttggctgagcttgggttttcctcgttgctcgttttaagnggtcgtccagtgtcaggtgcagcgtggtggagtcggtggggagtcgtggtccaggccgtgggacgtccctgaacctctcgtcctgtcgactaacgtcgtaggtattcagtcttcagttagttagtggctatggaccgacggttccgggtcccgccgtaggcctaccggaggacggaaggggtcgtgggaggtcggggtgacggtaggtttggtcggttagggtagtcggaaacgggtaaagttaagtaaaggtaagtacgtacgggaccggtaaacggtcccgggtaagggtaacgggacccgttaacgtacccgtaacccgtactttaccccggaaccgtaaacggtaaaccgtaaaaccgttaaacccgtttaaccccaaaaaccggtaaaacttaccggtttaaggttttaccgttaaacgttttaccggaaacgtaaacccggtttaaaataacggggttaaaaccgtttaccgggaaccccgttaaagggggaaacccgggaaccgggtaaaccccccggggaaagggtaaccccgttaaacccggggttacggttttagggttacggttttaaaacggtttttacccggggaaggggttaacggggtaaacggtaaaggttaaccgggtagggggttaaaccggtttacggtaaagtttttcggggttagggtttaaacccgggggg

SEQ ID NO: 256568 - DNA, 683 bp, Homo sapiens
  misc_feature: GYAE6OF01BRNKF.14.55.E11.1.454.CMB.1.raw
  modified_base (388)..(388): a, c, t, g, unknown or other
  misc_feature (388)..(388): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggaggtttgggctgagcttgggtttttcctcgttgcttcttttaagaggttgtccagtgtcaggtgcagctgggtggagtcgtgggggagcggtggtccaggccgtggggacgtccctgaccactctccgtgtcgcaacgtctggattcagtcttacagttagttagtggacagtcgctacgtcgggtcccgaccgagggcctccggaggcgtaaggggtctggggagttggggtcgccgtaggtttggnggttaggtagtacggaacggtaaagttaagaaggtaaaagtcgttacggacccggacgtccgggttaggaaccgggtccgtacgttaccgaccacgttacctaccgaaggtaacaaccaacttacccaaacctaacgtagttacgtttacgtactacgtacgaactaaagtagtaacgtaacgaccgtaggacgacggacccgaagggaccgtacggtgttacggttacgttactttacgtcggtacgtacggtaacgaggtacggtagggggtacgggggttggtacggtacgg

SEQ ID NO: 256569 - DNA, 798 bp, Homo sapiens
  misc_feature: GYAE6OF01CSJKW.14.55.E11.1.454.CMB.1.raw
tcagcgtctagtaccacgaccggtgctcgatttagcactcgcacgttgggtttgggggctctgggagaggagcccagcactagaagtcggcggtgtttccattcggtgatcagcactgaacacagagactcaccatggagtttggctgagtcgttgggttttcctcgttgcttacgttttaagaggtgtccagtgtacgaggtgcgagcgtggtggagtcggtgggggagcgtggtaccgagccgtagggacgtcccagacctactctccgtgtcgactaacgtcgtaggtacttcgaagtcttacaggttagttagtcggactagtcgtaccgtacggttccgggtacccgccgacggtccgtaccggagggacggaacgggtccgtagggtacgggtggggtcggtacgtagggtttggtggtaaggttagtaaggtaaacggtaaaagttaaggtaaaggtaaaacggttcgacccgggtaacggaacccggtaccgggtagggaaccggggtaccttaacgttaccgaaccccgttagtaccgtaaccgtaacggaacgtaacctaaaccgttaacccgaaaccgtaagttaacgtttagttaaccgttaacgttacgtaacgaaaccgttaaagtagttaaaaccgtcgggttaacccgtaggaaaccgggtaccggaacccgggtaacggtaccggaacggttaccggttaagttaacgttacgttacgtggttaccgaggtaaggtacggtagggttacggggtaggggtacgttagtaaccggttacggg

SEQ ID NO: 256570 - DNA, 728 bp, Homo sapiens
  misc_feature: GYAE6OF01DIRE4.14.55.E11.1.454.CMB.1.raw
  modified_base (201)..(201): a, c, t, g, unknown or other
  misc_feature (201)..(201): n is a, c, g, or t
  modified_base (323)..(323): a, c, t, g, unknown or other
  misc_feature (323)..(323): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtncagctggtggagtcgtgggggagcgtggtccaggcctgggacgtccctgaccactctcctgtgacaacgtctggattcgagtcttcagttagttatggctatcggctacggtcggggtcccnccgaggtcctccggagggaccgaagggggtctaggggacggttggggtcggctaggtttggtggttagggtagtagggaaacggtaaagtaaagtaaggaagtatcggacccgtaaccggccggtagggaaaccgggtcccgtaacgtttacccaacccgtacgttcccgtaaccgaaggtaacgaaccttaaccgttacccaaaactaaccgtagtttacggtttagttaacttcctacggtaaacaaagttacggtaaacttaccggaccgtaaggaacggtacgggaaccggtaaacgggaccgtacgggtacgttaggttaacgttaacgtttaccggttggtaaccgttacgaagggtacggttagggttagggggtacggggggttggtagtaaccggg

SEQ ID NO: 256571 - DNA, 712 bp, Homo sapiens
  misc_feature: GYAE6OF01BAFZ1.14.55.E11.1.454.CMB.1.raw
  modified_base (310)..(310): a, c, t, g, unknown or other
  misc_feature (310)..(310): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctgggtggagtcgtgggggagcgtggtccagccgtgggacgtccctgaccactctcctgtgcaacgtctggattcgagcttcagttagttatggctagtgcctacgtcgggtcccncgaggcctccgaggcgaaggggctgggagtgggtgcgtaggttgtgtggtagtggaacggtaaagtaataaggaaagttgtacggacccggaacgtcccggtagggaacgggtcccgtagttaccacctacgtccgtaccgaaggaacgaacctaaacgttacccaaacgtaaactagtttagtttacgtacttacgtacgtaacctaaagtgtaaacgttacggtacccgtaaggaacggtaacgggacccgggaacgggacccggtaaccggggtcgtttaacgggttacggtttaacgtttaacggttggtttacggtacggtaaaggtaagggttacgggttaggggggttagggggggttagggttacgggttaaggttaacccgggtttaaagggg

SEQ ID NO: 256572 - DNA, 864 bp, Homo sapiens
  misc_feature: GYAE6OF01DM3PI.14.55.E11.1.454.CMB.1.raw
  modified_base (182)..(182): a, c, t, g, unknown or other
  misc_feature (182)..(182): n is a, c, g, or t
  modified_base (390)..(390): a, c, t, g, unknown or other
  misc_feature (390)..(390): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggtagtttggctgagtcgttgggttttcctcgttgtcttacttttaagaggtntccgtagtgtacaggtgcagtcgtgggtggacggtcggtggggggagtcggtcgtacccgacggtccggtaggggacggttccctagacctacctccgttccgtagtcggtacctaacggttcctaggtacttaccgacgttacgttacgtaggttactagtgactagtcgaccgtccgggtccgaccgtcgaacggtcacgacgggnggaagggtgtggacgggttgggcgtagttaggttcggtggtagggtactaaggggaacggtaaaagtaacggtaaaggtaagtacgtaccgggaccggtaaccgggtccgggtaagggtaaccgggtaccgttaacgttacccgaacgttacccgtaccgtaaccgtaaggtaaacccgtaaacttaccggttaaaccaaaaccgttaacgttaaggtttacccgttaggttaaactttccggtaaacgtaaccgttaaaacgggtcgttaaaaccggttcgtaacccgggttaaagggaacccgttaacccgggacccggggtaaacggaccccggttacgggttacggtttacggttaaacgtttaacgttaacggggtttcggaaacggttaaaccggaggggtaacgggttaacgggggttacggggggaaggggtttattaaacccgggtgtaccgggtttaaaagggg

SEQ ID NO: 256573 - DNA, 882 bp, Homo sapiens
  misc_feature: GYAE6OF01E1A7F.14.55.E11.1.454.CMB.1.raw
  modified_base (190)..(190): a, c, t, g, unknown or other
  misc_feature (190)..(190): n is a, c, g, or t
tcagcgtctagtaccacgaccggtgctcgatttagcactcgcacgttgggtttggggagctcgtgggagaggagcccagcactagaagtcggcggtgtttccattcggtgatcagcactgaacacagaggactcaccatggagtttgggctgagtcgttgggttttcctcgttgcttacgtttttaaggnggtcgtccgagttcgtcagggtgcgaggtcgtgggtaggagtcggtgggggagtcgtcggtccaggccgtagggaccgtccctagacgtaccttcgtccgtggtcgccacggtcccttcgtacggtactttcccacccgtttcgtaacgtttaccttagtcgtacttagtcgtacccgtacggttccggggccccgacgacgggtcccgtacccgggaaggggtcccgggtaaggggtccgttaggggtacgggttacgggggtccggaaccgtttaagtttacgtacgtacccgaagttagtttacggaacggttaacggtaaacgtttaaaacggccgtaaccggttacgttaacggacccgggtaccccgttaccggttacccggggtaacggtaacccggggtaccctaaccgtttaccccgaaacccgtttaccgtcccggtaaaccgaacgtaaccgttaaaccccttaaaccgttaaaccccgaaaacggaacccgtaaccggtacttaaggttaacctaccggttaaacgaacccttaaaaggtaccggaaccgtacggtaaccggttagaaccgtacggaccggtaaccgggaaccggtacccggtaggttaccgtttaggtttaccggttaaagtttccgggacgggttaaggaaccgggtaggtaccgggtgggttaaacg

SEQ ID NO: 256574 - DNA, 716 bp, Homo sapiens
  misc_feature: GYAE6OF01ASMDG.14.55.E11.1.454.CMB.1.raw
  modified_base (247)..(247): a, c, t, g, unknown or other
  misc_feature (247)..(247): n is a, c, g, or t
  modified_base (329)..(329): a, c, t, g, unknown or other
  misc_feature (329)..(329): n is a, c, g, or t
  modified_base (619)..(619): a, c, t, g, unknown or other
  misc_feature (619)..(619): n is a, c, g, or t
  modified_base (699)..(699): a, c, t, g, unknown or other
  misc_feature (699)..(699): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttggctgagctgggttttcctgttgcttcttttaagaggtgtccagtgtcaggtgcagctgggtggagtcgtgggggagcgtggtccaggccgtggggacggtccctgaaccnccgtctccgtgtgacgtaacgtcgtaggtacttcagtcttacgagtttagtatcggactagtcgcgtacggtcgggtacccnccgtacggcctaccggagggaccggtaaggggtctaggggacggtggggtgtccgtagtttggtggtacggtagtagggaacggtaaagtaaagaggtaaaacgttgtacggacccggtcggaccgggtaggaaccggggtacctattacccaacgtacgtacctacgaacgtaacgtacctaaacttacccaactaaacgttgttacgttagtacttacgtacgtaaataaagtcgtaaacgtacgtacgtaagaacggtacggacccgggtaaggtaccgtacgggtnttacggttaacgttacgtttccgtagggttacggtacgaaggtaccggtagggttaacggggggaggttagggtaaccgnggtttaaccggtaaggg

SEQ ID NO: 256575 - DNA, 653 bp, Homo sapiens
  misc_feature: GYAE6OF01EWCJF.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctccggaggtgccagatgtgacatccagatcgacccagtcctccacttccctccctgtctgctatcgtgtaaggagacagactccaccatcctacgttcggccggacaagtcagacgactaattaaagtaactttaatttaaagttaggtaactacaaacgaacgaaaaccgaagggaaccgccccgtacgaccttaccgtacgacttactagtagctcgctactcgtagtttacgctacgtaggttccgggtacccgtacgtaacggttacgaggtcggacgtacggtggtacgtcggtaggactacggttactttaccgacctccttaccgaccgtcgacgtactacgttacgtacgactaacgtagtaacgtttagttactaccttacttacacgtatacacgtacgtactccgtacccttaccccgtacgtacggttcggaccggacggtaccggacggtacgacgtacgtaacgacggaacgtagtcgtcgacgtcacctactcgtaccttctcgtacgtccg

SEQ ID NO: 256576 - DNA, 777 bp, Homo sapiens
  misc_feature: GYAE6OF01DD4YM.14.55.E11.1.454.CMB.1.raw
tcagcgtctagtaccacgaccggtgctcgatttagcactcgcacgttgggtttggggagtctcagtcaggacacagcatggacatgacgggtccccgctcagctccgtggggctcctgctactcgtggctccggaggtgccagatgtgacatccagatcgacccagtcctaccactcccgtccctgtctcgctacttcgtaggtaacggaagaacgtaggtaccgtaccaacctactactaccgttcgggaccgggactaagacgagacgtactaaagttaaagtaaactttaagtttaaagttcgtaatacgaaaacgtaacgaaaccgaacgggaacctcccctacggacccttcgtacggtacttctagtacgctacgtactactaccgtagtccgactacgggtacggtccgggtaccctaggttacggtacgtacggtggactaggagtagtacggtaagggacttacggttactttccgacgtttccaccggtaacgtcgaacgtacgtaccgttctaacccgtaacgtaaaccgttaggtaaacgttttactaccgtaactttaaaccttacgtacgtaacgtaacctaagtacgttaaacccgttcccgtaacccccgttccccgtaacgttaccgggacgggtaaccgggaaacggttaccggaacgggacggtaaccgtaccgaacgtaccggtaaccggtaggttacggtaccggacccgtacgacccgtactttacggtcttacccgttcgttccgttaaccccg

SEQ ID NO: 256577 - DNA, 749 bp, Homo sapiens
  misc_feature: GYAE6OF01CBBUS.14.55.E11.1.454.CMB.1.raw
  modified_base (225)..(225): a, c, t, g, unknown or other
  misc_feature (225)..(225): n is a, c, g, or t
tcagcgtctagtaccacgaccggtgctcgatttagcactcgcacgttgggtttgggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtggtggaggtcgtgggggnggaaaaaaaacggtggtccgaggccgtggggacggtcccgtcgacactctccgtgtgcaacgtctgattcagcttcagtagttatggcatgcgtacgtcggccgtccgacggcgtacccgacgggacgaaggggtcgtagggaggtggggtggcgtaggttggtggttggtagtaggaacggaaagtaagtaagtaaagtagtacgtaccggacgaccggtaggaacggggtccctaagtttccaacccgtaattccctacccgaaggtaaccgaaactaaacctttaccccaaaaaccgtaaactagtttacggttacggtaacttaccgttaaggtaacctaaaaagttggaaaacgtttaaccgacccgttaagggaaccggtaacggaacccgggaacgggtaaacccgaccgggtaccgtttgggttaaacggttacgtttaaccgttcgggttacggttaccggtaagggaacgggtaagggttaggggggtaaggggggttgggtacgttaaacggg

SEQ ID NO: 256578 - DNA, 926 bp, Homo sapiens
  misc_feature: GYAE6OF01C0YHY.14.55.E11.1.454.CMB.1.raw
  modified_base (179)..(179): a, c, t, g, unknown or other
  misc_feature (179)..(179): n is a, c, g, or t
  modified_base (201)..(201): a, c, t, g, unknown or other
  misc_feature (201)..(201): n is a, c, g, or t
  modified_base (357)..(357): a, c, t, g, unknown or other
  misc_feature (357)..(357): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccagtggtagtttgggctgagtcgttgggttttcctcgttgcttcgttttaagnggttcgtacctagtgtcaggtncgagtcgtgggtggacggtcggtgggggacggtcggtcggtaccgacggtcccgtggggaccggttcccctaggaacctccgttccttccgtagtcgacccgtaacgtttccggtaggtactttccgagtacctttacgtaaggttaacgtttagnggacctagttccgtaccgtaccggttccgggggtacccacggtaaccggccccttaccggaacgggggtaccgaaacgggggggtcccttagggggtacgggttcgggggtacgggtaccggtttaagggtttggtacgggttttaggggttaaccggtacgggaaaaaggggttaaattaaaaacggttaaacggggtaaaaattccgggttacccggaacccgggttaaccggacccggggttagggtaaaacccggggtccccgttaaacgtttaccccgaaaccgttaaccgttacccgtaaaccggaaacgtaaccggtaaacccttaaaccgttaacccgaaaactaaacgtttagttccggtttaagttaccttacgaacgtaactaagtaacgtaaacgtacgggtacgtaggaagaccgggttaaccggaggtaaccggttacggtagtcgttaacggttacgtttaaccggtaggttacggtaacgaaggggttacggttaacggggtagggggggttacggggttaggtaaccgttaacgggtacggggtttaaaggg

SEQ ID NO: 256579 - DNA, 628 bp, Homo sapiens
  misc_feature: GYAE6OF01A7LL5.14.55.E11.1.454.CMB.1.raw
  modified_base (172)..(172): a, c, t, g, unknown or other
  misc_feature (172)..(172): n is a, c, g, or t
  modified_base (305)..(305): a, c, t, g, unknown or other
  misc_feature (305)..(305): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccagccgtgggacgtccctgacactctcctgtgcacgtctggattcagtcttcagttagttatggcagtcgcacgtcggggtcccnccgaggcctccgaggcggaaggggctgggaggtgggtggctaggttggtggtggtatggaacggtaagtaagtaaggaaagtgtcggaccggtacggccggtaggaacgggccgtaacttccgaacctatccgtaccgaaggaacgaacctaaacgttacccaaactaactagttagttacgtactcgtagaactaaagtgtaaactacgcctaggaaggtaccggaccgaggaccgtacggtcttaggtagttacgttccgtggttacggtacgtagggaggtagggtagggggaggggttaggacggtacgtcggtaaggg

SEQ ID NO: 256580 - DNA, 582 bp, Homo sapiens
  misc_feature: GYAE6OF01BBTSP.14.55.E11.1.454.CMB.1.raw
  modified_base (180)..(180): a, c, t, g, unknown or other
  misc_feature (180)..(180): n is a, c, g, or t
  modified_base (293)..(293): a, c, t, g, unknown or other
  misc_feature (293)..(293): n is a, c, g, or t
  modified_base (314)..(314): a, c, t, g, unknown or other
  misc_feature (314)..(314): n is a, c, g, or t
  modified_base (366)..(366): a, c, t, g, unknown or other
  misc_feature (366)..(366): n is a, c, g, or t
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
  modified_base (424)..(424): a, c, t, g, unknown or other
  misc_feature (424)..(424): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccaggccgtgggacgtccctgacacgtctcctgtgcaacgtctggattcagtcttcagttagttanggcatgccacgtcgggtcccnccaggcctccgaggcgaaggggctgggaggtgggtgctaggttgtgtggtanggaagtaagtaanaggaagtangacgtagacgtccggtaggacggcctattcgacctntaccgtaccgaaggacgactaacgttaccaactacgtattggttactatactagaactaagtacgaaatcgtacgagagacgcggaagcgacgtgtacggtagttacttacgtggtacgtacgaggtaggtagggttggggaggggttggtgtaacgg

SEQ ID NO: 256581 - DNA, 730 bp, Homo sapiens
  misc_feature: GYAE6OF01DY516.14.55.E11.1.454.CMB.1.raw
  modified_base (264)..(264): a, c, t, g, unknown or other
  misc_feature (264)..(264): n is a, c, g, or t
  modified_base (327)..(327): a, c, t, g, unknown or other
  misc_feature (327)..(327): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagtcttgggttttcctcgttgcttctttttaagaggtgtccagtgtcaggtgcagctggtggagtcgtgggggagcgtggtcccagccgtgggacgtccctgacactctctgtnacacgtctggattcgagtcttacgagttagttagtggctagtcgccgacggttggggtacccncgaggcctaccgaggccgaaggggtctagggcggtggggtgtctaggttggtggtggtaataggaacggtaaaagttaaagtaacggaaaagtcgtacggaccccggtaacggtccgtaaggggaacgggtacccgtaagttacccgaaccgtacgtacccgtacccgaaggaacgtaactaaacccgttaccaaaaccgtaactacgtttaggtttacgtaacgttacgtacgtaaacaaaacgttagaaacgttaccggacgttaggacggaaccggccgggaaacggtaccggacggtacgttaggttaacggtttaacgtttacggtaggttacggtaacgtaagggacggttacgggtaggggggttagggggttacggtaggtacggttaaccgggg

SEQ ID NO: 256582 - DNA, 655 bp, Homo sapiens
  misc_feature: GYAE6OF01DMSLM.14.55.E11.1.454.CMB.1.raw
  modified_base (208)..(208): a, c, t, g, unknown or other
  misc_feature (208)..(208): n is a, c, g, or t
  modified_base (261)..(261): a, c, t, g, unknown or other
  misc_feature (261)..(261): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccagtggagtttgggctgagcgttgggttttcctcgttgcttcttttaaggaggtgtccagtgtcaggtgcagcgtgggtggngtcggtgggggagtcgtggtccagccgtgggacgtccctgacctctctcgtgngcaacgtctgtattcgagtccttagagttagttagcggcagtcgctacggtcgggtacccgccgaggcctcgagggacggaaggggtcgtgggagggtgggtggtacgtaggttgtggtaggtagtacgggaaacggtaagtaaagtaaggtaaacggttgccggtaccggaaccggtccggtaagggaccgggccgtacgttaccacctacgtaccgtaccgaagaaacgtaactaaaccttacccaaactacgttagttgttacgtactctacgaataagtagtaacgtacgacgtagacggacgaccggaggaccgacgtctaggttgtaacgttcggtgttaggcgtagtagggtagggtggggtaggggttaggtacgtagtggtaagg

SEQ ID NO: 256583 - DNA, 799 bp, Homo sapiens
  misc_feature: GYAE6OF01BWZ5W.14.55.E11.1.454.CMB.1.raw
  modified_base (183)..(183): a, c, t, g, unknown or other
  misc_feature (183)..(183): n is a, c, g, or t
  modified_base (297)..(297): a, c, t, g, unknown or other
  misc_feature (297)..(297): n is a, c, g, or t
tcagcgtctagtaccacgaccggtgctcgatttagcactcgcacgttgggtttggggggctctgggagaggagcccagcactagaagtcggcggtgtttccattcggtgatcagcactgaacacagaggactcaccagtggagtttgggctgagctgggttttcctcgttgcttcttttaagnggtagtccagtgtcaggtgcagcgtggtggagtcgtgggggagcgtggtccagcctgggacgtccctgacactctcctgtgcaacgtctggtacttcgagtcttcagtagttanggcatgcacgtcgggtccgccgaggcctccggaggggaacggggcgtagggaggttggggtcctcgacggctaaagtcgaaggttggggttaccgtaagggtcgggtaaagttacctacggtttaccggcccggtacccggttcgtacccgggttagggaaccgggggttcccggtttcccgttccgtaaccgtttccgtaccccgtaacggaacgtaacccgtaactttacccgaaaggtaaccctaaccttaccgtttaactttttaccgttaacctaaacgttacgggtaaccgtacggtaacccgttaacgggaaaacggtaacccggaaacgggtaaccgaaccggggggtacctttagggttttaacggtttttcgggtaaggttaaccgggtaaaaggtaacgttaaacgggtaaggttaaccgttacgttaacgtaacgtttaaaccccggtaagggttttacgggggaacgggttcccgtttacggtaacggg

SEQ ID NO: 256584 - DNA, 702 bp, Homo sapiens
  misc_feature: GYAE6OF01CE20X.14.55.E11.1.454.CMB.1.raw
  modified_base (313)..(313): a, c, t, g, unknown or other
  misc_feature (313)..(313): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggaggcgtggtccaggccgtgggacggtccctgaccactctcctgtgcacgtctggattcagtcttcaggttagttagtggactatcgccacgtcgggtcccnccgaggcctccgaggacgaggggctgggaggtgggtgacgtggttggtggttaggtagtaggaacggtaaagtaagtaaaggtaaagtagcggaccgtacggacccggttagggaacgggtcccgtacttaccaacccgtacgttacccgtaccgaaggtaaaccgtaaccttaaacgttaaccccaaacgtaaccgtagttacggtttacgtacttacgtaacgtaactaaagttacgtaaacgttacgtacccgttagggaacgtaacgggacccggaacggtaccgtacgggtcgttaggttacgttaaccgtttacgtcgttaaggtcgtaaggtaggtagggtggggggtaggggttagggtcggtacggttaccggttaaggg

SEQ ID NO: 256585 - DNA, 650 bp, Homo sapiens
  misc_feature: GYAE6OF01DJSVM.14.55.E11.1.454.CMB.1.raw
  modified_base (173)..(173): a, c, t, g, unknown or other
  misc_feature (173)..(173): n is a, c, g, or t
  modified_base (177)..(177): a, c, t, g, unknown or other
  misc_feature (177)..(177): n is a, c, g, or t
  modified_base (242)..(242): a, c, t, g, unknown or other
  misc_feature (242)..(242): n is a, c, g, or t
  modified_base (282)..(282): a, c, t, g, unknown or other
  misc_feature (282)..(282): n is a, c, g, or t
  modified_base (302)..(302): a, c, t, g, unknown or other
  misc_feature (302)..(302): n is a, c, g, or t
  modified_base (340)..(340): a, c, t, g, unknown or other
  misc_feature (340)..(340): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagnggtntccagtgtcaggtgcagctggtggagtcgtgggggagcgtggtccagccgtgggagtccctgacnctctctgtgcaacgtctggattcagtcttacagtagttanggcatgcacgtcgggtaccnccgaggcctccgaggcgaaggggctagggaggtggggngcgtaggttgtggtggtatacggaacggtaagtaatagaaagtgtcggacccggacgtccggtaggaacgggtccgtattccgactacgtcctacgaagacgtaactaacttacccaaactaactagttagtttacgttacttccgtagaactaaagtacgtaaacgtacgtaccgtaggaacggacggaaccggaggaaccgtaccgggtcgttaggttacgttaacgtttacgttgggttacgtacgaagggtaggagggttacggggggtaaggggggttggtaaggtaccggttccggtaaagggg

SEQ ID NO: 256586 - DNA, 698 bp, Homo sapiens
  misc_feature: GYAE6OF01A8U8P.14.55.E11.1.454.CMB.1.raw
  modified_base (159)..(159): a, c, t, g, unknown or other
  misc_feature (159)..(159): n is a, c, g, or t
  modified_base (176)..(176): a, c, t, g, unknown or other
  misc_feature (176)..(176): n is a, c, g, or t
  modified_base (194)..(194): a, c, t, g, unknown or other
  misc_feature (194)..(194): n is a, c, g, or t
  modified_base (326)..(326): a, c, t, g, unknown or other
  misc_feature (326)..(326): n is a, c, g, or t
  modified_base (370)..(370): a, c, t, g, unknown or other
  misc_feature (370)..(370): n is a, c, g, or t
tcagcgtctagtaccacgaccggtgctcgatttagcactcgcacgttgggctctgggagaggagcccagcactagaagtcggcggtgtttccattcggtgatcagccactgaacacaggaggactcaccatggagtttgggctgagcttgggttttccngttgcttacttttaagnggtgtccagtgtcaggtncagcgtggtggagtcggtgggggagtcgtggtccagccgtgggacgtccctgactactctccgtgtcgacacgtctaggacttcgagtcttacgagttagttatcggactagtcgccgtacgtcgggtcccnccgacgcccgtaccgaggcggaaggggcgtgggacggttggggngtcgtaggttggtggttggtagtacggaaacggtaaagtaaagtaaggaaagttcgtccgggaccggacggtacccgggtagggaaccgggtaccgtaacgtttaccgaacccgtgttacccgtacgaacgtacgtaaccctaacttaaacccaaacgtactaacgttgtttaacgtacgtctaacgaactaagtagaagttccgacgttagaacgtacggaccggagtaccgtccgtagttacgttacgtaacgtttcgaggttacgtaagaggaggttagggtaggggggtacgggttaggtacccggtaaggttacgggttaagg

SEQ ID NO: 256587 - DNA, 797 bp, Homo sapiens
  misc_feature: GYAE6OF01CP4K9.14.55.E11.1.454.CMB.1.raw
  modified_base (186)..(186): a, c, t, g, unknown or other
  misc_feature (186)..(186): n is a, c, g, or t
  modified_base (207)..(207): a, c, t, g, unknown or other
  misc_feature (207)..(207): n is a, c, g, or t
  modified_base (754)..(754): a, c, t, g, unknown or other
  misc_feature (754)..(754): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagcttgggtttttccctcgttgcttcttttaaggnggttgtccagtgtcgagggtncagcgtgggtggacggtcggtgggggaggtcggtgggtccaggccggtggggacgtcccctgacctactcctccgtgtcgacctaacgtctggtacttacagtctttacgtaggttaagttagtcgggactagtcgccgttacggttccgggtacccgcccgagggtcccgtaccgggagggtaccggggaaacgggggtcggttaggggtaggggtttcgggggtcggttacgttagggttttggtgggtttacgggttaacggtagggtaaaacgggttaaagtaaaggtttaaacggaaagggttttacgcccggaaccccgggtaccggtaaccgggttacggggaaccgggtacccgttacgttccccgaaccgttactacccgttacccgaaggtaaccgtaaaccgtaacgttaacccaaacgttaactacggtttacggttttacgttacgtacctaaggtaacctaagtaccgtaaagttcggacgttaggaacggacgaccggaggccgtacgtagttcggttattacgttacggtntcgttaagaggtaggaggggtggggtaagggtgtaggtaacgg

SEQ ID NO: 256588 - DNA, 599 bp, Homo sapiens
  misc_feature: GYAE6OF01CBNRR.14.55.E11.1.454.CMB.1.raw
  modified_base (192)..(192): a, c, t, g, unknown or other
  misc_feature (192)..(192): n is a, c, g, or t
  modified_base (273)..(273): a, c, t, g, unknown or other
  misc_feature (273)..(273): n is a, c, g, or t
  modified_base (307)..(307): a, c, t, g, unknown or other
  misc_feature (307)..(307): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtagganacagagtccaccatccacttgccgggcaagtcagagcaattaagaactatttaaattggtatcaacagaaaccaggaaacncccctgacctctgatctatgctgcatccagtttncacgtggtcgggtcccgtcaaggttcaagtggcaggtgactcgtggacagtatttcactctcgaccgtcgagcacgtctacgactaacctgaagttagttttacgacgtaaacctttacgttacgtacgtaacaacgtaacgtaacgttaaccgaacccgttacccccctacgttaaccgtttccgggaccgggtacgggtacccgaacggcggaagacgtacgacgtaaccgtaagtcggtcggtaccgtaccgacgtaccctagtaccgttcgttaccgttcgttacccg

SEQ ID NO: 256589 - DNA, 970 bp, Homo sapiens
  misc_feature: GYAE6OF01CRMWZ.14.55.E11.1.454.CMB.1.raw
  modified_base (347)..(347): a, c, t, g, unknown or other
  misc_feature (347)..(347): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggaggtttgggctgagtcgttgggttttacctcgttgacttacgttttaaggaggttgtcccgaggtgtcaggtgcaggtcgtgggtggacggtcggtgggggacggtcgttggtccacggtccgtaggggtacgtccctagacctacgttccgtccgtagtcgaccgtaacggttcgtaggtacttcgacgtaccgttacgtaaggtttaaggttcngggaccttagtccggcgttaaccggtcgggtcccaccgaggtcccgtcggaaggggaccgtacgggggtcgttagggacggttaggggtcgtacggtaaggtttcgggtaggttacggggtaaacgttacgggggtaaaaacgttaagttaaaacggtaaacgggtaaacggtttacccgaccgggaaccccgggtaacgggtacccggggttaaacggggtaaacccgggtccgttaacccggttaaccctaacccgttaacgttcccccggtaaaccgtaaaccggtaacgtaaaacccgttaacccgttaacccgtaaactaaaccggttcggtttaggtttaaccgttaacgttaccgtaacggtaaacccgttaaaggtttaacccggaaaggttacccggtaaccgggttaaggtaaacccgggtaaccggtaacccccgggtagggtaacccggttaaccgggttaccgtttaaaccgggttaccggttttaaacgtttacccggtagggtttaaccccggtaaagggtaccgggttaaacggggttacgggttaaacggggggggttacggggttaacgggttaaccggtaaccggtttaaccggggttaaaggg

SEQ ID NO: 256590 - DNA, 633 bp, Homo sapiens
  misc_feature: GYAE6OF01A0E4R.14.55.E11.1.454.CMB.1.raw
  modified_base (304)..(304): a, c, t, g, unknown or other
  misc_feature (304)..(304): n is a, c, g, or t
  modified_base (339)..(339): a, c, t, g, unknown or other
  misc_feature (339)..(339): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggacgtccctgacactctcctgtgcacgtctggattcagtcttcagttagtatggcagtgcctacgtcgggtcccnccgaggcctccgaggcgaaggggctgggagtgggngcgtgttggtggtagtagtggaacggtaagtaagtagaaagtcgtcggacccgaacggtcccggtagggaaccgggtccgtacttccgaacctacgtccgtaccgaacggaacgtaaccgtaaacttacccaaactaacgtaagttcgttagtactacgtacgaactaaagttgaatcgacgtaggacgacggaccggaacggaccgacgggtcttaggtagttacgttacgtggttagtccgaaggtagtacgggtagggggtaggggttagttacggtacgtcggtaaaggg

SEQ ID NO: 256591 - DNA, 733 bp, Homo sapiens
  misc_feature: GYAE6OF01CBZKR.14.55.E11.1.454.CMB.1.raw
  modified_base (183)..(183): a, c, t, g, unknown or other
  misc_feature (183)..(183): n is a, c, g, or t
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
  modified_base (435)..(435): a, c, t, g, unknown or other
  misc_feature (435)..(435): n is a, c, g, or t
tcagcgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggtttttcctcgttgcttcttttaagaggtntccagtgtcaggtgcagctgggtggagtcgtggggggagcgtggtccagccgtggggacgtccctagaccacttcctcctggtgacctaacggtctggatttccaggtcctttagaagttaggttatcgggactagttggacctacggtcgggtccccgccgaggcctaccgagggcgaagggggcttagggcggttgggngctaggtttgnggtaggtatcggaaacggtaagtaaacgtaaggaaacgtntcggacccgaaggtccggtaaggaacggggtacccgtacgtttaccgaacccgtaacgtaccgtaccgtaacgaacgtaactaaactttacccaaaactaaacgttagttaggtttaacgttattaccgttaacgaacgtaaagttacgaaagttacggtaccgtaagggtaacgaacggacccggacggaaccgtaccgggtacgttacggttaacgtttaacgtttacgttggttacgtacggtaaggtaggtagggttggggtaacgggggttacggtaggtacgtcgggtaagg

SEQ ID NO: 256592 - DNA, 785 bp, Homo sapiens
  misc_feature: GYAE6OF01CSF9G.14.55.E11.1.454.CMB.1.raw
  modified_base (351)..(351): a, c, t, g, unknown or other
  misc_feature (351)..(351): n is a, c, g, or t
  modified_base (374)..(374): a, c, t, g, unknown or other
  misc_feature (374)..(374): n is a, c, g, or t
tcagcgtctagtaccacgaccggtgctcgatttagcactcgcacgttgggctcgtgggagaggacgcccagcactagagtcggcggtgtttccattcggtgatcagcactgaacacagaggactcaccagtggtaggtttggctggagtcgttcgggttttcctggtttgctttacgttttaaaggcggtcgtccagttgtcgaggtgcgagtcgtgggtggtacggtcgggtgggggacgtcggtcggtccgaggtccgtgggggacggttccctaggaacctaccgtttcctaccggttggacgtaccgtaacgttcgtaggtacttcgacgtcttagaagttagtagnggctagtcgcgtacggtcggccnccggaggcccgtacggggagacggggtcgtagggagggtgggttacggaggttaggtttggtaggtaagggttaagaaccgggaaggtaaaaggttaaagtaaaccggtaagtacgtccggaccggtacgggtacggttaagggaaccgggtacctaacttaccgaaccgttacgtaccgacgaaagggtaacaaccttaaacgaccaaaacgtagttacgtttaggaccttaagtaccaagtaacgtaaagtacgttaaagaccgaacggacggtaaccgaaccgggtacgaaccgggaccgtaccgggttaagttacggtacgtttaaaccgtggtccggttaaggacgtaggtaggggacccgggttaggggtaagggttcggaacgtacggtacggttggttaacgg

SEQ ID NO: 256593 - DNA, 778 bp, Homo sapiens
  misc_feature: GYAE6OF01D7R0H.14.55.E11.1.454.CMB.1.raw
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
tcagcgtctagtaccacgaccggtgctcgatttagcactcgcacgttgggctctggggagaggagcccagcactagaagtcggcggtgtttccattcggtgatcagcactgaacacagaggactcaccatggagtttgggctgagcttgggttttcctgttgcttcttttaagaggtgtccagtgtcgaggtgcagcgtgggtggagtcgtgggggagcggtggtccagccgtgggacgtccctgaccnctccnctgtcgacaacgttcnggtattcagtcttacagttagtttagnggcagttcgccgtaacggttcgggggtcccaccggacgggtcctacccgaggggaccggaagggggtctggggaacgggttgggggacgcgttaggttggtggttagggtaatagggaacggtaaagttaaagtaagtaaaggtcgtcgggacccggacggtcccggtaacgggaaccggggtccgtaacgtttaccgaaacccgttacgtaccttaacccggaaagtaccggtaaacctaaacgtttaacccccaaacgtaaacttaggtttagtttaacgtacgttaacgttacggaaccttaaaagttacggtaaacttacggtacccgttagggaaacgggtaccggaacccgggtacggtaaccggtacgggttacttacgggtttagtttaacgtttaccggttagttaggtccgtaaaggtcgggtaagggttcggggggtaaggggttcggtaacgtagtcccgggttaaggg

SEQ ID NO: 256594 - DNA, 872 bp, Homo sapiens
  misc_feature: GYAE6OF01CCGRM.14.55.E11.1.454.CMB.1.raw
  modified_base (185)..(185): a, c, t, g, unknown or other
  misc_feature (185)..(185): n is a, c, g, or t
  modified_base (349)..(349): a, c, t, g, unknown or other
  misc_feature (349)..(349): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccagtggagtttgggctgagcgttgggttttcctcgttgcttacttttaagnggtcgtccagtgtcgaggtgcagcgttagggtggaggttcggtggggggacgtcggttcggtaccaggtcccggtggggtaccggtcccctggaacctaccttccgtccgtggtcgaccgtaacgttcgtggtattccgagtcctttacgagtttaagttacgnggtactatcggacctacggtccgggtcccaccgtaggcccgttaaccggagggaccggtaacggggtcgtagggggtacggttcggggttacggtccgttaggggtttggtaaggttacgggtacgtaacgggaacggttaaaagttaacggtaaagtaaccggtagtacccgggacccggacgggttaccgggaggtaaaccggggtccttaacgttacccgaaccgttacgttacccgtaacccggtaaaggtaaccgaaaccctttaaacttaccccggaaaacgttaacgttacgggtttacgtttaacgttaccctacggtaaccgtaaacttaacggttaggtaaaccggtagttaccccgggtaaggaaacggcccgggttaaccggaaggtaccggttacggtccgttaagggtttacgtttaactttacggggatttacggtaaccggtaaagggttgggttaaacggggtaggggggttaaggggtaccggttacgtaacccgggtttagggg

SEQ ID NO: 256595 - DNA, 548 bp, Homo sapiens
  misc_feature: GYAE6OF01C1KM4.14.55.E11.1.454.CMB.1.raw
  modified_base (256)..(256): a, c, t, g, unknown or other
  misc_feature (256)..(256): n is a, c, g, or t
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (304)..(304): a, c, t, g, unknown or other
  misc_feature (304)..(304): n is a, c, g, or t
  modified_base (313)..(313): a, c, t, g, unknown or other
  misc_feature (313)..(313): n is a, c, g, or t
  modified_base (319)..(319): a, c, t, g, unknown or other
  misc_feature (319)..(319): n is a, c, g, or t
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
  modified_base (376)..(376): a, c, t, g, unknown or other
  misc_feature (376)..(376): n is a, c, g, or t
  modified_base (403)..(403): a, c, t, g, unknown or other
  misc_feature (403)..(403): n is a, c, g, or t
  modified_base (412)..(412): a, c, t, g, unknown or other
  misc_feature (412)..(412): n is a, c, g, or t
  modified_base (432)..(432): a, c, t, g, unknown or other
  misc_feature (432)..(432): n is a, c, g, or t
  modified_base (453)..(453): a, c, t, g, unknown or other
  misc_feature (453)..(453): n is a, c, g, or t
tcagcgtctagtaccacgaccggtgctcgatttagcactcgcacgtttgggtttgggggagctctgggagaggagcccagcactagaagtcggcggtgtttccattcggtgatcagcactgaacacagaggactcaccagtggagtttgggctgagcttgggttttcctcgttgcttcttttaagaggtgtccagtgtcaggtgcagctgggtggagtcggtgggggagcgtggtccaggccgtggggacgtcccngactactctctgtgacacgtntggattcagtctnagtatangnatgcncgtggtccncaggcncgaggcgagggctgggagtggtgntgttgngtagtagtagacgaagtataagagtancgcgaggtcgaggacgcgtatacactntctacaganactactacaacatatgttanctcagtaacaagtacgaatancgtacgaacgaggaccggtacggacgtcggtcgtaggttacgttatttaggtcgtagtacgaggtacggtagggtagggtaggggtgtagtacgg

SEQ ID NO: 256596 - DNA, 711 bp, Homo sapiens
  misc_feature: GYAE6OF01ENNOK.14.55.E11.1.454.CMB.1.raw
  modified_base (157)..(157): a, c, t, g, unknown or other
  misc_feature (157)..(157): n is a, c, g, or t
  modified_base (178)..(178): a, c, t, g, unknown or other
  misc_feature (178)..(178): n is a, c, g, or t
  modified_base (185)..(185): a, c, t, g, unknown or other
  misc_feature (185)..(185): n is a, c, g, or t
  modified_base (299)..(299): a, c, t, g, unknown or other
  misc_feature (299)..(299): n is a, c, g, or t
  modified_base (319)..(319): a, c, t, g, unknown or other
  misc_feature (319)..(319): n is a, c, g, or t
tcagcgtctagtaccacgaccggtgctcgatttagcactcgcacgttgggctcgtgggagaggagcccagcactagaagtcggcggtgttccattcggtgatcagcactgaacacagaggactcaccatggagtttgggctgagcttgggttttccncgtttgctcttttaagaggtntccagtntcaggtgcagctggtggagtcgtgggggacgcgtggtccaggtccctggggacgttcccctgacctacgttctccgtgtcgactaacgtctggattcagcttcaggtcgttagngtcatgctacgtcgggtccncgacggcctaccgaggccgaaggggtcctagggtaggtcgggtggaccgtaggttggtggttacggtaggttacggaaaccggtaaggtttaaacgtaaaggtaaaccgttagtaccggacccggaaccggtcccggttaaggaaaccggggtcccgtaacgtttacccgacccgagttacctaccgaacgaacgtaacgtaacttaccgaacctaactacgttacgtttacgtacttaaccgtagtaactaagtacgaacttacgaccgtaggaacggtacggaaccggtacggaaccgaccggtaccgttagttacgttaacgttaaccgttggtaccgtcaaaggtaccgtaggtcgggtagggggtacgtacggtagtccggtaaggg

SEQ ID NO: 256597 - DNA, 692 bp, Homo sapiens
  misc_feature: GYAE6OF01A27ZW.14.55.E11.1.454.CMB.1.raw
  modified_base (175)..(175): a, c, t, g, unknown or other
  misc_feature (175)..(175): n is a, c, g, or t
  modified_base (249)..(249): a, c, t, g, unknown or other
  misc_feature (249)..(249): n is a, c, g, or t
  modified_base (315)..(315): a, c, t, g, unknown or other
  misc_feature (315)..(315): n is a, c, g, or t
  modified_base (360)..(360): a, c, t, g, unknown or other
  misc_feature (360)..(360): n is a, c, g, or t
  modified_base (403)..(403): a, c, t, g, unknown or other
  misc_feature (403)..(403): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagtcttgggttttcctgttgcttcttttaaggnggtgtccagtgtcaggtgcagcgtgggtggagtcgtggggggagcgtggtccagccgtgggacgtccctgaccnctctccgtgtcactaacgtctggattcgagtcttcaagttagttagtggacatgcacgtgggtccncgaggctcgaggcgaagggctgggagtcgggtagcgtaggttggnggttaggtaagtaggaacggaaagttaaagtaacgaaaggttntacgggaccgtaacggcccggttaagggaacgggtacccgtacgttaccgaaccctaagtaccctaaccgaaagtaacggtaacctaaacgtttaaacccaaactaaaccttaagttacgtttacgtaacttacgtacgtaaactaaaagtacgtaaataccggaccgttaggaacggtaacggaccggtaacgggaaccgacggtacgttagttacgttaacgttacgttggtacggtcgaaggtacggtaggtaaggggtaggggttagtacgtagtacggtaaagg

SEQ ID NO: 256598 - DNA, 850 bp, Homo sapiens
  misc_feature: GYAE6OF01COU0I.14.55.E11.1.454.CMB.1.raw
  modified_base (191)..(191): a, c, t, g, unknown or other
  misc_feature (191)..(191): n is a, c, g, or t
tcagcgtctagtaccacgaccggtgctcgatttagcactcgcacgttgggtttggggtacgatttgatgttacctgatgcttagaggtcttttcctggaagcagggctatttgttgcttcagcaccgtagtcgcctcgtcatcacgcctcagtccttgtacttttccggatttcggacctacggaaaaccncgtaccctaacacgtaccgttaaacccgggaccaacccggtccgcccggacctaacactacgcccttcctcccccgtccccctgactaacgtaaccaaccaagtacaaggtaacttacttaacctcgttcccagtcgtaacctaccgtccgttttaccggccttccggtaccggtttaacgggggtcctaccgtacccaccccgttccggacccccgttaacgtttaaccggttacggaccgtaaccggtaaccccgtttcggtccccgttaccgggcggtacggtccgggtccttttaccgacccgttacgttttacgtacgtttaaccttacgtcgtacgtaacgtcttaccgttcgaccttacctttcgactaactcccgtacacgtctataccgtcctacgacacgtacctacccgtaccttacgacggtacgtaaccttaacgaaccggtacccctacccttaacccccaacccgaaacaccgtaactaacgtaccgtcccgtacgtaccgtaccgcccgggtacttaccggtccgttaccgggtacgaccgtttacgggtttacccggttcccgtacccgttttacctcccgttaaaccccgttcccgtaccgttaccgttaccggtacgttaaccttccgtaacgttaccgg

SEQ ID NO: 256599 - DNA, 738 bp, Homo sapiens
  misc_feature: GYAE6OF01AF7GZ.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggcctccgaggtgccagatgtgacatccagatcgacccagtcctccactccctccctgtctgctacttcgtagtaggacgacagagtccaacctatcctaccgttcggcccgggtacaacgtcgaagacgtactaagtttaaacgtaactttaagttttaaacgttaggtaactacgaaaccgtaacgaaaacccggaaggggaaccctccccgtacgtaccccttcgtacgtactttcgtactcgaccttcgacccttactacccgtttagtttaccgaccgtaaccggtacggggttccccggggtaccgttacggtaaccggttcggacgggtgacgtgggtcgtacgttaccgggtaggaactacgttacttccctacgtccgtacccgacgtcgatccgtacgtcgtaaccacggtaacctaggttacttacttactaccgttaacttactactaacgtacgacgtaccgttacgtacctaccccgttacccgttacggtccggttaacgggaccggtaaccggaacggcgacggtactacgtaccgagggtacgtaccgttggaccgtccgtacacctaccgtcttaggttccttccgttcgtaccccg

SEQ ID NO: 256600 - DNA, 700 bp, Homo sapiens
  misc_feature: GYAE6OF01C83TG.14.55.E11.1.454.CMB.1.raw
  modified_base (132)..(132): a, c, t, g, unknown or other
  misc_feature (132)..(132): n is a, c, g, or t
  modified_base (186)..(186): a, c, t, g, unknown or other
  misc_feature (186)..(186): n is a, c, g, or t
  modified_base (190)..(190): a, c, t, g, unknown or other
  misc_feature (190)..(190): n is a, c, g, or t
  modified_base (312)..(312): a, c, t, g, unknown or other
  misc_feature (312)..(312): n is a, c, g, or t
  modified_base (314)..(314): a, c, t, g, unknown or other
  misc_feature (314)..(314): n is a, c, g, or t
  modified_base (318)..(318): a, c, t, g, unknown or other
  misc_feature (318)..(318): n is a, c, g, or t
  modified_base (375)..(375): a, c, t, g, unknown or other
  misc_feature (375)..(375): n is a, c, g, or t
  modified_base (478)..(478): a, c, t, g, unknown or other
  misc_feature (478)..(478): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagagactnaccatggagtttggctggagtcttgggttttcctcgttgacttacgttttaagnggtntccgagtgtcaggtgcagcgtggtgtgtcggtggggacgtcgtcgaccagccgtgggacgtccctgaccgtactcgtcgtgagacctacggtcgtgtacttcgagtccttagagtagttagngntacncggtacctacgggttccggacccgtcgacgtccgtacggaacggtacggtacggggntggggtaggtgggtctcggttaggttcggtaggtagaacggtaggaaacggtaagtaaggtaagaacggtgaccggacgtacggcggtacggaacgggccctnttacccgaactctaccgtaacgagtaacctataaccgtaccaaacgtacgtagttagtttacgaattcgaagtaaactacgtaagtaaccgtagtcgtagggaaccgtcgaaccggtaccgacggtaaccgttgtaaggtttaaccggttattccggttaaggttcccgtaaggtaggtaaaggggttccgttaggggggtaacgttggtcggttaaacggg

SEQ ID NO: 256601 - DNA, 790 bp, Homo sapiens
  misc_feature: GYAE6OF01B50IW.14.55.E11.1.454.CMB.1.raw
  modified_base (232)..(232): a, c, t, g, unknown or other
  misc_feature (232)..(232): n is a, c, g, or t
tcagcgtctagtaccacgaccggtgctcgatttagcactcgcacgttgggtttgggctgggagaggagcccagcactagaagtcggcggtgtttccattcggtgatcagcactgaacacagagactcaccagtggagtttgggctggagtcgttgggtttttcctcgttgcctttacgttttaaagaggttgtccagtgtcaggtgctagcgtagggtggagtcggtggggngcgtggtccgagccgtgggacgtccctgacctctcgtccgtgtcgactaagtcgtaggtactcgagtccttacgaagttacgttagtcggctacggttcggaccgtaccggttcgggtccccgccgtacggtcccgtaccggagggtaccgggaaggggttcgtaggggtaggtcggggtacgacgttaggttggtagtaggttagtacgggtaacggtaaagtttaaagaaaggtaacgttcggtaccgacccggtaaccggtccgggtaaagggtacccgggtaccttaacgtacccgtaaccgtacgtcccgtaacgaacggtaacgtaaactaaccgttaacccgaaataaccgttagttacgtaacgttacctgtaacgtacgtaaagtacgtaacgtacggccgaaaggtacgaccggtacggaacggtaccgtacgggttacgttacggtttacggttacgtttacggtaggacggttacggtaagggaacggggttaggggttaacgggggtagggggttacccggttacggtaagtacgggttaacggg

SEQ ID NO: 256602 - DNA, 740 bp, Homo sapiens
  misc_feature: GYAE6OF01DOS2T.14.55.E11.1.454.CMB.1.raw
  modified_base (156)..(156): a, c, t, g, unknown or other
  misc_feature (156)..(156): n is a, c, g, or t
  modified_base (173)..(173): a, c, t, g, unknown or other
  misc_feature (173)..(173): n is a, c, g, or t
  modified_base (437)..(437): a, c, t, g, unknown or other
  misc_feature (437)..(437): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttggctgagcttgggttttccncgttgcttcttttaagnggtgtccagtgtcaggtgcagctggtggagtcgtgggggagcgtggtccagccgtggggacgttccctgacctacgttcctccgtaggtcgaccaaacgttctggaactttcgaaggtccttacgagttagttatggactagtcggctacggtcgggtcccgcgaggtcctccgaggcgaacggggctgggaggttggggacgcgtaggtttcgtggtaggttaactagggaaacgggtaaattaaaagtagggtaaaacgttnacgggtaccccgaacggttcccgggtagggaaaaccggggtccctaagtttacccgaacccgtacgtacccgttaacccgaggtaaacgaactaaacttacccgaaactaaccgtagttacgtttagtactcgtacgtaacgtaaatacgtaaactcgtacccgtaggacggaaccgggtaccggaacggacctaccgggtacttacgggttattaaacgttttccgagggtttccgtaaggaagggtaacggtaggttacggggggtaaggggttggttacgggtacgttaccggtaaaggg

SEQ ID NO: 256603 - DNA, 802 bp, Homo sapiens
  misc_feature: GYAE6OF01DVZQC.14.55.E11.1.454.CMB.1.raw
tcagcgtctagtaccacgaccggtgctcgatttagcactcgcacgttgggtttggggagctctgggagaggagcccagcactagaagtcggcggtgtttccattcggtgatcagcactgaacacagagactcaccatggagtttgggctgagcgttgggttttcctcgttgcttcgttttaagaggttgtccagtgtcgaggtgcgagtcgtggtaggaggtcggtggggaggcggtcggtccagccgtgggacgtcccgtgacctactccgtcgtagtcgtaccgaaacgttcgtaggtattccacgttcttacgtagttaggttaagtcggtacagttgaccgtacggttcgggtcccgaccgaggtcccgtaccggacggggtaccgaacggggtcgtaggggtaggtcgggtaggtcgttaggttttggtgggttaggttacgtaagggtaaaccggtaaaggttaaagtaacggtaaaggttacgtcggaccgtaccgggtcggtaaggaacgggtcctacgttacccgaacgtaccgttaccgaaccgtaaggactaaaccgttaaactttaacccgaaaccctaagttaacgttacgtttagttaactacgtacggttaactaaaacgttcggtaaaacgttacgacccgttaaggaggtaacccggtacgaaccgggtaacctaaccgggttcgttacggtttaacggtttaacgtttacgggtggttaaacgtcggttaaacgggtaggttaaccgggtaggggggttacgggttagggttggttaaaccggg

SEQ ID NO: 256604 - DNA, 852 bp, Homo sapiens
  misc_feature: GYAE6OF01EXXUD.14.55.E11.1.454.CMB.1.raw
  modified_base (797)..(797): a, c, t, g, unknown or other
  misc_feature (797)..(797): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggaggtttgggctgagtcgttgggtttttcctcgtttgcttcgttttaaaggaggtcgtccagtgtcgaggtgcagcgtggtggtagtcggtgggggagcggttggtaccgaggtcccggtagggtacgtcccgtcgtacctacttcctccgtagtcgaccgtaaccggttcgtacggttattaccgaagtcctttaggtaacggtttagtttaacggcgccgtagttaccggaccgtaccggtttccgggccccgtacgtaacgggcccttaccggacgggtacggaaggggttccgtggggtaggtcgggttacgacgtttaggttggtacggtttaggtaagtacgggttaaacggtaaaagttttaaacgaacggtaaaacggttcgtacccgggtacccgggtaacgggttaccccgtaaggggtaacccgggtacttacccgtaaccctaaaccgttcgtaccgttaaccgaaggtaaacctaacctaacgttaacccctaaggtaactaggtttttacggttataccggttacgtacgaaacgttaaacgttggaacgttaccgtaccggtaacgaacgtacccggtaaacgggtaccgaaacggttcggttctttaaaaccggttaggttttaccgttcgtaagggtttccgaaaccggnggtaacggttaggggtaggggttacgggttaacgagtttccgaacggttaaaggg

SEQ ID NO: 256605 - DNA, 694 bp, Homo sapiens
  misc_feature: GYAE6OF01DJX4B.14.55.E11.1.454.CMB.1.raw
  modified_base (311)..(311): a, c, t, g, unknown or other
  misc_feature (311)..(311): n is a, c, g, or t
  modified_base (684)..(684): a, c, t, g, unknown or other
  misc_feature (684)..(684): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccggaggtgccagatgtgacatccagatcgacccagtcctccatccctcctgtctgctatctaggaggagacagtacgtacacctataccacgttggccggacaacgtcgaagacgactaagtttaaaagaaactttaattttaaaagttggtaactacaaaacaagaaaccgaggggaaaccnccctaggaaccttctagtattcctaagtcgtcttacggctaacttccgtaagtttcgacgtaaacgtcgggttaccggggtaccccttagtaacggggttctaggtcggtagaggtttggaaccgtggtaaggaaccttaagttactttaccaaccttcgtaaccaccggtacacgactacggtcttacgactaacgttagtaaacgttctttagaaccttaacttacgttaactagtaacctaagtaagtaaccgttactaacccgtacccccttagttaccggttcgggaacggttaacgggacctaaagggccggaacgtagacgaacgtaccgtaagcggtacgcttagacccgatacgttatccgttntcttaacccg

SEQ ID NO: 256606 - DNA, 888 bp, Homo sapiens
  misc_feature: GYAE6OF01C3SOC.14.55.E11.1.454.CMB.1.raw
  modified_base (180)..(180): a, c, t, g, unknown or other
  misc_feature (180)..(180): n is a, c, g, or t
  modified_base (262)..(262): a, c, t, g, unknown or other
  misc_feature (262)..(262): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttggctgagtcgttgggttttcctcgttagcttacgttttaaaggnggttcgtccagtgtcgaggtgcgagtcgtggtggacggtggtggggggagtcgtggtccgaggtccgtaggggacgttcccnggaacctccttccgtccgtggtcgaccgtaacgtcgttcggtaactttcgacgttaccgtttagtaaggtttagttacgtcggtactacgtcggtcccggttaaccgggttccggggtaccccgtccggaacggtccccgtaccggaacggggtaccggtaagggggtccgtaggggtaagggttcggggtacggtacggtttaggttacggtgggttacggtaaggtaggggtaaacggtaaagttaaacggttaaggtaaacgtccggacgggtaccccggtaccggtccggtaacgggaaccggtacccgttaacgttaccccgaaccgtacgttacccggtaacgaaggtaaaccgttaaacttaaacccttaaccaaaaccgttaagttacggtttacgggttaactttaacgtaaccgttaacggtaaataaaccgtagggtaaacccgttccggaaacgttaacgggaacgtaccgggaaccggtaaccgggtacgtaacccgggttagttagggtttaagttaaaccgggttagggtacggggtaaggtaggtaaaccggttggggtagtaaccggggtttaattagggttttaacgtggggttaagggtttacgggg

SEQ ID NO: 256607 - DNA, 827 bp, Homo sapiens
  misc_feature: GYAE6OF01CCZ2N.14.55.E11.1.454.CMB.1.raw
tcagcgtctagtaccacgaccggtgctcgatttagcactcgcacgttggggtttggggagtctcagtcaggacacagcatggacatgagggtccccgctcagctccgtggggctcctgctactctggctccggaggtgccagatgtgacactcagatcgaccagtccactctccctccgtgtctcgctacgttcgtaggtaggacgactaggactaccaacctactaccgtacggttccgggaccggaactaagcgaagacgaacttaaagttaaacgtaaactttttaaagtttaaaggtttacggtaactaaccgaaaacggtaaaaccggaaaaccgggaaaccggggtaaacccctccccgttaacccgtaaccgttacccgtaagttaactttaccgtttaagtccgacttacgtaacctacggttttaccgttacggtttacgaccccggttaaacggggttccggggttaccggggtaccccggttaaaggttacggtttacggaagggttcgggaacgtaggtaacgtccggtagggtacggaaacttagttaccttaccacgttacccaccgtacgtagacggtctaacggtctacggaacctaaacggtagtaaatttcgttacaaactttacgtttacagttacggaaactaacggtactttaacccgtacccaaccccgtttacccgacgttttaccgggacggggggaaccgtaaaccgggcgaagggcgtaatacggaacgaacgggttacagggttcccggacgaacccgtctaacgttacgtaccgttattccgttacgttccctacccgg

SEQ ID NO: 256608 - DNA, 737 bp, Homo sapiens
  misc_feature: GYAE6OF01EZERZ.14.55.E11.1.454.CMB.1.raw
tcagcgtctagtaccacgaccggtgctcgatttagcactcgcacgttgggtttggggagtctcagtcaggacacagcatggacatggacgggtccccgctcagcctccgtggggctcctgctactctggctccggaggtgccagatgtgactatccagatcgaccctagtcctccacttccctccctgtctgctagttcgtaggtaaggacgaccgagacgtccaactacgtctacgtcggccggacaagtcgaagacgacgtaattaaacgtaactttaagttaagttacgtaactaacaaacgtaaacggaaaccgaacggaacctcccgtacggtacctacgtgtaacttctagtcgtctacgctacgttcgtagttacgacggtacggtcggtaccgtagtaggtcgaggtcgacgtcggtgtacgcggtagtactagttactacgtcgtctaccgtacgtcgagtccgtacgtcgaaccacgtaatacgtattaccgttacaccctttaaagtctacgtaacaacgtacggtaacccttacgtaaccccgttccccgtaaccgtcgttaaccggggtaccgggaaacggttacccggaaggtaccgggtaacgtaacggttacccgagggtaaaccgtaccgggtaacggtccggttaacggccgttacctaacccgttaaccgttcggtttaccggttaccttcccgtttaaccgcccccgtttaacccgg

SEQ ID NO: 256609 - DNA, 796 bp, Homo sapiens
  misc_feature: GYAE6OF01AYJI3.14.55.E11.1.454.CMB.1.raw
  modified_base (187)..(187): a, c, t, g, unknown or other
  misc_feature (187)..(187): n is a, c, g, or t
  modified_base (218)..(218): a, c, t, g, unknown or other
  misc_feature (218)..(218): n is a, c, g, or t
  modified_base (293)..(293): a, c, t, g, unknown or other
  misc_feature (293)..(293): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccagtgggagtttgggctggagcgttgggttttcctcgttgcttcttttaaggnggtgtccagtgtcagggtgcgagcgttgggngggtagtcggtgggggagcggtggtccaggccgtgggacgtccctgaccacttcgtcctgtcgcctaacggttcngggtattcgagtcttacgtaggtaagtttagcggactatcgggacctaccggtcggggtccccggaccgtaccgggtcctacccgggaacgggccgggtaaaggggggtcgttacggggtagggttcggggtagggccgttaggggttggtttggtaggggtttaagacgggtaaacggtaaaggttaagtaaaaggtaaggtaccgtggtaaccccggtacggaccgggtacgggaacggggtcccggttaatcccggtaacctaacgttaccgtacccgtaaaggaaccgttaaaccggttaacccttaaccgaaaccgtaaaccgtttaagttcgggttttaacgtacttacgtaacgttaaccgtaaagtaaggtaaccgtacgtaccgtagggaccggtaaggaccgaacggtaccggtacgtggttacgtagttacgttacgttgtcggtacgagggtaggtacggggtacggggtagggggtgtggtcggtacggg

SEQ ID NO: 256610 - DNA, 838 bp, Homo sapiens
  misc_feature: GYAE6OF01DBOAV.14.55.E11.1.454.CMB.1.raw
  modified_base (108)..(108): a, c, t, g, unknown or other
  misc_feature (108)..(108): n is a, c, g, or t
  modified_base (182)..(182): a, c, t, g, unknown or other
  misc_feature (182)..(182): n is a, c, g, or t
tcagcgtctagtaccacgaccggtgctcgatttagcactcgcacgttgggtttgggggctctgggagaggagcccagcactagaagtcggcggtgtttccattcggtnatcagcactgaacacagaggactcacagtggagtttggctgagtcttgggttttcctcgttgcttcttttaagnggtgtccagtgtcaggtgcagctgggtaggagtcgtggggggagtcgtggtcccagccgtggggacgtccctaggacctacttcctccgttggtacgacgtaacgttctaggtattcgagtctttaacgaggtttagttacgtcgggcctaagttcgggaccaaccgttccgggggtaccccgtaccgacgggtccctacccgggaagggaccgggtaaaggggggttccttagggggtacgggttggggtcggtacgttaggttttggtaggggtacgggtttaaggaaggtaaacgggtaaaagtttaaaaccgaaaggttaaaaaggttccggccggacccggtaacggtccgggttaaagggaaccggggtaacctaccgtttacccaacccgttacgtacccgttaacccggaaaggaacgtaaaccctaaacttaacccccgtaaaataaaccgttagttacggtttaacgtacgtttaaccgtaagaaaccttaaagtaacgaaacgtttaccgaccggttaagaaacgggaccggtaacccggaacgggtaccggtaccgggacttaggttaacgtttacgttaacgttgtacggtaacgagggtaggttaggggacggggaaggggtttcggaggtaccttacgggg

SEQ ID NO: 256611 - DNA, 709 bp, Homo sapiens
  misc_feature: GYAE6OF01B6S5R.14.55.E11.1.454.CMB.1.raw
  modified_base (192)..(192): a, c, t, g, unknown or other
  misc_feature (192)..(192): n is a, c, g, or t
  modified_base (251)..(251): a, c, t, g, unknown or other
  misc_feature (251)..(251): n is a, c, g, or t
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
  modified_base (457)..(457): a, c, t, g, unknown or other
  misc_feature (457)..(457): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgcttcttttaaggagtgtccagtgtcaggtncagcgtggtggagtcgtgggggagcgtggtaccagccgtgggacgtccctgacctctcncctgtcncacgtcnggtacttcgacgtcttagagttagttagtggctagtcgaccgtacggttcgggcccgcgacggtcgtcggacggtcggaacggggtcgtagggaggtgggtcggcgttaggttcggtggtaggtacgaggtaaacggtaaagtagtaaacggaaagtgtacgaccggacgtcggtagacgggtctatcgacncgtctaccgaagtacgactaactaccaactaacgtcgttagttacagttaccgtagtaaacctaagtggaaacttaccggtacctagggaaccggtaacggaacccggacggggtaacccgtacccgggttacgtttagtttaacccggtacgtttttaaccggacgtttacggtaacggacggtttaacgggaggggtttagggggtacgggggttagggttaaactcgggggtttaaacccggtaaaggg

SEQ ID NO: 256612 - DNA, 764 bp, Homo sapiens
  misc_feature: GYAE6OF01A3P0E.14.55.E11.1.454.CMB.1.raw
  modified_base (249)..(249): a, c, t, g, unknown or other
  misc_feature (249)..(249): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctgttgcttcttttaagaggtgtccagtgtcaggtgcagctgggtggagtcgtggggggagtcgtggtccaggcccgtgggacggtccctgaccnctctcctgtcgcctaacgtctggatttcgacggtctttacgaagttacgttagtggctagtcggcctacgtggggttcccgacctacgggcctaccgaggggcgtaaaggggggcctaggggaggttcggggtaggtcgtaggtttggggttcggtagggttaagttacgggtaaacgggtaagttaaaaggttaaggtaaaaggttacgtacggacccggggaacgttaccgggtagggtaaccgggcccgtaacgttacccaaccgtaacgttcccaaccggtaaagtacgtaaacctaaacgttaacccaaactaacgtattcgtttaacggttatacggtactaacgtaaagtacggtaaacttaggaccgttaggaaggtaccggaaccggacgtaccggaaacggttccggttaggttaacggtttacgttaaccggtgttaacggtacggtaaggtagtaacgggttcgggggtaaggggttccggtagtaccgttccggttaaaggg

SEQ ID NO: 256613 - DNA, 716 bp, Homo sapiens
  misc_feature: GYAE6OF01EFCWA.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccagtgggtagtttgggctggagtcgttcgggtttttcctcgttgcctttacgtttttaaaggcggtcgtccaggttgtcgaggtgcagcgtggtggagtcggtgggggagcgtcggtccgaggccggttgggacgttccctaggacctccgtcgttacccgtggtcgaccgtaacgttcgtggtacttcgacgtcttacgtaagtttagttacgtggtactagtcggtacgtcggtcggggtcccacgacgtccgtaccgagggtacgagggtcgtagggtacggtgggtacgcgtaggttcggtaggtagtaggtaggtaacggtaaagtagtaacgtaagtgtacggacgtacggcggtaggacggtaccgtactaccgactacgtcaccgagaacgtaacctaacgttaaccgaaactatagttagttattacgactacgactaaagtcgaaacgtcgacgtaaggacacggacggtacggacgaccggttgtacttaagttaacgtcggttacggtagtaggaacggttaagggtacgggtacgggggttacggggtagtttacgggaacccgttaagggttaggg

SEQ ID NO: 256614 - DNA, 715 bp, Homo sapiens
  misc_feature: GYAE6OF01BOFO7.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgcttcgttttaagaggtgtccagtgtcaggtgcagcgtggtggagtcggtgggggagtcggtggtccaggcccgtaggggacgtccctagacctacgtctccgtgtcgcaacgtcgtggattcagcttcgaggttattagtggctaagtcggaccacgttcgggcccgcgacggtcctaccgagggtcggaacgggtcgtagggagggttgggtacggtacgtggtttcggtggttaggtaacgtaggaacgggtaagtaaagtaacggtaaagtacgtcgacggacgtacggtaaggacggtcgtaacttacaccgtactccgtacgaagacaacgtaacttaaccaaactaatgttagttactacgttacgtagtaacaaagtacgtaacgtacggccctaaggaacgggtaacgtaccgggtaacgaaccgtaccgggttagttaaccgggttaagtttaacttaccgggttagttacggttaacgaagggtaacggtacggggttagggggtaagggggttcggtaaacgtaggtttcccggtaaagggg

SEQ ID NO: 256615 - DNA, 770 bp, Homo sapiens
  misc_feature: GYAE6OF01CH9OO.14.55.E11.1.454.CMB.1.raw
  modified_base (254)..(254): a, c, t, g, unknown or other
  misc_feature (254)..(254): n is a, c, g, or t
  modified_base (310)..(310): a, c, t, g, unknown or other
  misc_feature (310)..(310): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcacatggagtttgggctgagcttgggttttcctcgttgctcttttaagaggtgtcagtgtcaggtgcagcgtgggtggagtcgtgggggagcgtggtccaggccgtggggacgtcccagacnctctcctgtcgaccgaacgttctcggtattccgagtccttcgagttagttagtggnatgaccgtacgtcgggtacccgccgagggtcctccggaacggcgaagggggtctagggacggtggggaggtcgttaggttggtaggtgggtaaggtagggtaaacggtaaggtaaagtaacggtaaaagtcgttacggacccggtaaccggaccgggttaacggggaaccggggaccgttacgtttaacccgaacccgttaactaccccgttaaccggaaacggaacgtaaaaccgtaaacttaccccgaaaaacgtaacctaggttttaggtttaagtaaccgttacgtacggtaaactaaaaagtcggtaaaacgttacccggtcttaagggaaacgggtaccgggtacccgaaaaggggtaccctaaaccgggggtcttaggttacggttaatttacccggtggttaccgtagtagggtaacggtaggggtaggggtcggggttaggacggttacgg

SEQ ID NO: 256616 - DNA, 770 bp, Homo sapiens
  misc_feature: GYAE6OF01D65GU.14.55.E11.1.454.CMB.1.raw
  modified_base (240)..(240): a, c, t, g, unknown or other
  misc_feature (240)..(240): n is a, c, g, or t
  modified_base (312)..(312): a, c, t, g, unknown or other
  misc_feature (312)..(312): n is a, c, g, or t
  modified_base (342)..(342): a, c, t, g, unknown or other
  misc_feature (342)..(342): n is a, c, g, or t
tcagcgtctagtaccacgaccggtgctcgatttagcactcgcacgttgggctctgggagaggagcccagcactagaagtcggcggttgtttccattcggtgatcagcactgaacacagaggactcaccagtggagtttgggctgagtcgttgggtttttccctcggtttgccttacgtttttaagaggttgtccagtgtcaggtgcagcgtggtggagtcggtgggggagcggtggtccngtccggtgggacgtccctgactcctctccgtggtcacgtacgtgtgtattcagtcttacgtagttagttagngactagtcgacgtaccggtcggggtacccnccggacgggtccctacggacgggcgggaacgggggtcgtaggggacgggttggggtcggtcgttagggtttggttacgggtaggttagtaaggggtaaaccgggtaaagtaaggtaaaaggtaacggttagtaccgggcccgaccgggtacggtacggggaacgggtacctacgtttaccccaaccttacgtccgtacgaaagtacgtaaacctaaacgtaccccaaagtaacttagtttacgtttagtaacgttacgtaacgtaactaaagtagtaaacgtcgtaacgggtagtaaccggtaacggccgggtaacgtaaccggtcggttacgtttcggttaagtttagttaccggtgttacgggtaagaaggttacgggaggggttcggggggttaacgggtggttaggtacccggtggttaacggg

SEQ ID NO: 256617 - DNA, 640 bp, Homo sapiens
  misc_feature: GYAE6OF01BPXGV.14.55.E11.1.454.CMB.1.raw
  modified_base (172)..(172): a, c, t, g, unknown or other
  misc_feature (172)..(172): n is a, c, g, or t
  modified_base (285)..(285): a, c, t, g, unknown or other
  misc_feature (285)..(285): n is a, c, g, or t
  modified_base (307)..(307): a, c, t, g, unknown or other
  misc_feature (307)..(307): n is a, c, g, or t
  modified_base (368)..(368): a, c, t, g, unknown or other
  misc_feature (368)..(368): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccagccgtgggacgtccctgactctctctgtcgcaacgtctaggacttcagtcttacagtagttanggctatgctacgtcgggtcccncgaggtcctccgaggcgaaggggctgggacggtggggtcgcgtaggttggtggtggtaagnggaacggtaagtaagtaagtaagtagtcggaccgacgccgtaggaacgggcctattccgacctagtcctacgaagtaagtaactaacttacccaaactaacgtattacggttagtaactctaacggtaactaaagtgaaacttcggacccttaggaacgacggaccggaggaacccgacggtcttaggttaagttacgttaacgttggtacggtacggaacggtaggtacgggtagggggtagggggttgtaggtaccggttacggtaaggg

SEQ ID NO: 256618 - DNA, 828 bp, Homo sapiens
  misc_feature: GYAE6OF01CU1PN.14.55.E11.1.454.CMB.1.raw
  modified_base (321)..(321): a, c, t, g, unknown or other
  misc_feature (321)..(321): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccaggccgtgggacggtccctgacacttctccgtgtcgcaacgtctggtattcagtcttacgaagttagttatggactatgacctacggttcggggtcccncccgaggccctaccggagggacgaagggggtcgtaggggacggttggggtacgggtcgtagggtttggttaggttagggtagtacgggaacgggtaaaagtaaagttaaggtaaaacgttcgtaccggacccgggtacccggtaccgggtaacgggtaacgggtccccgtaacgtttacccgaacccgtacgttaccccgaccgtaaacggtacgtaaaccctaaaaccctttaccccgaaaacctaaacgttacggttttacgtttaggttaaccgtttaccgtaacgtaaacgtaaacgtttaaacgaaacgttaccggtaccgttaacggggaacgacccgggtaacccgggaacggtaacccggaccgggtttccggtttaaggttaccggttttaacgtttacggttagggttaacccggttaggacgggtaaaagggttcgggggttagggggggtaacgggggttaggggtaacggttaacgggttcccggttaaagggg

SEQ ID NO: 256619 - DNA, 836 bp, Homo sapiens
  misc_feature: GYAE6OF01DOZ38.14.55.E11.1.454.CMB.1.raw
  modified_base (743)..(743): a, c, t, g, unknown or other
  misc_feature (743)..(743): n is a, c, g, or t
tcagcgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagtcgtggtccaggccgtggggacgtccctgaccactctccgtgtcgacgtaacgttctggtacttcgagtcttacgaaggttacttagtcggactagtcgacacggttcggggtacccgccgtagggtccctaccggaggggtaccggtaaaggggggccttaggggtaagggttcgggggtacggtccgttaagggtttcggttagggttagggttaacgtcggggaaaacggggttaaaatttaaaaggtaaaccggtaaaaggtttcgaccgggtaccccgggtaaccgggtccgggttaaggggaaaccggggtcccgttaacgtttaccccgaaccccgttagttcccccgtaaccgaaacgggtaaccgtaaaacctaaaaccctttaccccgaaaacgtaacgttaggtttacgtttacggttaacttcccgtaagtaaacctaaaaggttacgtaaacgttaccggtccctaagggaaggtaacccggacccggggaagtaccggtacccggttnttaaggttcgtttaacgttagttcggtgtaaaccggagggttaacggtagggttcggggggaagggttcgtagtaacccggttcggtaaaggg

SEQ ID NO: 256620 - DNA, 534 bp, Homo sapiens
  misc_feature: GYAE6OF01DT2PB.14.55.E11.1.454.CMB.1.raw
  modified_base (313)..(313): a, c, t, g, unknown or other
  misc_feature (313)..(313): n is a, c, g, or t
  modified_base (346)..(346): a, c, t, g, unknown or other
  misc_feature (346)..(346): n is a, c, g, or t
  modified_base (378)..(378): a, c, t, g, unknown or other
  misc_feature (378)..(378): n is a, c, g, or t
  modified_base (386)..(386): a, c, t, g, unknown or other
  misc_feature (386)..(386): n is a, c, g, or t
  modified_base (432)..(432): a, c, t, g, unknown or other
  misc_feature (432)..(432): n is a, c, g, or t
  modified_base (446)..(446): a, c, t, g, unknown or other
  misc_feature (446)..(446): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggaggcgtggtccagccgtgggacggtccctgacactctcctgtgcaacgtctggattcagtcttcagtagttatggcatgctacgtggggtccncaggcctccgaggcgaaggggctgggagtgggngctaggttgtgtggtatggacggtaaagtaanagaaagtntgaccgacgcgtaggacggcgatcacatctcagagacattaccaanaacatgttgtactntgactaaatgaatcggctggacgagcgagacaggctgtagtattagtggtgtacgagtacgtaggtaggggaggggtggtgtgtacgg

SEQ ID NO: 256621 - DNA, 727 bp, Homo sapiens
  misc_feature: GYAE6OF01AW2QF.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccagtggagtttggctgagcgttgggttttcctcgttgcttcgttttaagaggtgtccgagtgtcgaggtgcagctggtggagtcgtggggagcgtggccagccgtggacgtccctgaccactctccgtgcgcgaacgtcgtgtacttcgagtcttcgagttagttagtcggcaatcggaccgtacggttccgggtcccgccgacggtccgtacccgaagggaccgaaggggcgtagggaggttgggtggtctaggttggtggtaggtagtacggaaggtaaagttaagtaaggaaagtacgtacgacccgacggtacccgagggaacggtcccgtaacgtccgaacctacgtaccgtacccgaagtaaccgtaaccgtaaacctaacccgtaaacctaacgttacgtttagttacgtaacttaccgtaagaaccgtaaagtagtaaactacggtaccgtaaggtaacgaccggacccgaaggaaccgtaccgggtacgttagttaacgtttaacgtttacgtagggttacgtaacggtaaggtaacgggttagggtagggggtaggggttacggttacggttaacggttacgggttaaggg

SEQ ID NO: 256622 - DNA, 555 bp, Homo sapiens
  misc_feature: GYAE6OF01CLQ8E.14.55.E11.1.454.CMB.1.raw
  modified_base (174)..(174): a, c, t, g, unknown or other
  misc_feature (174)..(174): n is a, c, g, or t
  modified_base (255)..(255): a, c, t, g, unknown or other
  misc_feature (255)..(255): n is a, c, g, or t
  modified_base (284)..(284): a, c, t, g, unknown or other
  misc_feature (284)..(284): n is a, c, g, or t
  modified_base (303)..(303): a, c, t, g, unknown or other
  misc_feature (303)..(303): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
  modified_base (357)..(357): a, c, t, g, unknown or other
  misc_feature (357)..(357): n is a, c, g, or t
  modified_base (388)..(389): a, c, t, g, unknown or other
  misc_feature (388)..(389): n is a, c, g, or t
  modified_base (396)..(396): a, c, t, g, unknown or other
  misc_feature (396)..(396): n is a, c, g, or t
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
tcagcgtctagtaccacgaccggtgctcgatttagcactcgcacgttgggctctggggagaggagcccagcactagaagtcggcggtgtttccattcggtgatcagcactgaacacagaggactcaccatggagtttgggctgagctgggttttcctcgttgcttcttttaagnggtgtccagtgtcaggtgcagctgggtggagtcgtggggggagcgtggtccagccgtgggagtccctgacactctcctgtncaagtctggattcagcttcaggtagttanggcagtgcacgtgggtccnccaggcctccgaggcaagggctgggagtggngcagttgngtgtatggagaatanagaagtatgccgagcgtagaacggcatcacnnctcaganacaatcaanacatgtntatctagactaaatcgtaaatacgaccttaggaacgacggaccggaaggtaaccgaccgggtacttacggtaggttaacgtttacgttaggttggtacgaacggaggtaggtggggtagggggtggtaggcgtacggtaaggg

SEQ ID NO: 256623 - DNA, 742 bp, Homo sapiens
  misc_feature: GYAE6OF01B8CHR.14.55.E11.1.454.CMB.1.raw
  modified_base (144)..(144): a, c, t, g, unknown or other
  misc_feature (144)..(144): n is a, c, g, or t
  modified_base (241)..(241): a, c, t, g, unknown or other
  misc_feature (241)..(241): n is a, c, g, or t
  modified_base (530)..(530): a, c, t, g, unknown or other
  misc_feature (530)..(530): n is a, c, g, or t
tcagcgtctagtaccacgaccggtgctcgatttagcactcgcacgttgggtttggggagtctcagtcaggacacagcatggacatgacgggtccccgctcagcctcctggggctcctgctactctggctcgaggtgccagatgngacagtccagatcgacccagtcctccactccctccctgtctgcagtcgtggtaagggacacaggacgtccaaccattcgacgttcgggacccggganaacgtcgaagacggactaaagttaaagttaacctttaagttttaaaaggttccggtaataaccgaaaacgtaaacggaaaaacccgggaaaggggtaaacccctccccgtacggttaacccctacgtacggtaacttactacgttcgcctagtcctaacgtttaccgaaggtttcgaccgtacgggtacgggttccgggtaccctaggttaacggtcgaggttacgggacttagggtaggtacgttcggtacggggaactattactttcgaccgtcctaacgcccgtanacgtcgacgtcgtaccgtacgaacgtagtaaagtacgtttacaacctaacttttcgaattcggaaactagtaacctacggtccaacccggtccctagtacggttccggacgggtaaccggacgaagggtacgacgtacgaccggtacggaactaccgggttggcgaccgtaccgtaaccgccttacggtactttcgaaccgttcggtacccc

SEQ ID NO: 256624 - DNA, 780 bp, Homo sapiens
  misc_feature: GYAE6OF01ANXZS.14.55.E11.1.454.CMB.1.raw
tcagcgtctagtaccacgaccggtgctcgatttagcactcgcacgttgggctctggggagaggagcccagcactagaagtcggcggtgtttccattcggtgatcagcactgaacacagaggactcaccatggagtttgggctgagcttgggttttcctcgttgcttacttttaaggaggtcgtccagtgtcaggtgcaggcgtgggtggaggtcggtggggggacgtcggtggtccaggccggtggggacgtccctagaccacttctccgtggtcgacctaacgtcgtaggtacttcgaagtcctttacgaacggtttagttagtcggactagtcgaccgtacggtcgggtccccgacgtacggtccgtaccggagggtaccgggaaggggtccgtaggggtagggttcgggggtacggtcgttaagggtttggtagggttaggttaacggtaagggaaacggtaaagtaaagtaaggtaaacgtgtaccggacccggacggtaccggtagggaaccgggtaccgtaacgttacccgaaccgtacctaccgtaccggaaagtaaccgaacttaaacgtaacccaaacaacgttttttaacgacgtttacgttacgttacgtacgtaaacgttaaagtacgtaacgtaaccggtacggtaaggaacgtaaccggtaacgggaacggaccggtacggtcggttgtaacgtttagtaacgttgggttacgtaggtaacggaggtagggtcgggggtagggtacggtagtacggtcggtaaggg

SEQ ID NO: 256625 - DNA, 774 bp, Homo sapiens
  misc_feature: GYAE6OF01E05FT.14.55.E11.1.454.CMB.1.raw
  modified_base (207)..(207): a, c, t, g, unknown or other
  misc_feature (207)..(207): n is a, c, g, or t
tcagcgtctagtaccacgaccggtgctcgatttagcactcgcacgttgggctctggggagaggagcccagcactagaagtcggcggtgtttccattcggtgatcagcactgaacacagaggactcaccagtgggtagtttgggctgagtcgttgggttttcctgtttgcttacgttttaaggaggttcgtccgtagttgtcgaggtncgagtcgttgggtggtagggtcggtaggggggacgtcggtcggtaccgaggcccggttggggtaccggtccccgtagaacctccgttccgtccgtaggtaccgtaccgtaaccgttcgtaggtactttccacgttcctttagaacggtttagtagtcggactagtccggtaccgtacggtccgggggtaccccacggtaccggtcctaacggacgggaccgggtaagggtcgtggggtaggtggggtcgacgttaggttgggtacgttagtcgtaacgggtaaacgtaagttaaaggtaaagtaacggtcgtacgggaccggtacggtcggaagggtaccgtacgttactaccgtaccgtaacgtacgtaaccgaaagtaaacctaaacgtaaccttaacccgaaacttaacgtagtttacgtacgttacgtaacgtacgaactaagtacgtaacgtccggtaccgtagaccggacgtaccggagacccggtagtacgttcggtaagttacgtacgtgttacgaggagtacggtagggagggtagggtacgtgtacggtggttaagg

SEQ ID NO: 256626 - DNA, 778 bp, Homo sapiens
  misc_feature: GYAE6OF01C79YK.14.55.E11.1.454.CMB.1.raw
tcagcgtctagtaccacgaccggtgctcgatttagcactcgcacgttgggtttgggggagtctcagtcaggacacagcatggacatggagggtccccgctcagctcctggggctcctgctactctggctccgaggtgccagatgtgacatccagatcgacccagtcctccatccctccctgtcctgactatcgtaggaggaagacgagtacgtacaaccatccacgttcggccgggacaagtcgaggacgactaagtttaaaacgaacttttaagttttaaaagttggtaactaacgaaaaccgaaacggaaacccgaaggggaaacctccccctacggtacccttccgtagaactttctaacgtcgtacctctaccgtactttaccgtaggtttaccgaccgtaacgggtacggggttccgggtacccgtaacggtaagggttccggtaaggtcggggtagttacgggtacgggttaactcggggtacggtaaacgttagtttaccctttcgtaacccgttacgaacccgtccgtaactacgaccgttagtaccgtacgtaaccgtaaccgttaggttaaacgtttactttacgaaacctttaacttaacgttaccgttagtaaaccgaacttaagttacccgttaacccgtaccccgttaccccttaggtaccgttacggggaccggaacggtacgacggtacgtacgtaccgaacgacggtaacggtgtacggtcgtaccgtgacccgtacatttcgtctccgttacttccccgg

SEQ ID NO: 256627 - DNA, 692 bp, Homo sapiens
  misc_feature: GYAE6OF01ESUGC.14.55.E11.1.454.CMB.1.raw
  modified_base (166)..(166): a, c, t, g, unknown or other
  misc_feature (166)..(166): n is a, c, g, or t
  modified_base (186)..(186): a, c, t, g, unknown or other
  misc_feature (186)..(186): n is a, c, g, or t
  modified_base (249)..(249): a, c, t, g, unknown or other
  misc_feature (249)..(249): n is a, c, g, or t
  modified_base (302)..(302): a, c, t, g, unknown or other
  misc_feature (302)..(302): n is a, c, g, or t
  modified_base (333)..(333): a, c, t, g, unknown or other
  misc_feature (333)..(333): n is a, c, g, or t
  modified_base (433)..(433): a, c, t, g, unknown or other
  misc_feature (433)..(433): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggaggtttgggctgagcgttggtttccncgtagcttctttaagaggtntcagtgtcaggtgcagcgtggtggagtcgtgggggagtcgtggccaggccgtgggacgtcccngactctctcctgtcgacgaacgtgtacggtattcagtcttagagtttagtagnggtactatcgacgtacgtcggggtcccacgnggtcctaccgaggcgaagggtcgtagggtacggtgggtcggagttaggttggtacgggttagtaacggtcggaaacggtaaagttaagaggttaaaacgnggtccgaacccgggtagtcccgggtaaggaccggtaccgtagtaccacgtctacccgtacaacggtataaacccgtactaacccgaaacgtactagttacgtttacgtactcgtaacctaagaaaggttaactaacggtacgttacgtaacggtaggaccggtaccgggtaagacccgtcggttaagtcgttttaacgactttaacggttgtaccgtaggaggtaacgtaggggtgggttaaccgggtgtcggtaaacg

SEQ ID NO: 256628 - DNA, 868 bp, Homo sapiens
  misc_feature: GYAE6OF01AIILR.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgcttcttttaagaggttgtccagtgtcgaggtgcagcgtggtggaggtcgtgggggagcgtggtccagccgtgggacgtccctgacactctccgtgtcgactaacgtctggattcacgtcttacaggttagtttagtggcctagtcgtccgtaacggttcggggtccccgccgtaacgggtcccgtaccggaaggggtacccggaaagggggtccgttagggggagggttcggggggttacggaccggttaagggtttgggttagggttacgggtaaggttacggggaaaacgggttaaaaggtttaaaacgtaaagggtaaaaaggttacggtaccgggaaccccgggtaaccgggtacccgggtaagggaaccggggtccccgtaacgtttacccgtaaccgtacttaccccgtaccgaaacgggtaacctaaaccgtaaaccctttaacccgaaaacccgtaacgttaagtttaccggtttagttaaccgttacgtaacggtaaacctaaagttaacggtaaacgttaccgtaccggtaaggtaacccggaacgggtacccgggaaacgggtaccggtaccgggtaccttagggttaacgtttaaccgtttacgtagggttacggtacggaaagggtaaggttcgggggttaacgggggttacggggggttaggtaacgggtaaccgggttacggttaaagggg

SEQ ID NO: 256629 - DNA, 865 bp, Homo sapiens
  misc_feature: GYAE6OF01AGGL6.14.55.E11.1.454.CMB.1.raw
  modified_base (171)..(171): a, c, t, g, unknown or other
  misc_feature (171)..(171): n is a, c, g, or t
  modified_base (218)..(218): a, c, t, g, unknown or other
  misc_feature (218)..(218): n is a, c, g, or t
tcagcgtctagtaccacgaccggtgctcgatttagcactcgcacgttgggtttgggggctctgggagaggacgcccagcactagaagtcggcggtgtttccattcggtgaccctcagcactgaacacagaggtactcacagtggagttgggctgagtcgttgggttttccngttagtcttacgttttaaggcggtcgttccaagttgtcgtagggtcncgagtcgttagggtaggtaggttccgggtagggggaggtccggttaccgggttacccacgggtccgggttacggggaccgtttccccctacggtaaccctccgttccgttacccggttggtacccggttaaccgtaaccggttggttacgttaactttacccgggtaagttccctttaacggttaggtttaacggtttcaccggggttataacgttcggaccccgttacggggttaccccgggtcccggaacccgttaagggtccccgggttaacgacgggggttacggaagggggttcccggtaggggtaacgggtttggggacccttaggttgggtttcggtttagacgggtacgtaaaggtacggtaaagtaagaaggttaactcgggtacgccggtaacgtccgggtaaggacccggtactacgtacgtaccgtacgttacgaccgtaacgtactaacttaacgtaccctaaacgtacgtacgttacggttattacgtacgtacctaaagtctaacgtagtaacgtacggtacgacggtaaccgtacggggtaactcggtaagtaccgttagttaacggttcgtaagtcggtacgtacgtaggtaacggtagggtacgggttaggtcgggtacgtaggtacgg

SEQ ID NO: 256630 - DNA, 767 bp, Homo sapiens
  misc_feature: GYAE6OF01A6XKX.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctccggaggtgccagatgtgacatccagatgacccagtctccatcctccctgtctgcatctgtaggagacagagtcacctatcacgttcggccgggacaagtccgaaggacgactaagttaaaagaactttaattttaaaagttggtaataccgaaaacaacggtaaaacccgaaggggaaaccgtccccttaggaccccttcgttagtacttacgtagtacgtcctagacctaacgttccgtagtttcgactacgtaggggttccggggttccctaacgtaagggttcgaggttcgggacgtaggttggtaacgtacggtagggtaactaggttaccttttacgacccttccgtaccgaccggtaccgtacgtacgtaacgttcgtacgtacccgtaaccgttaaggtaactttaacggtttacgaaccctttaaccgtttaaccgttaccgttagtaaccgtaaccgttaacgttaacgttaaccccgttaaccccgttaccccccgttacgttacccgggtttaccggggaacgggtaaccgggtaaccgaacgggtaccggaagtaccgacgaaacggtaccgtaaagtcggtacgtacgaccgtacccgtactacgttacttcgtccttcgtacccg

SEQ ID NO: 256631 - DNA, 758 bp, Homo sapiens
  misc_feature: GYAE6OF01B41X1.14.55.E11.1.454.CMB.1.raw
  modified_base (366)..(366): a, c, t, g, unknown or other
  misc_feature (366)..(366): n is a, c, g, or t
  modified_base (412)..(412): a, c, t, g, unknown or other
  misc_feature (412)..(412): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccagtggtagtttgggctggagtcgttgggttttcctcgttgtcttacgtttaagaggtgtccaggtgtcagggtgcgagtcgttggtcggtaggtcggtggggggagtcggtcggtaccgacggtccgttggggtacggtccctgaacctccgtctccgtgtcgacctaacgttcgtaggtacttcgagtcttacgtagttacgttagtcggactagtcgccgtacggtccgggtacccncgacggtacctccggacgggtaacggtaacgggggtcttagggggngggttacggggcggtacgttagggtttcggtaggttaggtacgtagggtaaacggtaaagttaaggtaaagtaaacgtacgtccggacccggtaacggtcggtaacggtaccgggtacctacgttaacccgacctacgtccgtaaccgaagtaaacgtaaccttaaccttaaccaaacgttaaacgtagtttactttacggtacttacgtaataaccgtaagtacgtaataccgacgtacggagtaccgaccggtaacgccgtacgttgttacgttacgttagttacgtcggttagtacggagtacgggtaggtcggggtaggtcgtaaggtccgttaaggtacgg

SEQ ID NO: 256632 - DNA, 928 bp, Homo sapiens
  misc_feature: GYAE6OF01ASNZ8.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttggctgagcttgggttttcctgttgcttacttttaagaggtcgtccagtgtcaggtgcagcgtggtggagtcggtgggggagtcgtcggtccaggtccggttgggaggttccctaggacctaccgttctccctggtcgactaaccggttctagggtactttcgacgttcttacgaggtttacgttagtcggctagtcggtaccgtacggtttcggggcccccgaccggtacggtccctaccggacggggtaccgaacggggggtccgtaggggtagggttcggggttacgggcgtttagggtttcggttaggtcgggttaagtacgggaaacgggttaaagtttaaaggttaaaacgggtaaaggtttaccgtaccgggtaacccgggtaacggtacccggggtaacgggtaaacccgggtaccggttaaccgtttcccaacccggttacgttaccccggtaacccgtaaaggtaaaccgtaaacccgtttaaaccgttaaaccccgtaaacgtaaaccggttaacggtttcgttttaaacgttaaccgttaacccgttaacgtaaaccgtaaaaggttaccgttaaacgggttaccgtaaccggtaagggttaaccggtaacccgggaacccgggttaacggaacccggttaaccgggttacgtttaccgggtttaaggttaaccgtttcgggttaaggttacgggtacgggtaacgggtaaacggggttagggttaacgggggggttacggggtttaacggtaacgggttacccggttaagggttaaacgg

SEQ ID NO: 256633 - DNA, 890 bp, Homo sapiens
  misc_feature: GYAE6OF01C8EGQ.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcacatggagttgggctgagcttgggttttccctcgttgtcttcgttttaaaggaggttgtccgagtgtcgaggtgacaggcgtgggtaggacggttcggtggggggacgtcggtggtcccgaggtccgtggggacgttcccctagaccaccttctccgtgtgacctaacgttcgtcggtacttccgagtccttagtaacgttagtttacgtggactagtacggtccgtaaccggttccggggtaccccgtaccggacgggtccccgtaacccggaccggggttacggaacggggggtccgttagggggtacgggttggggggttacggacggttagggttttcggttaggttagggttaacgtaagggaaacgggtaaaagtttaaaagttaaaaggtaaaggttacgtccggggtaaacccggtaaccggtccgggttaacggggaacccggggtacccgttaacgtttaacccgaacccgttaaccgttccgtaaacccggtaacggtaaaccgtaaaacccgttaaaaccgttaaacccccaaacgttaaaccgttaaagttttacgttttaacgttaacgttacggtaacgtaaaccgttaaagttaaggtaaacgtacgtaaccgttaggaaccggacgggtaccggaacgggtacccgtaacggtccttggttaacgttacgtttaacggttagttaccggtaagtacggtagggtagggttcggggtagggggttggtacgttcgggtaacggttaaggg

SEQ ID NO: 256634 - DNA, 816 bp, Homo sapiens
  misc_feature: GYAE6OF01AELG0.14.55.E11.1.454.CMB.1.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (360)..(360): a, c, t, g, unknown or other
  misc_feature (360)..(360): n is a, c, g, or t
tcagcgtctagtaccacgaccggtgctcgatttagcactcgcacgttgggctctgggagaggagcccagcactagaagtcggcggtgtttccattcggtgactcagcactggaaccacgagaggacctcacctagtggtagtttcgggcctagtagtccgttgggttttacctggttgccgttttacttttaaggnggtcgtccgtagttgtccgtagggtnaccgtaggcgtttagggcgggtacggttccggtagggggggactccgggttacggtaccccggaggttccccggttagggggtaaccggttcctcggaacctcccgtttcgtccgtgggttacacgtaacccgggttntcgggtatccgagtcctttagaacgttgttagccgtatcgtacgtccgtagtccgggaccgccgtacggttcgaccgggtaggcggtacgggtcggtacgggtacggtcgggaagtccttagggtgcggttacgtggaacgtaaacgggtcaaagggtttacctaaggccgggttacgccgttaacggcccgggtaaagtaccggcgtacgttccgtaacgtaacctcggtaacgtacgacgtaaccgtaccgtaaccgacgttaacgggtacctttaggttcccttaaggtaccgtacgtaaccgtaattaccgaacgttaacgccgtttaaggcgtaccggtacggtaccgacggttacgaggttaccgtacggttaaccgtcggttaggttacgtagggaacgttgggttaacgggtggggtacggttacgacgttaaacggtgggtaaaccg

SEQ ID NO: 256635 - DNA, 762 bp, Homo sapiens
  misc_feature: GYAE6OF01A3SHG.14.55.E11.1.454.CMB.1.raw
  modified_base (179)..(179): a, c, t, g, unknown or other
  misc_feature (179)..(179): n is a, c, g, or t
  modified_base (623)..(623): a, c, t, g, unknown or other
  misc_feature (623)..(623): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttggctgagcgttgggttttcctcgttgtaccttcgttttaaagnggttcgtccagttcgttcgagggttgcgaggcgttagggttggaggttcggtggggggacgcggtcgggtaccaggtcccggtgggtacggttccctaggaccctcgtcccttgtcgggtacgaccgtaacggttcgtacggtatttacccgagggtcctttagaacggttaggtttaccgtgggctacggttggcccgtacggttccgggacccctacggaccggcccggtaaccggacgggtaaggaaccgggggttgtcgggagggttggggtacggtctaagggtttggtacggttaggttacgaggggaaccgttaaagggttaaaataggtaaaagttgaacggccggtaacggcgggttagaaccgggtcgtcacgtaaccacgttactccggaagacgtaaccgttaaactacctaacgaagtctagttacgttancgttaagaccgtaattaaggaattacggacgttcgggacgtacggacgtacggaaccgtacggtagtgttaaccgttataccggtgtagtcgtaaggacggttaagggtggggttagggtaggttacgacggtgtaggg

SEQ ID NO: 256636 - DNA, 1134 bp, Homo sapiens
  misc_feature: GYAE6OF01DJVIU.14.55.E11.1.454.CMB.1.raw
tcagcgtctagtaccacgaccggtgctcgatttagcactcgcacgttgggctctggggagaggagcccagcactagaagtcggcggtgtttccattcggtgatcagcactgaacacagagactcaccagtggtagtttggctgagtcgttgggttttcctcgttgtaccttacgttttaaggacggttcgtacccgtaggttcgtaccgtaagggttcgaccgtaggtccgttaggggtgggtacgggtccgggtaggggggtacggtcggttcggtaccccgagggtccccggttagggggaccgttaccccgtacggaaccttaccgttcccgttaccgtcggtcgtacccgtaacggttcgttagtactccgtaggttccttaggtaaggttacgttacgcggtactaggttaccggacccgttaccgggtttcccggggtacccgaccggttaaccggcccggtttaaccggaacgggggtacccgggttaaagggggtccctttaggggggtaccgggtttggggtaaccggttggtttacgggtttagggtttacgggtaaaccggtttaacggtaaaagggggtaaacggttaaaaggttttaaaaaacctacggggggttaaaaaaccgtttcggggtaacccccgggtaaccccggggttacccggggtaaccccgggttaaaacggggaaccccggggtttcccggttaaacccggtttaacccccgtaacccgggttaaccgtttacccggtaaaccccggtaaacggttaaacccggtaaacctttaaaaacccccggttaaccccgttaaaaaccgaaaccggtttttaccggtaaccggttttaaccgttaaccgtttaacccggtaacgttaaaccggtttaaaacgtaaaccggttaaccggtttaacccggtaaacgggtaacggtaaccgggtaacccggggttaaccgggtaaaccggtaacccgggtttaacggtttaccgggttaacgggtttaaaccgtttaaacgggtttcggtaaacggttcgggtttaccgaaaggggttagggttaaacccggggttgggggtaaacgggggtttgtaaccgggtttacgtaacggggttttaaacgg

SEQ ID NO: 256637 - DNA, 721 bp, Homo sapiens
  misc_feature: GYAE6OF01AU0BI.14.55.E11.1.454.CMB.1.raw
  modified_base (199)..(199): a, c, t, g, unknown or other
  misc_feature (199)..(199): n is a, c, g, or t
  modified_base (329)..(329): a, c, t, g, unknown or other
  misc_feature (329)..(329): n is a, c, g, or t
  modified_base (352)..(352): a, c, t, g, unknown or other
  misc_feature (352)..(352): n is a, c, g, or t
  modified_base (453)..(453): a, c, t, g, unknown or other
  misc_feature (453)..(453): n is a, c, g, or t
tcagcgtctagtaccacgaccggtgctcgatttagcactcgcacgttgggctctgggagaggagcccagcactagaagtcggcggtgttccattcggtgatcagcactgaacacagtaggactcaccaatggaggtttgggctggacgcgttcgggttttctccgttgcttcttttaagacggtgtccagtgtcaggtnacgagcttgggtggtagcggtgggggagtcgtggtacccaggtccgtgggggtacggtcccctggaaccctcgttaccgttcccgtggttcggaccgtaaaccggtcgttacggaattcgtataccgttntaagttacgttatcggtctaagngtacgacgtacggtccgtccggacgtccgtaccgaggtccgaaacgggtcgtaacggtacggggtgggtcggtaaccgtggttggttacggtaggttacgnggtaacggaaagtttaaaggtaacgtaaagtggacgtaccggacggacgttaggaaacgggtccgtagtccgtaacgctacgtacgtacacgtacgtaactaacaacgactagtacgtatacttcgagtaacaacgtaataccgtaagacgtacgggaagaacgaccggaacggacgtaacgtagtaccggttagttaaacttcggtagtttccgaaggtaccgtagtacgggtagggtggggtaacggtagttacggtacgtaaggg

SEQ ID NO: 256638 - DNA, 821 bp, Homo sapiens
  misc_feature: GYAE6OF01ATP60.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagtcttgggttttcctcgttgcttcgttttaagaggttgtccagtgtcgaggtgcagcgtggtggagtcggtgggggacgtcggtcggtccgaggtccgtggggacgtccctagacctaccgttcctccgtggtcgaccgtaacgtcgtaggtacttcgacgtccttacgtaagttagttacgtggacacgttcgccgtacggttcgggtcccgccgacgggtcctaccggagggaccggaaggggtcgtaggggacgggttggggtcggtacgttagggtttcggttaggttagggttaacggtacgggaaacggttaaaggttaaacgttaaacgggtaaaaggttacggaccggtacccgggtaaccgggtaccgggtaagggaaaccggggttacccgtaacgttaccccgaccgtaaccgttacccgttaccggaaacggtaaaccgtaaaccgtaacttaaaccccgaaacgtaaaccttaggtttacggttattaccgtacgtaacgtaacgtaacgtaacgtaacgtaccgtacggtaacggaacggaccggaaccggtaggaccgtacggtcgttacggttaaggttacgttacggttagtacggtacggaagggtagggttagggtagggggttacggggttagtacgggttaacgtacgggttaaggg

SEQ ID NO: 256639 - DNA, 736 bp, Homo sapiens
  misc_feature: GYAE6OF01D7W7E.14.55.E11.1.454.CMB.1.raw
  modified_base (188)..(188): a, c, t, g, unknown or other
  misc_feature (188)..(188): n is a, c, g, or t
  modified_base (210)..(210): a, c, t, g, unknown or other
  misc_feature (210)..(210): n is a, c, g, or t
  modified_base (378)..(378): a, c, t, g, unknown or other
  misc_feature (378)..(378): n is a, c, g, or t
  modified_base (608)..(608): a, c, t, g, unknown or other
  misc_feature (608)..(608): n is a, c, g, or t
tcagcgtctagtaccacgaccggtgctcgatttagcactcgcacgttgggtttgggggctctgggagaggagcccagcactagaagtcggcggtgtttccattcggtgatcagcactgaaacacagaggactcaccagtggtagtttgggctgagtcgttgggttttcctcgttgcttcttttaaggnggtgtccaggttgtcgaggtcncaggtcgtgggtggaggtcggtggggggagtcggtcggtccgaggtccggtggggaccggtcccctaggacctacttccgttccgtagtcgacctaacgttcgtaggtacttcgagtccttagtaaggtttagttgtggctaggtcgacgtaccggtccggggtcccnccggtacggccctaccggtaggggacgtaggggtcgtggggtagggtgggtacggtcggtaggtttggtcggttagggtacgtaggtaaagggtaaagtaaagtaacggtaaagtgtaccggaccggtaccggtaccgggtaagggtaccgggtaccttacgtaccctaaccggtactacgtaccgaagacgtaaacctaacgaaccaaacgtagtagttgtatcgtaanacgtaagtaatacggactacgtaccggtaagaccggaacggtaccggacgaacggtccgtgtagttacgtacttcgtagtcgaagtagggacgtaggggttacggggagggttagtcgtagttaacgg

SEQ ID NO: 256640 - DNA, 939 bp, Homo sapiens
  misc_feature: GYAE6OF01EULDX.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgctcgtttttaagaggtgtccagtgtcaggtgcagctgggtggagtcgtgggggagcgtggtccagccgtgggacgtcctgacactctcctgtacgcctaacgtctggacttcaggtacctttcgagttacgttagtcgggacctaagtcggaccgtacggtttccggggaccccgtccgaacggggtcccttacccggagggaccgaaagggggtacgtcgggttagggacgggttcgggggtacggaccgttaagggtttggttagggttaggggttaacgttagggaaaccgggtaaagtttaaaacggtaacgtaaaaggtttaccggtacggaccccggtaacccgggttacccggggttaagggtaaacccgggggtacccgttaaaccgtttacccgaaccgttaaccgtttaccccgtaaccccgtaaagggtaaacccgtaaacgttaaacccgttaacccctaaaaccgtaaaccgtttaactttacgggttttaacggttaacgtttaccgttaagaaaccgtttaaaacggtaacggttaaaaccggtaacccgggttaacccttacggggtaaacgggtaacccggaaccggggtaaccgggtaaacccggaacccggggtttaacttaaccgggtttaacggtttttaaacccggttagggtttaccggtttaacggtacggtaaacgggtaacgggggttaaagggtttacggggggtaacgggggggttttaagggtaacgggttaacgggttaaccggggg

SEQ ID NO: 256641 - DNA, 1008 bp, Homo sapiens
  misc_feature: GYAE6OF01D98SJ.14.55.E11.1.454.CMB.1.raw
tcagcgtctagtaccacgaccggtgctcgatttagcactcgcacgttgggtttggggctgggagaggagcccagcactagaagtcggcggtgtttccattcggtgatcagcactgaacacagaggactcacagtggagtttgggctgagtcgttgggttttcctcgttgtcttacgtttttaaaggaggttgtccgtaggtcgtcgtaggtgctaggtcgtgggttgggaaggttcgggtagggggggacggtcggttcgggttacccaggcccggtttaggggggaaccggtttccccgtaggaacccttccttccgttccgttaggttacggaccgtaacggttccgttaggtacttaccggtaagtccgtttaacgtaaggtttaggtttaacgtgggacctaagtcggtaccggtaaccgggtttccgggggtcccgacccggtacgggtacccgttacccggaacggggaccggggtaacggggtcggtagggggttaggttcgggggtcgtagttagggttgggtaggttaggttacgtacgggtaaagggtaaaatttaagtaaaagggaaacgtttcgacccggccgggtaaacgtaccgggtaacgggaacgggtccccgttaacggttacctaacccgtacgttaccgtaaacccggtaaggtaaacccgtaaacccttaaacgttaacccccaaacgtaaaccggtttacgtttacgggtttagttaaccgtttacggttaaccgtaaacgtaaacgttaacggttaaaccgttaaccgggtaccggttaacgggaaaccggggttaccgggtaaaccccggggaaccgggtaaccgggtaaacccggtttacgggtttacggtttaaacgtttaaccggttttaaaccggtttccgggtacggttaaccgggaaaggttaccggggtaaccgggggtttaagggggggacgggggttttaacgggaacggtttaccgggttaacgggttaaacggg

SEQ ID NO: 256642 - DNA, 875 bp, Homo sapiens
  misc_feature: GYAE6OF01EIZ6O.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaggcgtgggtgggagtcggtggggggaggcgtggtccagccgtgggacgtccctgaccactctccgtgtgacctacgtcgtggattcagtctttcgaagttagttagtgggactagtcggacctacggttcggggtccccgccgacggggtccctcccggagggaccggaaacgggggtcgtacggggaagggttggggggtacggcgttagggtttggttagggtacgggttagtacggggtaaacgggtaaaaggttaaagtaaagggtaaaacggttagtaccggggacccggtaaaccggggccgggttaacgggaaacgggggtccccgttaacgttacccgtaacccgtacgttacccgtaacccgaaggtaaaccgtaaacctaaaccgtttaaccccgtaaaacccgtaaaccgttaacgtttacggtttaacgttaaccgtttacgttacggtaaacgttaaaagttaacggtaaacgttaaccggtaccgtaacggggaaacggtaccgggtaacccgggaacggggtaaccggtaaccggggtcgttaacgggttacggtttaaagtttacccggtttagggttacggtaccggtaagggtaacgggtaaggggttacgggggggttagggggttacggggtaacgggttacggtacccggttaaaggggg

SEQ ID NO: 256643 - DNA, 764 bp, Homo sapiens
  misc_feature: GYAE6OF01CQKF8.14.55.E11.1.454.CMB.1.raw
  modified_base (181)..(181): a, c, t, g, unknown or other
  misc_feature (181)..(181): n is a, c, g, or t
  modified_base (410)..(410): a, c, t, g, unknown or other
  misc_feature (410)..(410): n is a, c, g, or t
tcagcgtctagtaccacgaccggtgctcgatttagcactcgcacgttgggctctgggagaggagcccagcactagaagtcggcggtgtttccattcggtgatcagcactgaacacgagagactcaccagtggagtttgggctgagtcgttgggttttcctcgttgcttacgttttaaaggnggtcgtccagtgtcgaggtcgcgaggtcgtgggtggacggtcggtaggggggacggtcggttcggtcccgaggtcccggtggggtaccggttcccctaggaacctccttccgtccgtaggtcgtaccgtaacgtttctagggtactttccgagtcgttacgtaagttaaggttacgtcggtactagtcgccgtaacggttccggggtcccgacgtacgggccctaccgngggaacggaggggtgtgggtacgggtggggtcggacgttaggttgttaggtagggttagtagggaacggtaaagtaaagtaaagaagttaggcggaccggtcggtacggtaacggaacggtcccgtaattacccgaacgtactccgtacgaacgacgtaaacctaaccgttaccaaacgtaacgtattacgttagtacttaccgtagtaactaagtaacgtaatacggacccggttagaaggaccgacgggacgaccgtcggtaccgttagttacgtacgtttacgtggttacgacggtaaggtaggttaacgggtggggtaacggggttggtaacgttccggtaggttaaggg

SEQ ID NO: 256644 - DNA, 608 bp, Homo sapiens
  misc_feature: GYAE6OF01D1F6O.14.55.E11.1.454.CMB.1.raw
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacggtcccctgaccacttctcctgtcgctaacgtctggattcagtcttcagtagttatggcatgccacgtgggtccgccgaggcctccgagggcgaaggggctgggagtggggtgctaggttgtgtggtanggaaggaataatagaaagtngccgagccgtaggacggcgtattccactatctacgagagaacaactaccaaatactacttagttacgtatactacgaactaaagtagaaacgtacgtacgtagaacggacggaccggaaggaccgtacgggtaccgttaggtacgttaactttacggttacgttggtacgaggtaacggtcgggtaggggtagggggttcggtgtacggttaaccggg

SEQ ID NO: 256645 - DNA, 797 bp, Homo sapiens
  misc_feature: GYAE6OF01DAZ9Z.14.55.E11.1.454.CMB.1.raw
  modified_base (207)..(207): a, c, t, g, unknown or other
  misc_feature (207)..(207): n is a, c, g, or t
tcagcgtctagtaccacgaccggtgctcgatttagcactcgcacgttgggtttggggagtctcagtcaggacacagcatggacatgacgggtccccgctcagctcctggggctcctgctactctggctccgaggtgccagatgtgacataccagtactcgaccctagtctacctactccctccctagtctgcctatcgtagtagganacagactcactatcacgttgccggacagtcagacgactaagttaacgtaattaatttaagttaggtaactaccaaacgaaccgtaaaaccggaacggaaaccgtcccctacgtacccttacctagtactactagtaccgtctacgtacctacgttacgtagttacgacgacgtacgggtccggggttacccgtacggtaacggttcgtacggtcggtacgtacggtagtacgttcggtagggtactaacggttactttaccgacctttccgtacccgtacccgtaccggtacgtacctaacgttcgtaacgtacccgttaacgttaacggttaaactttacgttacgtaaccgttaaccgttaaccgttaacttaaccggtaaacgtaacgtaacggtttaacccttaacccgtttaccccgttaaccccccggttaaccgtttaccggttaccgggaaccggggtaaccggtaacgggtaccggacggttaaccgtacgtaccggtaacgtaaccggaacggttcggtccggtaaccgtccgtaacccgtaccgttacgttaccgtttcgttcccgttccgttaccccg

SEQ ID NO: 256646 - DNA, 834 bp, Homo sapiens
  misc_feature: GYAE6OF01AUK19.14.55.E11.1.454.CMB.1.raw
  modified_base (219)..(219): a, c, t, g, unknown or other
  misc_feature (219)..(219): n is a, c, g, or t
  modified_base (257)..(257): a, c, t, g, unknown or other
  misc_feature (257)..(257): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggcttgagcttgggtttttcctcgttgcttcttttaagaggttgtccagtgtcaggtgcagctggtggagtcgngggggagcgtggtccaggccgtgggacgtccctgaccnctctcctgtcgctaacgtctggattccagtctttcgaagttagttacgtggactagttcgccgtacggttcggggcccaccgagggcccttaccggagggtaccgtaaagggggtctacggggtagggtttacggggtggaccgtttaaggggtttggtacggggttaggttaacgtacgggtaaaccggggtaaattaaaccgttaaagggaaacgtttacgtccgggaaccccggtacgggtaccggtaagggtaaccgggtccgtaacgttaccgaaccttagtccccgttaacgaaacggtaacgtaaacgttaaccgttaacccgaaacgtaaacgtttacgttacgggtttaactaccgtttacggtaacgtaaacgttaaaggtaacggttaaaccgtaacggttacccgtaaggttaccgggaaccggttacccggaacgggtaacccggtacgggtacctttaacggggttagtttaaacccgtttgggtacggttaacgtacgggaaacggttacggtaggggttaccggggggtaagggggtttactagggttccgttaaacgggg

SEQ ID NO: 256647 - DNA, 1197 bp, Homo sapiens
  misc_feature: GYAE6OF01CQOMF.14.55.E11.1.454.CMB.1.raw
  modified_base (329)..(329): a, c, t, g, unknown or other
  misc_feature (329)..(329): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcacatggagtttggctgagtcgttgggttttcctcgttgcttacgttttaagaggttgtcctaggtgtcgaggtgcagtcgtggtggagtcggtgggggagtcggtcggtccaggtccgtggggacgttccctagaccgtaccttctccgtggtcgaccgtaacgttcgtacggtattccgagtcctttagaacggtttagtttancgggtacctagtcggtacctacgggttccgggtacccgaccgaagggtccctaccgggtaacggggtaccgggtaaacggggggtccgtttaagggggacgggtttccggggttgggtaaccggtttaagggttttcgggttacgggtttaacgggttaaacggttaacggggtaaaaacggggttaaaacggtttaaaacggtttaaacgggtaaaacgggttttacgggccccgggtaaaccccgggtaacccggggttcccgggttaaaaggggtaaccccggggtttaccgttaaacccgtttacccggaaccccgtttaacccggttaccccggttaaacccggtaaacggggtttaaaccttaaaacccgttaaaaccccgtttaaacccccgggtaaaactaaaacccgggtttttagggttttaccccgggtttaaaggtttaaacccgttttaaccggtaaccggggtttaaaaaaccgttttaaaaccggttaaccgggtttaaaaacggggtttacccccggtaacccgggtttttaaaacggggggaaaccccgggtttaaacccgggtaacccgggggtaaaccgttaaaaccccccggggggtttaccgggggttttaactttttaaaccggggggttttaaacccggttttttaaaaccgggtttttaccccggggttttacggggttaaaaccggggtttaacccgggggtaaaaacggggtttaccgggggggttttaaaaccgggggggttttaaacgggggggggggtaaacgggggggttttttttaacccccaacggggggttttttaaaaacccccgccgggggggtttttttaaaaaaccggggg

SEQ ID NO: 256648 - DNA, 772 bp, Homo sapiens
  misc_feature: GYAE6OF01D44Q7.14.55.E11.1.454.CMB.1.raw
  modified_base (313)..(313): a, c, t, g, unknown or other
  misc_feature (313)..(313): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccagtggagtttgggctgagcttgggttttcctcgttgcttacttttaagaggtgtccagtgtcaggtgcagcgtggtggagtcgtgggggaggcgtggtccagccgtgggacgtcctgacactctcctgtcacaacgtctggtattcagtccttcagttagttatggcatgctacgtcggggtcccnccgaggtcctccgaggcggtaaggggtctagggacggtggggtggacgtaggttggtgtagggtagtacgggaacgggtaaagttaaagaaaggtaaagttagtcgggaccccgtaacggtcccgggtaagggaaccggggtcctaccgttaccaaccccgtaagttcccgtaaccgtaaggaaccgtaacctaaacttaacccccgaaaactaaaccgttaagttacgtttacgtaacgttacgtaacggtaacctaaagtaacggtaaacgttacgacccgttaaggaacggtaaccggaccgggtaaccggaaccggtaaccgggtccgttaagggtttaacgtttaacggtttaaccgttagggttaaggttacggaaccgggttaaggggtaaaggggttcggggggtaagggggggttagggtttaacggggtagttacccggttaaaggggg

SEQ ID NO: 256649 - DNA, 793 bp, Homo sapiens
  misc_feature: GYAE6OF01ADB2E.14.55.E11.1.454.CMB.1.raw
  modified_base (87)..(87): a, c, t, g, unknown or other
  misc_feature (87)..(87): n is a, c, g, or t
  modified_base (177)..(177): a, c, t, g, unknown or other
  misc_feature (177)..(177): n is a, c, g, or t
  modified_base (199)..(199): a, c, t, g, unknown or other
  misc_feature (199)..(199): n is a, c, g, or t
tcagcgtctagtaccacgaccggtgctcgatttagcactcgcacgttgggctctgggagaggagcccagcactagaagtcggcggtntttccattcggtgatcagcactgaacacagaggacctcaccatgggagtttgggctgagtcttgggttttcctgttgcttcgttttaagnggttgtccagttgtcgaggtgnagtcgtgggtggaggtcggtggggggagcggttcggcccaggtccgtgggtacggtccctggaccctaccgttcctccgttggtacgaccgtaacggttcgtacggtactttccgacggttctttacgaaggtttagttacgtcggatacggtcgaccgtcggttacgggccccgaccgtaaggttccccgtacggaacggggtaccgggtaacgggggtcgtacgggggtaggggttcggggtacggtgttagggtttggtaacgggttaggtaagtacgggaaacggttaaataaaggttaacggtaaacggtcggttacggaccccggtaacccgggtggaacgggtaccggggtacccgtacttcccgaaccgtccgtaccgtaccgaagtaactaaccgtaaactaacccgaaactaagttagtcgtttagtaccttcgaacgtaacgaaacgttagaaacgttcgtacgtacggaacggacggtacggagaccggtccggtcgttagtaacgttgttaccggtgtttacggacgtaggtacgggtaagggttggggaacggggttggaccgttaggtacggttacggg

SEQ ID NO: 256650 - DNA, 844 bp, Homo sapiens
  misc_feature: GYAE6OF01BRGPG.14.55.E11.1.454.CMB.1.raw
tcagcgtctagtaccacgaccggtgctcgatttagcactcgcacgtttgggtttggggagctctgggagaggagcccagcactagaaagtcggcggtgtttccattcggtgatcagcactgaacacagaggactcaccatggagtttgggctgagcgttcgggttttcctcgttcgccttacgttttaaggaggtcgtaccgaggttgtcgagggtgcgaggtcgttgggtcggaggtcggtaggggggaggtcggtcggtccaggccgtggggacgtcccctagaccacgtccgtccgtgtcgacgtaacgtcgtaggtacttacgaagtcgttacgaggttagttagtggctaggtcgaccgtaccggttacgggtcccgaccgtaggtccgtcgggaacgggaccggaacggggtcgtaggggtagggttcggggtaggtacgtaggttggtggttagggtacgtagggaaacggtaaaggttaaacgtaaggtaaaggttacgaccggtacccggaaccggttaccgggtaaaggggtaaccgggtaaccgtaacccgttaaccgtaacccgtaacgtacccgtaaccgtaacggaaaccgtaaccgttaaacccgtaacccgtaaaacgtaaccgttacgtttaccggttaacgttaacgttaccgtaacgtaacctaaaggttaacgaaaccgttacggtaaccgtacgggtaacgaccgggtaccgaacgggaccgttacgggttaccgtttacggttacgtttacggttacggttggttaccgttacggaagggtacggtaggggttaggggtacggggttgtacgggtaaaccgg

SEQ ID NO: 256651 - DNA, 794 bp, Homo sapiens
  misc_feature: GYAE6OF01BKITV.14.55.E11.1.454.CMB.1.raw
  modified_base (368)..(368): a, c, t, g, unknown or other
  misc_feature (368)..(368): n is a, c, g, or t
tcagcgtctagtaccacgaccggtgctcgatttagcactcgcacgttgggctctgggagaggagcccagcactagaagtcggcggttgtttccattcggtgatcagcactgaacacagaggactcaccagtggagtttgggctgagtcgttgggttttcctcgttgcttcgttttaagaggtcgtcctagtgtcaggtgcgagtcgtgggtggacgtcggtgggggagtccggtggtccaggccgtgggaccgtccctagacctctctcgtgtcgactacgtcgtgtacgttcacgttctcgtagttacgttagtggactgtcgcgtacgtcgggtcccgccgcggccgtccgaggaccgggaagggngtagggtcgggtagggtcggtcggtaggtttcggtgggttaggttagtagggtaaacggtaagttaaagttaaacggtaagtacggtacggacccgggtaaccggtaccggtaagggtaaccgggtaccggttaccgttaccgtaaccctacgttaccgtaacccgtaacggtaaccgtaaccgttaaacctttaaacccaaacgtaaacccgtttaagttagtttacgtactttacgaacgttaacgtaaagtacgtaaacgttacggacccgtaagggacgtaaccgggaccggtaacgggtaaaccgtccgggtaacgttggttaaccgtttacgttacggtttaggtacgtacggtaagggtacgggttaaggggtacgggggttaggggttacggttacgggttaccgtaagggttaacgg

SEQ ID NO: 256652 - DNA, 742 bp, Homo sapiens
  misc_feature: GYAE6OF01BRBZF.14.55.E11.1.454.CMB.1.raw
  modified_base (145)..(145): a, c, t, g, unknown or other
  misc_feature (145)..(145): n is a, c, g, or t
  modified_base (189)..(189): a, c, t, g, unknown or other
  misc_feature (189)..(189): n is a, c, g, or t
  modified_base (340)..(340): a, c, t, g, unknown or other
  misc_feature (340)..(340): n is a, c, g, or t
  modified_base (354)..(354): a, c, t, g, unknown or other
  misc_feature (354)..(354): n is a, c, g, or t
tcagcgtctagtaccacgaccggtgctcgatttagcactcgcacgttgggctctgggagaggagcccagcactagaagtcggcggtgtttccattcggtgattcagcactgaacacagagactcaccagtggtagtttggctagngtccgttgggtttttccctggttcgtctttacgtttttaaaggnggttcgtccgaagttcgtacgagggttgcgagtcgttgggtagggagtcggtggggggacgtcggtggttacccgaggtccggtaggggacgttcccctggaacctcttccgtctaggtcgacctacggttctggtaacttccgatcgttnaaggtttgttacgnggactagtgccgtcggttcggggaccctccgaggtccctacggacggtcggaacggggtctaaggggtggtggggtcgcggtttagttgtggtcggtaagtaccggtaaggtaaagtaacgtaaggtaatcgtcgggaccgtacggtaccggaagccgggttacgtactaccgaactacgtccgtacgaacgaacgactaacgtaacctaacacgttagttacggtacttaacgtcgttaaccgtaataacggttacgaaacgttcgtaacccgtagaccggaacgtaccggaggaccgttaacgggcgtttagtacgtttagtacgttaccgaggttacgaggtacggttagggagggtacggggtagttacgcggttcggttaagg

SEQ ID NO: 256653 - DNA, 828 bp, Homo sapiens
  misc_feature: GYAE6OF01DLHT2.14.55.E11.1.454.CMB.1.raw
  modified_base (102)..(102): a, c, t, g, unknown or other
  misc_feature (102)..(102): n is a, c, g, or t
  modified_base (194)..(194): a, c, t, g, unknown or other
  misc_feature (194)..(194): n is a, c, g, or t
tcagcgtctagtaccacgaccggtgctcgatttagcactcgcacgttgggcgtcgtgggagaggagcccagtcactagagtcggcggtgttccattcggtanatcagcactgaacacagagacctcacctagtggtagtttcgggcttacggagtcgtttcgggttttccctcggttgtactttcgttttaagnggtcgtcctagtgtcgaggtcgcacgcgtgggtaggcggtggtgggggtagtcggtcggtaccacggttccggtgggggaccttcccgataccgtacctcgttaccgtgtacaccgtaggtcctaggtacctccgagttccgtacgtagttacttagcgtactgtccgacgtccgtacgggtcccgtaaccgtccggtaccgtacggcggacgggtacgggtacgtgggaacggtttcgggatcggttaggtaggtttcggtagtaaccggacggtaacggtaaaacgtaggttaaacgtaccggtgtccgggaacccggttacggtaccgggttaacgggaaccgttcgtaaccttaccgtaccgtacggtaaccccgtacgaaggtacgtaaacctaacccgttaccgaaactacgttaacgttcggtactttactacggttaacaaacgtttaacgaacgttacctacgggtacggtaaggaccgtaacggacccgggttaacgaccgttaccggttaggttaccgttacgtttaaagtccggttaaggttcggggtaacctaaaaggggttcggtttaggggggtacccgggtagggtttacgggacgttaacccgttgggttaaacggg

SEQ ID NO: 256654 - DNA, 754 bp, Homo sapiens
  misc_feature: GYAE6OF01B9PWP.14.55.E11.1.454.CMB.1.raw
  modified_base (295)..(295): a, c, t, g, unknown or other
  misc_feature (295)..(295): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatcgtgtaggagacagagtccaacctatcacgttcggccgggacaagtcagagactaattaaagaacttaattttaaagttggtactacaaacgaacgaaaccgagggaaaccncccctagacccttcgtagtacttctagtcgactcgactagttccgtagtttcgacgtacggtacggttccggggtacccgttacgtaacgggtttcgaggtcggacgtaggttacggagttacggacggtactagttacctttacacgtacctaccgtaaccgtacgacgtaccgtacgtctacgtaccgtaaccgtagttaacgttacgtttacgtaaccttaacttaccgttacgttacgttaacgaacgtaacggttaaccgttaacccgtaaccccggttacccccgtacgttacccgggtttaccgggaaccgggtaacgggaacccggtaacggggacggtacgtaaccggtaaccgaaccggtaaccggttaacggtacggttaccggtaccgtaccgtaacccgtaacccgtacgtttaccgttccgtttaccgttacccgttaaccccgg

SEQ ID NO: 256655 - DNA, 730 bp, Homo sapiens
  misc_feature: GYAE6OF01BP1RL.14.55.E11.1.454.CMB.1.raw
  modified_base (254)..(254): a, c, t, g, unknown or other
  misc_feature (254)..(254): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagtcgttgggtttttcctcgttgcttcgtttttaagaggtgtccagtgtcaggtgctagcgtgggtggagtcggtgggggagcgtggtccaggccgtgggacgtccctgacnctctcctgtgctacgtctgatcagtcttacgagttagtagtcggctagtcgctacggtcggcccgaccgacggccctccggagggcggaggggtcgtgggaggtggggtcgcgttaggttggtaggtcggtagtacgggaacggtaagttaaagtaaggtaaagttcggacgggacccggtaacggtaccggtagggaaccgggtccgtactttacccgacccgttattcccggaaccgaggtaaacgtaacccttaactaaccccgaaattaaccgttaggtttcgtttaacgtactttacggtagaaaccttaagttacggaaacgttccgacgttaacgggaggacccggaccgggtagacccggtacggttagttattaagggttaccttacggttgtaccggttacggaagggttaggagggggtttacgggggggaggggttttaacgacggtccgggttaagttagggg

SEQ ID NO: 256656 - DNA, 953 bp, Homo sapiens
  misc_feature: GYAE6OF01DS7W4.14.55.E11.1.454.CMB.1.raw
  modified_base (864)..(864): a, c, t, g, unknown or other
  misc_feature (864)..(864): n is a, c, g, or t
  modified_base (939)..(939): a, c, t, g, unknown or other
  misc_feature (939)..(939): n is a, c, g, or t
tcagcgtctagtaccacgaccggtgctcgatttagcactcgcacgtttgggtttgggggagctctgggagaggacgcccagcactagaagtcggcggtgtttccattcggtgatcagcactgaacacagaggactcaccagtggtaggtttggctgagtcgtttgggtttttcctcgttcgtctttacgttttaaggaggttcgtccgtaggttgtacgtagggtcgccgaggtcgttgggtacgggtagggtcggggtaggggggtacgggtcggtcgggtacccgacgggtcccggtagggggtacccggttcccctaggtaacccttccgttcccgttccggttagtccggtaaccgtaaccggtttacgttggttaacttccgacggtttccgttacggtaaggttttaagttaggtcgtaccgtagttccggtaccgtaccgggttcccggggaccccgtaccggtaccgggtcccgtaaccgggaacgggaaccgggtacgggggtacggtaggggtacgggttggggtcggtacgttagggtttgggtacgggttaggtaaggttagggaaacggttaaaacggttaaaggtaaacgggtaaacggtccggtaccggtaaccccggtaccggggtaccgggtaacggggtaaccccggccctttaaaccgttaaccccgaacctaccggttacccggaaacccgaaaggttaaaccctaaccgtttaaaccctacccaaaacttaagttacggttttacgttaacgttaccgtactaacggtaaattaagttaaacggtaactcgggtaccggaaggtaaccggacggttacccggaaaggttcccgtaccgggttnttaacgggttaactttggttaaccggtggtaggtaacggtaaggtaggggttacggggttagggggggtaaggtnttaaccggtacggg

SEQ ID NO: 256657 - DNA, 879 bp, Homo sapiens
  misc_feature: GYAE6OF01DP3MA.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacgagaggactcaccagtggagtttggctgagtcgttcgggttttcctcgttgcttacttttaaggaggtcgtccgagtgtcgaggtgcgagtcgtggtggagtcgggtgggggagtcgtggtaccgaggtccggtagggacgtccccgtgacctaccttcgtccgtagtgaccgtacgttcgtaggtactttcgagttaccgtttacgtaggtttaacgttagttggcctagtcggtacctaccggttcgggaccctaccgacggtcctaccggaggtacggaacggggtcgtagggtagggtagggtcgtacggttaggtttcggttaggttaggttacgtacgggaaaggttaaaagttaaaggtaaaggtaaacggttacggtaccgggacccgggtaaccggtaccgggtacggtaaccggggtacccttaacgttacccgaaaccgtacgtcccggttaaacccgaaggtaaaccgtaaaccgttaaacctaaccccgaaaacgttaacggtttaagtttaccgggtttataaccgttttacgaaggttaaacccgttaaagtaacggttaaaccgtaccggtacccggttaaggtaaacccgggacgggtaaccccggacgggtaaccccggttagggtaccgtttacggggttaacgttttaacccgttaggttacggttaacggtacggtaaacggggtaaggtacggggttagggggtaacggggttagggttacgtaacggttcgggtttaaagg

SEQ ID NO: 256658 - DNA, 622 bp, Homo sapiens
  misc_feature: GYAE6OF01CCRVL.14.55.E11.1.454.CMB.1.raw
  modified_base (122)..(122): a, c, t, g, unknown or other
  misc_feature (122)..(122): n is a, c, g, or t
  modified_base (175)..(175): a, c, t, g, unknown or other
  misc_feature (175)..(175): n is a, c, g, or t
  modified_base (205)..(205): a, c, t, g, unknown or other
  misc_feature (205)..(205): n is a, c, g, or t
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
  modified_base (326)..(326): a, c, t, g, unknown or other
  misc_feature (326)..(326): n is a, c, g, or t
  modified_base (341)..(341): a, c, t, g, unknown or other
  misc_feature (341)..(341): n is a, c, g, or t
tcagcgtctagtaccacgaccggtgctcgatttagcactcgcacgttgggctctgggagaggagcccagcactagagtcggcgttgttccattcggtgatcagcactgaacacaggagactnaccatggagtttgggctggagcgttgggttttcctgttgcgttcttttaaagngggtctccagtgtcgaggtgacaggctggnggacgtcggtgggggagcgtgtccgagccgtgggagtcccgtagacctcgtctcgtgtgaccttagtctgcttacgagtcttacgngttaattacggngtcaagtcgctacggcggtaccncgaggtcctaccggnggaccggtaggcgtagggacgtggtcgattgtcggagtcgtagaggaacgtaatagtacgtaagtcgtcgacggacgtcggacacggtcgtacgtacgtacctacgtgtacctagaacgtactaacgtaaccaatactagttcgtagtactacgactacgataacgtacgtacgagtacgtacggacgttaccggacgaacggtggtacgttaccgtagtacgttacgtaccgtagtacgaacggtgtacgggtggtaggggtacgtcggagtcggttacg

SEQ ID NO: 256659 - DNA, 700 bp, Homo sapiens
  misc_feature: GYAE6OF01E4YGR.14.55.E11.1.454.CMB.1.raw
  modified_base (176)..(176): a, c, t, g, unknown or other
  misc_feature (176)..(176): n is a, c, g, or t
  modified_base (267)..(267): a, c, t, g, unknown or other
  misc_feature (267)..(267): n is a, c, g, or t
  modified_base (290)..(290): a, c, t, g, unknown or other
  misc_feature (290)..(290): n is a, c, g, or t
  modified_base (314)..(314): a, c, t, g, unknown or other
  misc_feature (314)..(314): n is a, c, g, or t
  modified_base (633)..(633): a, c, t, g, unknown or other
  misc_feature (633)..(633): n is a, c, g, or t
tcagcgtctagtaccacgaccggtgctcgatttagcactcgcacgttgggctcgtgggagaggagcccagcactagaagtcggcggtgtttccattcggtgatcagcactgaacacagaggactcaccatggagtttgggctgagcttgggtttttcctcgttgcttcttttaagnggtgtccagtgtcaggtgcagctggtggagtcgtgggggagcgtggtccagccgtgggacgtccctgacactctcctgtcgacaacgttcnggattcagcttgagttagttagnggcagtcgactaccgtcgggtccncaaggtcctaccggaagggccgaaagggggcttagggacggttgggtcggcgtaaggtttggttaggtggttaacgtagggtaacgggtaaaagtttaaaggtaacggtaaaagttcgtacgggaccccggtaacggtcccggttaagggaaaccgggtcccgttaagttcccgaacccgtacttcccgtaaccggaaggaacggtaaactaacctttaacccaaaaccgtaaacgtaacgtttagtttacggtaacttcgtagaaccgtaaagtacgaagtacgccgttagaacggacgtaccggaggaccacgggtntacgttagtacgttacgtgtagtcgaggacgtagggtgggtaggggtcgtaggtaccgtcggtaagg

SEQ ID NO: 256660 - DNA, 888 bp, Homo sapiens
  misc_feature: GYAE6OF01CIN0S.14.55.E11.1.454.CMB.1.raw
  modified_base (860)..(860): a, c, t, g, unknown or other
  misc_feature (860)..(860): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacaggaggactcaccagtggagtttggctgagtcgtttgggtttttcctcgttcggtctttactttttaaaggaggttcgtaccgtaggttgtcgtagggttcgacgacggtcggttaggggttgggtacgggttccggggtaggggggggacggttccgggttacggggttaccccgagggtccccgggtttaggggggaacccggttttcccccgagggtaaccctttcccgttccccggtttccgttacggggtaccggtaaccgttaaaccggtttcgggttacggttaacgtttccgtacggttaccccgttttaaggttaacggtttaacggtttaacggtcggtacgttaacgtccgggttaacccgttaccggggtttccggggtaccccgaccggtacccgggtaccgtaaccccgggaggggtacgggtaaacgggggtcggtacgggggtggttacggggtcggtcgttaggggtttagtggggtacggtaggtaacggaaagtaacgtaaggaaacgtagtacgcggccgtaacgggcgtagggacgtccgtacttcgaaccttacgccgtaacgaagtaaccgaaactaaccgtacaaacgtacgttacgtttaagttcgtaatcgtaagaactaagtaagacgtaaccgtgaacggcggtacgacgaacggtgaccgtagtcgttacgttagtacgtagttcgaacggaggtcgggttaaggggngggtaaggttcggtacgttggtaacggg

SEQ ID NO: 256661 - DNA, 706 bp, Homo sapiens
  misc_feature: GYAE6OF01C8CV6.14.55.E11.1.454.CMB.1.raw
  modified_base (301)..(301): a, c, t, g, unknown or other
  misc_feature (301)..(301): n is a, c, g, or t
  modified_base (351)..(351): a, c, t, g, unknown or other
  misc_feature (351)..(351): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcgttcgggttttcctcggttgcttcttttaaggaggtgtccagtgtcaggtgcagctggtgagtcgtgggggagcgtaggtccagccgtgggagtccctagacacttctccgtagtgacctacgtctaggacttcgacgtcttacgagttaacgttnacggcattcgcgtacggtcggtcccgacaggcctcgaaggcgaacggggntagggaggtcgggagtctaggttgtggttaggatacgggaaacggtaagttaaagtaccgggaaaagtttcgtcggaccccggtaaacggtcccggtaagggaaacgggcccgtagttacccacgtacgttcccgtacgaagtaaaccgtaacctaaagttacccgaaactaacgttaattcgtttacgtaatttcccgaagtaacctaaagttccggaatttacccggacccggttagaaaccggcgtaacccggaggtaacccgaccgggtactaggttacgttaagtttacggtaggtacgtcgaaaggaggttaggtagggggtacgggtgtacgttaaccgaggttaggg

SEQ ID NO: 256662 - DNA, 861 bp, Homo sapiens
  misc_feature: GYAE6OF01BTS9H.14.55.E11.1.454.CMB.1.raw
  modified_base (177)..(177): a, c, t, g, unknown or other
  misc_feature (177)..(177): n is a, c, g, or t
tcagcgtctagtaccacgaccggtgctcgatttagcactcgcacgttgggctctgggagaggagcccagcactagaagtcggcggtgtttccattcggtgatcagcactgaacacagagactcaccatggagtttgggctgagcttgggttttcctcgttgcttcttttaagaggtntccagtgtcaggtgcagcgtggtgagtcgtgggggagcgtggtccagccgtgggacgtccctgaccactctccgtgtcgcctaacgtcgtggactttacgagtcctttagaaggtttagttaatcgggctaagtccggtacctaaccggttcgggggttccccgaccggtaagggtccccgttaccggaacggggaccggtaaaccggggggcgttaacggggtaagggtttcgggggtcggtccgttaaagggttttgggtaggttaggggttaacgttacggggaaaaccgggttaaaaaggttaagttaaaagggtaaaaaacggttcgttaccgggaacccccggaaaccgggttaccccgggttaaaggggaaaacgggggtaccccggttaacgtttaacccccgtaaacccgttaaccgttaacccgttaacccggtaaaacggtaaaccgtaaaaacccggttaaaccttaaacccccgtaaaaaccgttaaaaccttaaggtttacgttttaacgttacttaaccgttaggaacctaaaaaggttcgtaaacgtaggtaacccgtagaacggacgaacgtacggacgtacgggtcctagttacgttaagtacgttggtacgtcgaagggacggtaaggtcgggggtaggggttaggtcggtagtacggttaaggg

SEQ ID NO: 256663 - DNA, 771 bp, Homo sapiens
  misc_feature: GYAE6OF01A41TA.14.55.E11.1.454.CMB.1.raw
  modified_base (184)..(184): a, c, t, g, unknown or other
  misc_feature (184)..(184): n is a, c, g, or t
  modified_base (341)..(341): a, c, t, g, unknown or other
  misc_feature (341)..(341): n is a, c, g, or t
  modified_base (392)..(392): a, c, t, g, unknown or other
  misc_feature (392)..(392): n is a, c, g, or t
  modified_base (438)..(438): a, c, t, g, unknown or other
  misc_feature (438)..(438): n is a, c, g, or t
  modified_base (714)..(714): a, c, t, g, unknown or other
  misc_feature (714)..(714): n is a, c, g, or t
tcagcgtctagtaccacgaccggtgctcgatttagcactcgcacgttgggtttggggctgggagaggagcccagcactagaagtcggcggtgtttccattcggtgatcagcactgaacacagaggactcaccagtggagtttgggctgagtcttgggttttcctcgtttgcttacgttttaagnggttctccaggttgtcgaggtcgactagtcgtgggtggagtcgggtgggggagtccggtcggtcccaggccgttggggacgttcccctgacctccgttcgtccgtagtacgaccgtacgttctaggtacttctagtcttacgtaggttaacgttagnggtacctagtcggtacctacggggttccgggtacccggcccggggttaccncccgggaacggaacggtaccggggtagtcggggtaaggttcggggngtacgttaggttggtaggtaggtacgaggtaaacggttaagttaacaaaggttagttacgaccggtaccggtaaccggcggtagaaccggggaccttaactaccgtaccgtacctaccgtaccggtaagaaccgtaacgttaaaccttaaccaaccgtaacgttattacggtttacttacgtgtaacgttacgtaaagttacgaaacgtgtaccggtagtacggaacgtacggagtaacccggtgtacgtagtttaaccgtagtttacgtacggtnttaccggagttaggtacgggtaggggttcggtaggttagcggttagggacggtttag

SEQ ID NO: 256664 - DNA, 871 bp, Homo sapiens
  misc_feature: GYAE6OF01C5W0U.14.55.E11.1.454.CMB.1.raw
  modified_base (193)..(193): a, c, t, g, unknown or other
  misc_feature (193)..(193): n is a, c, g, or t
  modified_base (556)..(556): a, c, t, g, unknown or other
  misc_feature (556)..(556): n is a, c, g, or t
tcagcgtctagtaccacgaccggtgctcgatttagcactcgcacgttgggtttggggtacgatttgatgttacctgatgcttagaggtcttttcctggaagcagggctatttgttgcttcagcaccgtagtcgcctcgtcactcaccgtcctcacgtccttgtacgttttccggatttcgcctaggaaaaccncgcctacaccgtaccgttaaaaccgggacctaaccggtccgacccggaccaaactacgtacgccctttcctccccgtcccccctgactacgtaaccacctaagtacaggtaacttacttacctcgttccatcgtacctccgtcctttcgcctcgtccgttagggtaccactcctaccctcgaccccgtaagtttaaccggtcggaaccgtaccggtacctttcggtccttaccgggcggtacgtaccgggttccttttaaccgaccccgtttacgttttaacgtccgtttaactttcgtacggttcctaacggcccttaacgtttccggtaccttactttcggtactaaaccgttaccccgtntaaccgcttactaccgtaccttaccgaacgtaccgtcctaacccgtaccttaccggtaacgtaccggtacccgtttaacgacccgggtaaaccccctcccgttaacccccctaaacccggaacctaaaccgtaccgtaaacgaccggttaccccgtcgggtaccctacccggaccgtacggtacgttcccgtttacgggcttaaccggtttaccgtttcggggttaaccccttaccccggttttacctccccgttacccgtcccccggttaacttccgttaacgttaaccgtaacggtaggttcccggtaaccgg

SEQ ID NO: 256665 - DNA, 792 bp, Homo sapiens
  misc_feature: GYAE6OF01CDTS8.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccgagtggtaggtttgggctgagtcgtttcgggttttcctcggttgtcgtttacgtttttaaggaggttcgtccgtaggttggtccgtaggtcgccgtaggtcgttggggtaggagggttccgggtgggggggtacgtccggttcggtacccgacggtcccggttagggggtacccgttcccgtaggaccctaccgttccgttcccgtggtccgtaccgaacggttccgttagggtacttccgagttccgttacgtaggtttagttagtcggactggtacgccgtaccgggtccgggttacccgccggacggtccgtccggaagggacggtacgggtcggtagggtagggttcgggtaggtacggtttagggttgggttcgtaggtacggtaggtaaacggtaagtaaagttacggtaaagttcgacggacccggtacggaccggtaggacggtcctacgtaaccgctacgtcgtaccgaagtacgtaacctaactaacccaacgtacgttagttacggttactacgtacgtaagacttaagtaacgtagtacgtggtagaacggtaccgacggtacggcgtacggtgttagtacgttaacgtgttggtaaccgttggaagggttaggtaggggtagggtaggggtagtaaggtccgttagtacggg

SEQ ID NO: 256666 - DNA, 765 bp, Homo sapiens
  misc_feature: GYAE6OF01ELA3H.14.55.E11.1.454.CMB.1.raw
  modified_base (161)..(161): a, c, t, g, unknown or other
  misc_feature (161)..(161): n is a, c, g, or t
  modified_base (179)..(179): a, c, t, g, unknown or other
  misc_feature (179)..(179): n is a, c, g, or t
  modified_base (215)..(215): a, c, t, g, unknown or other
  misc_feature (215)..(215): n is a, c, g, or t
  modified_base (273)..(273): a, c, t, g, unknown or other
  misc_feature (273)..(273): n is a, c, g, or t
tcagcgtctagtaccacgaccggtgctcgatttagcactcgcacgttgggctctgggagaggagcccagcactagaagtcggcggtgtttccattcggtgatcagcactgaacacaggaggactcaccagtggagtttgggctgagtcgttgggttttccncgttgcttcttttaaggngtgtcctagtgtcaggtgcagcgtggtggagtcggngggggagcgtggtccagccgtgggacgtccctgacctctcgtcctgtcgactaacgtntaggacttcgatcttacgtagttacgttagtggctagtcgacgtacggtcggggtaccccgccgacgggtccctaccggacgggaccggtaagggggtcgttaggggcgggttggggttcgggacgtttaagggttggttggttaacgggtaagtcggggtaaacggtaaaagtttaaagtaaacggtaaggtaacgtcggacccgggaacggtaccgggtaggggaacggtacccgtacgttcccgaacctactacgtaccgaaggaaaccgaccttaaacgtaacccgaaacgtaaacgttcgttaagtttacgtaacgttcgtttacggaaacttaagttacgaaacgttacgtaccggtaggaacggacggtaccggtaacggaccgtacgggtacgtagtacggtttacgttcgttaggttagtacggtaggtacggtaaggggttgggggtaaacgggggtggtacgttaacggtcgggttaaagg

SEQ ID NO: 256667 - DNA, 865 bp, Homo sapiens
  misc_feature: GYAE6OF01C9V90.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagagactcacagtggtagtttgggctgagtcgttcgggtttttcctcgttgtctttacgtttttaaggaggttgtaccgtaggttcgtcgaggtcgcagtcgtgggtggaggttcgggtgggggacgtcggttcggtcccaggtccggttggggaccgttcccctaggacctaccttccgttaccgtggtacgaccgtaacgttcgtaggtaactttccgagttcttacgtaaggtttagtttagcggtactacgtggtcccgtaccgggttccgggtacccgaccggtacggtcccctaaccgggaggggtaccgggaagggggttccgttaggggagggttcggggtacggtcgtttagggtttggtaggttacggttaagtaggggaaacggtttaaagttaaagtaaacggtaacgttacggtcccggaacccgggtaaccgggtaccggtaagggaacccgggttccttaaacgttaccccgaaccttaacgttacccgaaccgaaagtaaccgttaaaccgttaaaccgtaacccgtaaactaagttacgtttagtttaccgttaacctttacggaacgtaaaacttaaggttaacgaaaccgttcggaaacgttcggaacggaccggtaaccggtaggaccgtccggtttagttacgttcgtttaacgttcggttaggttacgtacggtaagagggttacggggttacgggggtaggttagtacggttaccgtgggttaaagg

SEQ ID NO: 256668 - DNA, 777 bp, Homo sapiens
  misc_feature: GYAE6OF01DH6YF.14.55.E11.1.454.CMB.1.raw
  modified_base (206)..(206): a, c, t, g, unknown or other
  misc_feature (206)..(206): n is a, c, g, or t
  modified_base (222)..(222): a, c, t, g, unknown or other
  misc_feature (222)..(222): n is a, c, g, or t
  modified_base (386)..(386): a, c, t, g, unknown or other
  misc_feature (386)..(386): n is a, c, g, or t
  modified_base (753)..(753): a, c, t, g, unknown or other
  misc_feature (753)..(753): n is a, c, g, or t
tcagcgtctagtaccacgaccggtgctcgatttagcactcgcacgttggggtttggggagtctcagtcaggacacagcatggacatggagggtccccgctcagcctccgtggggctcctgctactctggctccggaggtcgccagatgtgacatccagatcgacccagtcctcactccctcctgtctgctattcgtaggtaagganacgagactacaacctntacctacgtcggaccgggtacaacgtcgaaggtacgaacgtaacttaaaaggtaaactttaaagttttaaacgttaggtaacctaaacgaaaacgtaaacggtaaaaccggaaacgggaaccgtaccccgtacgaccttaccgtagtaccttactacgtcgtcncggtactacgttacctagggtttacgaaccgtacgggttacgggttaccggggtacccgtaagttaccgggtttaggaacgggttacggtacgtagggtacggtacggttaggaacggtaagtacgtttactactaccgtcgtacgtaccgtcaacgtcggtacgttacgacgtaacctaacgttaagtaactttacgttaaccgtaaacttacctacgttaactaacgttaaccgaacgaacgttacgttaaccacccggttacccctagggttaccggttaacgggaccgggtaaccggaccgaacggtaacggacgtagtaaccggaacggtaacgtaggtacggctagtaccgacgtaacctnttaccgtacttcgtacgttacccg

SEQ ID NO: 256669 - DNA, 757 bp, Homo sapiens
  misc_feature: GYAE6OF01DHFB9.14.55.E11.1.454.CMB.1.raw
  modified_base (165)..(165): a, c, t, g, unknown or other
  misc_feature (165)..(165): n is a, c, g, or t
  modified_base (299)..(299): a, c, t, g, unknown or other
  misc_feature (299)..(299): n is a, c, g, or t
  modified_base (329)..(329): a, c, t, g, unknown or other
  misc_feature (329)..(329): n is a, c, g, or t
  modified_base (335)..(335): a, c, t, g, unknown or other
  misc_feature (335)..(335): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccggaggtgccagatgtgacatccagatgacccagtcnccactcctccctgtctgcatcgtgtaggagacagacgtcacatcctaagttcggaccggcaagttcaagagctaattaagaaacttaattttaaacgttaggtataacgaaacaaggaaaccgaagggaaaccncccccggataccctcgtagtactacgttangtacgntacctacttccgtagttacacgtagacggtcggtccgtacgtaggtcgagtcgagtagtagagttgacgggtaatcgtaacttcgtaaacctctaaccggtacctacaccgtacgtacggtacctaacgtaccgtaacgtacgggtaacttttaacgttacgttactaaaacctttaccggttaaacttaccggttaaacgtaaacgtaacgttaaccggttaaacccgttaacccgttaaccccccgtttacgttaacccgggttttaaccgggacccggggtaaacgggtacccggtaaacggggtacggtaaggtaacccggaacgttaacgggaaacgtaaccggttacggtacggtaccgtacgaaccccgttacgttaacgttcccgttaccgttaacgtttaccccgttacccgg

SEQ ID NO: 256670 - DNA, 741 bp, Homo sapiens
  misc_feature: GYAE6OF01CISK7.14.55.E11.1.454.CMB.1.raw
  modified_base (116)..(116): a, c, t, g, unknown or other
  misc_feature (116)..(116): n is a, c, g, or t
  modified_base (181)..(181): a, c, t, g, unknown or other
  misc_feature (181)..(181): n is a, c, g, or t
  modified_base (402)..(402): a, c, t, g, unknown or other
  misc_feature (402)..(402): n is a, c, g, or t
  modified_base (433)..(433): a, c, t, g, unknown or other
  misc_feature (433)..(433): n is a, c, g, or t
  modified_base (672)..(672): a, c, t, g, unknown or other
  misc_feature (672)..(672): n is a, c, g, or t
tcagcgtctagtaccacgaccggtgctcgatttagcactcgcacgttgggctctggggagaggagcccagcactagaagtcggcggtgtttccattcggtgatcagcactgaacanagaggactcacatggtagtttggctgagtcgttgggttttcctcgttgcttacttttaagaggtntccgagtgcaggtgacgtagtgtgggaggtcggtcggtggggggacgtcggtcggtaccacggccggttggggaccggttacccctggaaccgtacccttccgtcccgttgaccggtaccggtaaccgtttcgtagggtaccttcgagtcttacgagttaagttgtggacatggactccggttcggcccgccacggcctaccggaggacgtaacgggggtnaggggtgggttgggcggacgttaggtttggnggttagtagtacggtaaggaaattaaagtaaggaaacgttacgtacggacccggtacgtacgggtaacgggaagggtcccgtaactttcccgaactacttaccgacccgaagtaacgtaaaccgtaaactttaacccaaacgtaacgttacttacggtaatttacgaccctttaaggaaactaagttacgtaaccgtagtacccgtaaggaaccgtacggaacgcggaatacggtacgngttaagtacgtagttccggaggtacgtaggacgttaggtagggggaggtttggacgtaggttccgtagg

SEQ ID NO: 256671 - DNA, 749 bp, Homo sapiens
  misc_feature: GYAE6OF01ASIUI.14.55.E11.1.454.CMB.1.raw
  modified_base (157)..(157): a, c, t, g, unknown or other
  misc_feature (157)..(157): n is a, c, g, or t
  modified_base (182)..(182): a, c, t, g, unknown or other
  misc_feature (182)..(182): n is a, c, g, or t
tcagcgtctagtaccacgaccggtgctcgatttagcactcgcacgttgggctctgggagaggagcccagcactagaagtcggcggtgtttccattcggtgatcagcactgaacacagagactcaccagtggagtttggctgagcttagggttttccngttgctttacgttttaaggcggttntccgtagtgtacgagggtgctaggcgttgggtggtacggtcggtaggggggagtcggttggtaccacgggtccgtcggggtacggttcccctgaaccttccgttcgtccgttggttacaccgttaacgttcgtaggacttccgagttccttagtaaggttcgttaggtgctaacgtcgaccggtaccggtggggtaccccacggtacggtcctaccgggacggtaccgggtaaggggtcgtaggggcgggtttgggcggtcgtaggtttggcggttagggtaacgtagggtaacggtaaaagtgtaaacggtaagtcggtaccggaccgtacgggtacggtaccgggtaaacccggtggttaccctaacgtaccgttacgtaccgaaccggtacgtaaacacctaaacctaacgaactacgttagtaacgttacgacttacgtaactaagaattagaacgttccaacgtgacggtaccggaacgtaccgacgtacgtgttacgtagttacgttcgacggttgacgtaaggtggacgggtggggtaggttcgaacggttccgtggtag

SEQ ID NO: 256672 - DNA, 956 bp, Homo sapiens
  misc_feature: GYAE6OF01BOZ9W.14.55.E11.1.454.CMB.1.raw
  modified_base (179)..(179): a, c, t, g, unknown or other
  misc_feature (179)..(179): n is a, c, g, or t
tcagcgtctagtaccacgaccggtgctcgatttagcactcgcacgttgggctctggggagaggagcccagcactagaagtcggcggtgtttccattcggtgatcagcactgaacacagaggactcaccagtggagtttgggctgagtcttgggttttcctcgttgtcttcttttaaggnggtgtcctagtgtcaggtgcagcgtgggtcggaggtcggtgggggggacggtcgggtcggtcccacgggccgtgggggacggttccccgtagaccctaccttccttccgtggtacgaccgtaaccggttccgtgggtaactttccgagttccgttacgaaggtttaggttagcggtactacgttcgccgtaccgggtcggggtccccgaccgacgggtcccgtccggaacgggtaccgggtaacgggggtcggttaggggacgggtttgggggtacgggtacgttagggtttcggttaggttaggggttaaacggttaacggggtaaaacggggttaaaaagtttaaacggtttaaaaggggtaaaaaccggtttacggtacccggggtaacccgggtaaccgggtacccccggggttaaaggggaaacccgggggttccccgttaacgttaacccccgttaacccccgttaagttcccccggtaaaccgaaaggtaaacccgtaaaaccttaaccggttaaccccaaacgttaacgttcgttacggtttaacgtacttaccggtaacgtaaacccgtaaagttcgtaaacggtcgtaaccggtaagggtaaccgacgggaacccggtacggtaccgttaccgggttaagtttccggtaaacgttttacggttacgggttaccgttaagggtcccgtaaaaggggttgggttaacgggggttagggggggggttaacgggttaccgggttaggtacccggtttacgggtaaaagggg

SEQ ID NO: 256673 - DNA, 803 bp, Homo sapiens
  misc_feature: GYAE6OF01ATMRQ.14.55.E11.1.454.CMB.1.raw
tcagcgtctagtaccacgaccggtgctcgatttagcactcgcacgttgggctctgggagaggagcccagcactagaagtcggcggtgtttccatcggtgatcagcactgaacacagacggactcaccagtggtagtttggctggagtcttcgggtttcctcgttgtcttacgtttaagacggtgtcctagtcgtcgtaggtgcgaggtcgtgggtcgggtaggtcggtgggggaggtcgtcggtaccgagtccggtgggaccggtcctagacctctcgtcgtgtcacgtacgtcgtagtactcgacgtcttacgtagttaagttacgtggtctagtcggactaccgggtcggtcccgaccggacggttccgtaccggacggggtaaccgggaacgggtcggttaggggtaacgggttcggggtacggtcggttagggtttcggtgggtacggttaacggtacggtaaaagggtaagttaaacgtaaagggttaactacggtaccggaaccggtaccggtccgggtaacggtaacggaccgtaacgtaccgtacctaacgtaccgtacgtaacgtaacgtaactaaccgtaaccgaactaacttacgtaacgtagtacgtacgtaacgtaacgtaagtaacgtaacgtaggacgtacggaacgtaaccgggaccggtacggaacggtttttaaccggacggtttacggtacgttagttaccggttaggttaacggtacggtaagggtaacggaaggggttaccgggggttaaggggtagggtacggtacggtagggtaaccggg

SEQ ID NO: 256674 - DNA, 843 bp, Homo sapiens
  misc_feature: GYAE6OF01ETGJA.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccagtggtagtttggcttgagtcgttcgggttttcctcgttcgtcttacgttttaaggaggtcgtacctagtgtcgaggtgcagtcgtggtggaggtcggtgggggacgtcggttcggtccgacggccggtggggtaccgtcccgtgtaaccgtaccttccgtccgttggtaccgacgtaaccggttcgttagggttacttccgtacgttcctttacgtaaggtttacgtttaagtcggtacctaagttccggtaacccgtaccggtttcccggggtaccccgaccggtaaccggtcccgtacccggtaacgggtacccggggtaaggggttccggttagggggttacgggttcgggggtttaaccgacggttaggttttacggtgggtttacggttaaacggtacgggtaaacggtaaaagtttaacggtaacggtaaaaggttcgacccgggtacccggtaaacggtacgggtaacgggaaccgggtaccgtaaccgttacccgaaccttacgtacccgtaacgtaacgaacgtaacctaaccgtaaccctaacgtaacgttagtttagttacgtactacgtaacgtaataaacgtagtaacgtaccgtcggtagacggacgaaccgacggtacgtaggtccgttagtaccgttagtcgttgacggtagacggtagggttacgggtaggggtcggttacgacgttgtcggttacgg

SEQ ID NO: 256675 - DNA, 771 bp, Homo sapiens
  misc_feature: GYAE6OF01BX51P.14.55.E11.1.454.CMB.1.raw
  modified_base (748)..(748): a, c, t, g, unknown or other
  misc_feature (748)..(748): n is a, c, g, or t
tcagcgtctagtaccacgaccggtgctcgatttagcactcgcacgttgggtttggggagtctcagtcaggacacagcatggacatgagggtccccgctcagctccgtggggctcctgctactctggctccggaggtcgccagatgtgacatccagtatcgaccctagtcctccatccctcctgtcctgcatcgtggagagacagacgtacacatacgtcttcgcgtaggactaagtcgaagacgtataaattaaacgtaatttaaagtttaaacgttggtaactaccgaaaacgtaaccggaaaaccggaacgggtaaaccgttacccccgtagtaccccgttaccgtacgtacttaacttcgtacgtaccgtacgtactaccgtaccgttaggtttacgaccgtacggttaagggtcccgggttaccgttacggtaacgtcgtacggagtacgtaggacggtacgtacgtaaggggtactacggtttaacttccgtacccgtcgtaacgtccgtacgacctacggtacgtcttaccgaaacgtacgttaaacgtaagttaccgttacgtaaaccttaacctttacgtacttaacgactaaacgttacgttaacgtacccgtaccccttaacccgttcggtaccggttaacgggacgggaacccggttaacggacggacgtaaaccgtacgtaaccggtagtaaccgggtactcggggtcccgtagtaacccgaaccttcccggttanacccgtttccgttacgtaccccg

SEQ ID NO: 256676 - DNA, 670 bp, Homo sapiens
  misc_feature: GYAE6OF01APPLP.14.55.E11.1.454.CMB.1.raw
  modified_base (229)..(229): a, c, t, g, unknown or other
  misc_feature (229)..(229): n is a, c, g, or t
  modified_base (257)..(257): a, c, t, g, unknown or other
  misc_feature (257)..(257): n is a, c, g, or t
  modified_base (274)..(274): a, c, t, g, unknown or other
  misc_feature (274)..(274): n is a, c, g, or t
  modified_base (326)..(326): a, c, t, g, unknown or other
  misc_feature (326)..(326): n is a, c, g, or t
  modified_base (602)..(602): a, c, t, g, unknown or other
  misc_feature (602)..(602): n is a, c, g, or t
  modified_base (650)..(650): a, c, t, g, unknown or other
  misc_feature (650)..(650): n is a, c, g, or t
  modified_base (662)..(662): a, c, t, g, unknown or other
  misc_feature (662)..(662): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatgggagtttgggctaggagcgttgggttttccgtcgttggccttacgttttaagaggtgtccagtgtcgaggtgcagctgggtggtagtccggtggggggngtcgtggtccagccgttggggcgtcccnggacctcctctcgtagngccgtaacgtcgtaggtattacggactcttacgtagtttagtagtggcgtancgctcggttcgggtcccgaccgcggtcctccggaacgggtacggaacgggggttccgaaggggttcgggtaggggttccggagtaggtttggtgtagggtagtagggacgtaaagttaacgaaagtaaactcggtcggaccgtacggtcggaaggaaccgtcgtacttaaccaccgtactaccgtaacagtaacaactaaacgtaacccaatacctattgtacgtaatctacaataatcgaactacgacgtagagtacgacggtagaccggaacgngttagtacgttgtacgtgtagttcaagggtagtggtacgggggtaagnggtaacgttcgngttaaggg

SEQ ID NO: 256677 - DNA, 793 bp, Homo sapiens
  misc_feature: GYAE6OF01DSBZQ.14.55.E11.1.454.CMB.1.raw
  modified_base (265)..(265): a, c, t, g, unknown or other
  misc_feature (265)..(265): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccagtggagtttgggctgagtcgttgggttttcctcgttgcttcgttttaagaggtgtccgagtgtcgaggtcgcagtcgtgggttggaggttcggtgggggaggtcggtggtccgaggccgtggggacgtccctgaccncctctccgtgtcgaccgtaacggttcgtggtaacttcgagtcttacgtagttagttagtggcagtcgccgtacggtccggtccgccgacggcctaccggacgggtacggaacggggtcgtagggtagggttcggggtacggtcgttagggttggttaggttaggttaagtaacgggaaacggttaaagttaaagtaaaggtaaacgtcgtccgggacccgtacggtaccggtagggaaaccgggtcccgtaacgttacccaaccttacgtacccgtaacccgaaggaacctaaacctaaaccttaacccaaacgtaacttagtttacggtttaacgttacgtttacgtaacgtaactaaagttaacggaacgttacggtaccgtaggaaccggtaacgggtaaccgacgggtaaccgtacgggttaccgttaggtttaccgttaacgtttacgttagggtaaccgttaggaagggtaggttaaggggtgggggttaaggggttggttaacggtacggttacggtaagg

SEQ ID NO: 256678 - DNA, 827 bp, Homo sapiens
  misc_feature: GYAE6OF01B3D5U.14.55.E11.1.454.CMB.1.raw
  modified_base (173)..(173): a, c, t, g, unknown or other
  misc_feature (173)..(173): n is a, c, g, or t
  modified_base (417)..(417): a, c, t, g, unknown or other
  misc_feature (417)..(417): n is a, c, g, or t
tcagcgtctagtaccacgaccggtgctcgatttagcactcgcacgttgggtttggggagctctgggagaggagcccagcactagaagtcgcggtgtttccattcgtgatcagcactgaacacagaggactcaccatggtagtttgggctgagcttgggttttcctgttgcttnttttaagaggtgtccagtgtcgaggtgcagcgtggtgagtcggtggggagtcgtggccaggccgtgggacggtccctggaccactctccgtgcgacaaccgttcgtaggtacttaccgagtcttcgaagttagttaagtggactagtacgcgtaacggttcgggtcccaccgacgggccttaccgaagggacggtaaacggggtcgtaggggaacggttggggtacgtacgtacggttttgggngtttaacgggtaagtcgggaaaacgggtaaagtaaagtaacggaaaagtttacgtacggaccggtaccgggtaccggttagggaacgggtaccctaaggtttaccaaccgtacttaacccgtaccgaacggtaaccgaaacgtaaaccttaaccgaaaaacccgaaacgttacgtttacgttacgtttaacgttaccgttaaggaacccttaaaagttacggaaaagttaccggtccgttaaagggaaccggacgggaacccgggtaaaggaccggttaaaccgggtctttaaacgggtttacggttaaacgtttacggttagggttacccgggttaaacgtaaacggggttacggaaagggggttaaccggggggttaaggggggtttaggttaaacccggtaaacggg

SEQ ID NO: 256679 - DNA, 985 bp, Homo sapiens
  misc_feature: GYAE6OF01AWCH9.14.55.E11.1.454.CMB.1.raw
  modified_base (204)..(204): a, c, t, g, unknown or other
  misc_feature (204)..(204): n is a, c, g, or t
  modified_base (261)..(261): a, c, t, g, unknown or other
  misc_feature (261)..(261): n is a, c, g, or t
  modified_base (271)..(271): a, c, t, g, unknown or other
  misc_feature (271)..(271): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagtcgttgggttttcctcgttgcttcttttaagaggtgtccagtgtcgaggtncagcgtggtggagtcggtgggggagtcgtggtccagtccgtgggacgtccctgaccnctcgtctgtnaccgacgtcgtaggtattcgagtccttagtagttagttacgtcggtacagttcggaccggtaccggttccggggtccccgaccggtaacggtcccgtaccgggaacggggaccgggtaaacggggtccggtaaggggttggggttcggggtacggtaccggttagggtttcggggttaaggttacggggttaacggtacgggtaaaacggggttaaaagtttaaaggtaaaccggtaaaaggtcggtaacccgggttaccccggaacgggttacccggggtaacggggaaaccgggttaccccggtttaaaccgttacccgtaaaccccgttacccggttaaccccgtaaacccgggtaaaggttaaacccggtaaaacccgtaaaccctttaaaccccgtaaaaacgttaaaccgtttacgggttttaacgtttaccggttaacgttaccgtaaaccggtaaaacgttaaaccgttaaggtaaaccgttaccgggtaacccggttaagggtaaaccggaccccgggggtaaacccgggtaaacggtaccccgggttaaccggtttacggttttacgggttaaacccggttttaggtttacccggttaacgggttaaacgggttacccggggtaaaggttaaaccggggggttaagggggtttacccggggggggttaaggggtttaaccccgggttagggtttaaacccgggg

SEQ ID NO: 256680 - DNA, 829 bp, Homo sapiens
  misc_feature: GYAE6OF01AEGS2.14.55.E11.1.454.CMB.1.raw
tcagcgtctagtaccacgaccggtgctcgatttagcactcgcacgttggggtttggggagtctcagtcaggacacagcatggacatgagggtccccgctcagctcctggggctcctgctactctggctcgaggtgccagatgtgacatccagatcgacccagtcctcctactccctccctgtctgctatcgtggtaggagacagagtccaaccatcctacttcggccgggacaagtcagagactaagttaaagtaactttaattttaaacgtggtaataccaaaacgaaacggaaaaccgaaggggaaccgccccctacggtacccctcctaggaacttctacgtcgtcgtacgacctaccgtccttaaggttttcgacctaacgggtaccggggttcccgggggttaccccggttaacggttaaacgggtttaccgtaggggttacgggtcggtaaggttacgggtaacgttccgggtaggggtaaccgtaaggtttacctttttaccccgaaccgtttcccttaacccggtaccgtaccgtacgggtaccttacggttcgtaccgtaacccgtaacgttacggtaacgttttactttacgtaaccttaacgttacctaacgtacgtaactaacgtacgttaacgtttaacccgtaacccccgttaccccttacggttacccgggttaccggggaaccgggtaaccgggaaccggaacgggtcggaactaaccgtaccgtaaacggtaacccggtaacggttcgggtacggtacccgccgtacccgttacccgtagtttccgttaccgtttcccgttccgttaccccg

SEQ ID NO: 256681 - DNA, 785 bp, Homo sapiens
  misc_feature: GYAE6OF01CM81M.14.55.E11.1.454.CMB.1.raw
  modified_base (656)..(656): a, c, t, g, unknown or other
  misc_feature (656)..(656): n is a, c, g, or t
tcagcgtctagtaccacgaccggtgctcgatttagcactcgcacgttgggctctgggagaggagcccagccactagaacgtcggcggtgtttccattcggtgatcagcactgaacacagaggactcaccagtggtagtttgggcgtgagtcttgggttttcctcgttgcttacgttttaaggaggttgtccaaggttgcgtaggtgcgtagtcgtggtggagttcggtggggggacgtcggtcggtcccaggtccggtagggtaccgtcccgtagaccgtaccttcgtaccgtggtccgacgtaacgttcgtggtaacttacgacgtcttacaggttataggtcgactaggtcgtcgtcggacgggttcccgccgacggtacctacggagggacgtaaccggggcggttagggtacgggttaggggtccgtcggtaaggtttcggaagttgggtaaacgtacgggtaacggttaaagttaaacgaacggttaaaggtcgtagggtacccgaacggttcccgggaaggtaacccgggtccgaaacgtttccaaccgtaccgttaccgtaacccgtaacggaactaacgtaaactttaacccgaaacgtaaacgttacgttaacttacgggtactttacgtaacgaaccgttaaagtnttaaacgtacgtccgttaaggaggtacccgacggtcggaaacgggtacgttcgtacgtacgttacgttcgttacgaggttcgaggtaacgttagggtaggggtcggggtatacggtagttaccggtagg

SEQ ID NO: 256682 - DNA, 807 bp, Homo sapiens
  misc_feature: GYAE6OF01AXT8Z.14.55.E11.1.454.CMB.1.raw
  modified_base (232)..(232): a, c, t, g, unknown or other
  misc_feature (232)..(232): n is a, c, g, or t
tcagcgtctagtaccacgaccggtgctcgatttagcactcgcacgttgggctctgggagaggagcccagcactagaagtcggcggtgtttccattcggtgatcagcactgaaacacagaggacctcacagtggtagtttgggctggacgtcgttcgggttttcctgttgcttacgtttaaggaggtcgtccagtgtcgaggtgcagtcgtggtggacgttcgggtagggggngcgttggaccgaggccggttagggacgtcccagctaccgttcacgtggtcgacgtaacgttgtacggatttacgacggttcttaacgacggtttagttagtaacgcgtacgttacggactaccgggtccgggggtacccctaaccgggtaacggttcccgaacccggggaacggtaaccgggttaaggggccgtaaggggtacggggttcggacggtaaggttggttaagggttggtaacggttaacgacggttaaaaggtaaaacgttaacggtaaaggttaaaccggtcgacccggtaaccccgggtaagtacccgggttaaggggaacccgtaccgtaacgtacccgtaaactacgttaaccgtacgtaaacggaacctaactaacctaaacctaaccgtaataggttactaacggtactaagtaacgtaaacgttaagtaacgagtaacgtaaggtacggtaacgtacgaaccgcgtacggaactacggttagttacgtaagtacgttgggtacgtagtaacgggtaggtaagggtacgggttacggtagggtaactaggtacggtaacgg

SEQ ID NO: 256683 - DNA, 854 bp, Homo sapiens
  misc_feature: GYAE6OF01AZ050.14.55.E11.1.454.CMB.1.raw
  modified_base (477)..(477): a, c, t, g, unknown or other
  misc_feature (477)..(477): n is a, c, g, or t
tcagcgtctagtaccacgaccggtgctcgatttagcactcgcacgttggggtttgggggagtctcagtcaggacacagcatggacatgagggtccccgctcagctccgtggggctcctgctactctggcctccggaggtgccagatgtagacatccagatcgacccgagtcctccgactccctccctagtctgcctagtcgtaggtaggacacgagacgtcaacctatcctacgttcggaccgggataacggtcgagtagtaactaagttaaaacgtaactttaagtttaaaggttggtaactaaaccgtaaacggaaaccggaaaccggtaaacggggaacccttcccccgtaactaccttaccgttagtacgttacttacggtcgtaactcgaccttacgttacccggttaggttaccgaacggtaccgggttacgggggttaccggttaccgttaacgggtaacggttaccggngggttaccgggacgtaggggttacgtacgtaccggggttaagggtaaccttacgttccgtttaacccgtaccgttaccggttaccaccggtacgtaacgtcgtacgtaccgtacggtacctaacgtagttaacgttaacgttacgtaaaccttacgttaactaaccgttactaacgtaaccgtaacgtttaacccgtacccgttaccccgttaccccgttaccggttaccgggtaccgggttaaccggaccgggaacgtaccgggaaccgtaacggtacgtaacccggaacggtaaccggttaccggaggttacccgtacggtaacccgtacggtaacccttcggtttaccgttcccggttacttacccggttaccc

SEQ ID NO: 256684 - DNA, 659 bp, Homo sapiens
  misc_feature: GYAE6OF01EAYHK.14.55.E11.1.454.CMB.1.raw
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
  modified_base (315)..(315): a, c, t, g, unknown or other
  misc_feature (315)..(315): n is a, c, g, or t
  modified_base (318)..(318): a, c, t, g, unknown or other
  misc_feature (318)..(318): n is a, c, g, or t
  modified_base (341)..(341): a, c, t, g, unknown or other
  misc_feature (341)..(341): n is a, c, g, or t
  modified_base (396)..(396): a, c, t, g, unknown or other
  misc_feature (396)..(396): n is a, c, g, or t
  modified_base (603)..(603): a, c, t, g, unknown or other
  misc_feature (603)..(603): n is a, c, g, or t
tcagcgtctagtaccacgaccggtgctcgatttagcactcgcacgttgggtttggggagctctgggagaggagcccagcactagagtcggcggtgtttccattcggtgatcagcactgaacacagaggactcaccatggagtttgggctgagtctgggttttccacgttgcttcttttaagaggtgtccagtgtcagggtgcagctggtggagtcgtgggggagcgttggtccagcccgtgggacgtccctgacnctcncctgcncaacgtctggattcagtcttcagtagttanggntatgcacgttggggccncgnggctacgaggacgagggctaggnggtgggtgcaggttggtgtgggtataggaacggtaagttaataacggtaaacgtntcggacccgtacggaccggtaggtaacgggccctaattccgactacgtacctacgaaggaacgtaacctaagttaacccgaaactaaactacgttacgggttactaaccttctaggtaaccgtaaataccggtaagttaacgcccgttaaggaggaaccgggaccggagggtaaccggtacgtcgtacggtttctaagtttaaccgngggttactcggtaaggaacgttagggtagggggtacgggggttagtaggtaaccgg

SEQ ID NO: 256685 - DNA, 933 bp, Homo sapiens
  misc_feature: GYAE6OF01DQADE.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagtcgttgggttttcctcgttgccttcgttttaagaggtgtccagtgtcgaggtgcgaggcgtgggtggtacggtcggtggggggacggtcggttcggtcccgaggtccggtggggacgttccccgtaggacctaccgttccgtccgtggtcgccgtacggtccgttcgtgggtactttaccgacggtcctttacgtaaggtttagtttagtcggtactagtcggtaaccgtcggttccggggtaccccgacccggacgggtacccgtaccggaagggaccgggtaaacgggggtccggttaggggtaggggttcgggggtaacggtaccggtttaagggtttcggttaggggttacggggttaaacggttaacggggaaaaccggggtttaaaaaggtttaaaacggtaaaagggtaaaaacgggttcggtacccggggtaaccccggggtaaaccgggttccggggttaaacggggaaaccgggggtttttacccaaccgtttacccgaacccgttaccgttaccccgtaacggaaacgtaaacgtaaccctaaaccgtttaacccgaaaactaaacgttacggtttacggttacgttaccttacggttaagaaaccgttaaagtacggtaaacgttaccgtaaccgttaggaaccggtaacgggacccggaaacggaccggtaacggtcgtttaacgggttagtttaacgttcggttaggtaccgtaaacggtacggtaagggttaggggtaacgggggtaggggttaacggtcgtagttaaccgggg

SEQ ID NO: 256686 - DNA, 556 bp, Homo sapiens
  misc_feature: GYAE6OF02G2V17.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggcccgggacaagtcagagctaattaagaacttaatttaaattggtatacaaacaagaaaccgagggaaacgcccctgacctcctgatctatgctgcatccagtttgcacaggtcggggtccctgaaggttcaggtgcaggtggatcgtgggacagtatttcactctacaccgtcagctagtctgacaactgaagtatttcgactaacttactacttgtacaacagtagttacaccgtaccccctctaccgtttcggacggtacgggaaccgaagggcggaagacgtacgaacggaaccgtaacgtggtacggtctgacctaaccattccgtcgttccttctaccg

SEQ ID NO: 256687 - DNA, 513 bp, Homo sapiens
  misc_feature: GYAE6OF02IIV4L.14.55.E11.1.454.CMB.1.raw
  modified_base (372)..(372): a, c, t, g, unknown or other
  misc_feature (372)..(372): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtcccctgacactctcctgtgcaacgtctggattcagcttcagtagttatggcatgcactggggtccgccagggctccgaggcaagggggctgggagtgggtggctaggttgtgtggtatggacggaagtaatagaaagtntgccgagccgtgaaggccgattcacatctcagagacaattccaacaacatgttgtatctgacaaatgaatagcctagagacgccgaggacacggctgtgtattactgtgtcagagagtgggtaggggtggtgagtcgaggg

SEQ ID NO: 256688 - DNA, 491 bp, Homo sapiens
  misc_feature: GYAE6OF02JH33Q.14.55.E11.1.454.CMB.1.raw
  modified_base (457)..(457): a, c, t, g, unknown or other
  misc_feature (457)..(457): n is a, c, g, or t
  modified_base (470)..(470): a, c, t, g, unknown or other
  misc_feature (470)..(470): n is a, c, g, or t
  modified_base (488)..(488): a, c, t, g, unknown or other
  misc_feature (488)..(488): n is a, c, g, or t
tcagcgtctagtaccacgaccggtgctcgatttagcactcgcacgttgggtttggggagtcgtcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaatggtatcaacagaaaccagggaaagcccctgacctcctgatctatgctgcatccagtttgcacagtggggtccctcaaggttcagtggcagtggatcgtgggacagatttcactctcaccgtcagcagtctgcacctgaagtatttgctaacttactactgtacaacagattacacgtacccctctacttcggcgaggaccaaagcgagtanacagacgaactgngactgcacatctgtcttntac

SEQ ID NO: 256689 - DNA, 511 bp, Homo sapiens
  misc_feature: GYAE6OF02FXKMM.14.55.E11.1.454.CMB.1.raw
  modified_base (298)..(298): a, c, t, g, unknown or other
  misc_feature (298)..(298): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactggggtccnccaggctccaggcaagggggctggagtgggtggcagttgtgtggtatgacggaagtaatagaaagtatgccgacgccgtgaagggccgattcaccatctccagagacaattccaacaacatgttgtatctgcaaatgaatagctgagagccgaggacacggctgtgtattactgtgtcagagagtgggagggggttggtggagtccgtaaggg

SEQ ID NO: 256690 - DNA, 370 bp, Homo sapiens
  misc_feature: GYAE6OF02HQFSM.14.55.E11.1.454.CMB.1.raw
  modified_base (361)..(370): a, c, t, g, unknown or other
  misc_feature (361)..(370): n is a, c, g, or t
tcagcgtctagtaccacgaccggtgctcgatttagcactcgcacgttgggtttgggtctcattggccttcaggttcaggggcacctctggcccgacttgcagcatgggctccctggaggacggtgccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaacccactgtcactctgttcccgcctcctcgtactagacgctgagcgggctggcaaggcgcatagnnnnnnnnnn

SEQ ID NO: 256691 - DNA, 499 bp, Homo sapiens
  misc_feature: GYAE6OF02FZ11Z.14.55.E11.1.454.CMB.1.raw
  modified_base (270)..(270): a, c, t, g, unknown or other
  misc_feature (270)..(270): n is a, c, g, or t
  modified_base (437)..(437): a, c, t, g, unknown or other
  misc_feature (437)..(437): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaancccctgacctcctgatctatgctgcatccagtttgcacagtggggtccctcaaggttcagtggcagtggatcgtgggacagatttcactctcaccgtcagcagtctgcaacctgaagtattttgactaacttactactgtacaacagagttacacgttacccccctntactttcggtggacggaccaaggcgagatcagacgaactgtgctgcaccatctgtcttctac

SEQ ID NO: 256692 - DNA, 538 bp, Homo sapiens
  misc_feature: GYAE6OF02IEKAL.14.55.E11.1.454.CMB.1.raw
  modified_base (369)..(369): a, c, t, g, unknown or other
  misc_feature (369)..(369): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtaatcaacagaaaccagggaaagcccctagacctcctgatctatgctgcatccagtttgcacagtggggtccgtcaaggttcagtggcagtggatctgggacagatttcactctcaccgtnagcagtctgcaacctgaagtattttgacctaaactttactacttgtacaacagtaagttaccacgttacccccctctaaccgtttccgggaccggaacgggaccaaggaccggagacgtacgacgaacgaactggtcggactgcaccattactgttaccttaattcccg

SEQ ID NO: 256693 - DNA, 370 bp, Homo sapiens
  misc_feature: GYAE6OF02GF1WO.14.55.E11.1.454.CMB.1.raw
  modified_base (302)..(302): a, c, t, g, unknown or other
  misc_feature (302)..(302): n is a, c, g, or t
  modified_base (361)..(370): a, c, t, g, unknown or other
  misc_feature (361)..(370): n is a, c, g, or t
tcagcgtctagtaccacgaccggtgctcgatttagcactcgcacgttgggtttgggtctcattggccttcaggttcaggggcacctctggcccgacttgcagcatgggctccctggaggacggtgccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccntgtcactctgttcccacctcctcgtactagacgctgagcgggctggcaaggcgcatagnnnnnnnnnn

SEQ ID NO: 256694 - DNA, 496 bp, Homo sapiens
  misc_feature: GYAE6OF02G349Y.14.55.E11.1.454.CMB.1.raw
  modified_base (321)..(321): a, c, t, g, unknown or other
  misc_feature (321)..(321): n is a, c, g, or t
  modified_base (493)..(493): a, c, t, g, unknown or other
  misc_feature (493)..(493): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtccctnaaggttcagtgcagtggatctgggacagatttcactctcaccgtcagcagtctgcaacctgaagtatttgactaacttactactgtacaacagagttacacgttaccccctactacgtttcggcggacgggacaaggcgagatcagacgaactgtggctgcacatctgtctntac

SEQ ID NO: 256695 - DNA, 503 bp, Homo sapiens
  misc_feature: GYAE6OF02IZH2A.14.55.E11.1.454.CMB.1.raw
  modified_base (270)..(270): a, c, t, g, unknown or other
  misc_feature (270)..(270): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaancccctgacctcctgatctatgctgcatccagtttgcacagtggggtcccgtcaaggttcagtggcagtgatctggacagattcactctcaccgtcagcagtctgcaacctgaagtatttgactaactttactactgtctaacagtagttacacgttaccccctctactttcggacggtacgggaccaaggcggagagtcaggacgaactgtggctgcacatctcgttctctac

SEQ ID NO: 256696 - DNA, 499 bp, Homo sapiens
  misc_feature: GYAE6OF02FHT8B.14.55.E11.1.454.CMB.1.raw
  modified_base (321)..(321): a, c, t, g, unknown or other
  misc_feature (321)..(321): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtccctnaaggttcagtggcagtggatcgtggacagatttcactctcaccgtcagcagtctgcaacctgaagtatttgctaacttactactgtcaacagagttacacgttaccccctctacctttcggcggacggaccgaaggcgagactcagacgaactggtgctgacaccatctgtcttctac

SEQ ID NO: 256697 - DNA, 488 bp, Homo sapiens
  misc_feature: GYAE6OF02H9PKY.14.55.E11.1.454.CMB.1.raw
  modified_base (429)..(429): a, c, t, g, unknown or other
  misc_feature (429)..(429): n is a, c, g, or t
  modified_base (485)..(485): a, c, t, g, unknown or other
  misc_feature (485)..(485): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactatcacgtcagcagtctgcaacctgaagattttgcaacttactactgtcaacagagttacagtaccccctnactttcggacgaggaccaaggcgagatcagcgaactgtagctgcacatctgtcttntac

SEQ ID NO: 256698 - DNA, 513 bp, Homo sapiens
  misc_feature: GYAE6OF02J01CP.14.55.E11.1.454.CMB.1.raw
  modified_base (188)..(188): a, c, t, g, unknown or other
  misc_feature (188)..(188): n is a, c, g, or t
  modified_base (193)..(193): a, c, t, g, unknown or other
  misc_feature (193)..(193): n is a, c, g, or t
  modified_base (317)..(317): a, c, t, g, unknown or other
  misc_feature (317)..(317): n is a, c, g, or t
  modified_base (347)..(347): a, c, t, g, unknown or other
  misc_feature (347)..(347): n is a, c, g, or t
  modified_base (361)..(361): a, c, t, g, unknown or other
  misc_feature (361)..(361): n is a, c, g, or t
  modified_base (422)..(422): a, c, t, g, unknown or other
  misc_feature (422)..(422): n is a, c, g, or t
tcagcgtctagtaccacgaccggtgctcgatttagcactcgcacgttgggtttgggagtctcagtcaggacacagcatggacatgaggtcccgctcagctcctggggctcctgctactctggctccgaggtgccagatgtgacatccagatgacccagtctccatcctcctgtctgcatctgtagganacagngtcaccatcacttgccgggcaagtcagagcattaagactatttaaattggtatcaacagaaaccaggaaagcccctgacctcctgatctatgctgcatccgagtttgctacagtggggtccctnaaggttcagtggcagtggatctgggacagntttcatctcacgtnagcatctgcaactgagatttgactaacttatacttgacacagtattaccgatcccccgtanaccgttttaccgcggtaggacccaaggcccgagatacgaggaccgtaaactgtacgggacttgaccgtacaacttcgcgttctctttaacc

SEQ ID NO: 256699 - DNA, 517 bp, Homo sapiens
  misc_feature: GYAE6OF02HOLRU.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccaggaaagcccctgacctcctgatctatgctgcatccagtttgcacagtggggtcccgtcaaggttcagtggcagtggatcgtgggacagatttcactctcaccgtcagcagtctgcaacctgaagtattttgactaacttactacttgtacaacagtagttactacgtaccccctactaccgtttcggacggacgggaccaagggcggagagtacacgacgaactgtggtcgtgactaccatctcgtcttctacg

SEQ ID NO: 256700 - DNA, 510 bp, Homo sapiens
  misc_feature: GYAE6OF02FL5PO.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattgtatcaacagaaaccagggaaagcccctgacctcctgatctatgctgcatccagtttgcacaggtcggggtcccgtcaaggttcagtggcagtggatcgtgggacagtatttcactctcaccgtcagcagtctgcaactgaagtatttgactaacttactactcgtacaacagtagttacacgtaccccctctactttcggcgacggaccaaggcgagatacgagaacgaactggtcggctgccacctacgtctcgtcttctac

SEQ ID NO: 256701 - DNA, 499 bp, Homo sapiens
  misc_feature: GYAE6OF02GKTWL.14.55.E11.1.454.CMB.1.raw
  modified_base (466)..(466): a, c, t, g, unknown or other
  misc_feature (466)..(466): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaaccagggaaagcccctgacctcctgatctatgctgcatccagtttgcacagtggggtcccgtcaaggttcagtggcagtggatctgggacagatttcactctcaccgtcagcagtctgcaacctgaagtattttgctaacttactactgtcaacagacgttacacgtaccccctctaccgtttcggcggaggaccaaggcggagancagacgaactgtggctgcacatctgttctctac

SEQ ID NO: 256702 - DNA, 585 bp, Homo sapiens
  misc_feature: GYAE6OF02JJUAQ.14.55.E11.1.454.CMB.1.raw
  modified_base (165)..(165): a, c, t, g, unknown or other
  misc_feature (165)..(165): n is a, c, g, or t
  modified_base (314)..(314): a, c, t, g, unknown or other
  misc_feature (314)..(314): n is a, c, g, or t
  modified_base (346)..(346): a, c, t, g, unknown or other
  misc_feature (346)..(346): n is a, c, g, or t
  modified_base (358)..(358): a, c, t, g, unknown or other
  misc_feature (358)..(358): n is a, c, g, or t
  modified_base (478)..(478): a, c, t, g, unknown or other
  misc_feature (478)..(478): n is a, c, g, or t
  modified_base (567)..(567): a, c, t, g, unknown or other
  misc_feature (567)..(567): n is a, c, g, or t
tcagcgtctagtaccacgaccggtgctcgatttagcactcgcacgttgggtttggggtaggctctgggagaggagcccagcactagaagtcggcggtgtttccattcggtgatcagcactgaacacagaggactcaccatggagtttgggctgagcgtggtttcncgtgctctttaagaggtgtccagtgtcaggtgcagctggtggagtctgggggagcgtggtccaggcctggggagtccctgacactctcctgtgcaacgtctggattcagcttcgagttagttatcggcagttgcaacgttggggccccncgaaggctccgagggtccaagggggtctgggnggtgggtggacnggtttgtcggttaggtactggaacggaaagttagtaaggaaagtctggcccgacgccgtaggaagggcctagttccaccgatccgtacgagacgacaacttccgaaacaactagtagttntaactcgttcgagtaaataggaattacgccgtagagacggaccgaaggtcccgaggtacgtggtcttaagttatgtagcgtaggagtgngggaggggttggcgtagg

SEQ ID NO: 256703 - DNA, 691 bp, Homo sapiens
  misc_feature: GYAE6OF02I7W17.14.55.E11.1.454.CMB.1.raw
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagctgggtttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcacgtgggtccgccgaggctccgaggcaagggggctggagtgggtggctaggttgtggtggtatggaacgggtaagttaagtagaaagtagtggacccgacggtcccggtaggaaacggggcccgtaagtttccaacccgtactaccgttacccgaaggaacgtaaaccgtaaactttaccccaaaactaaaccgaatttaggttagttaacttcgttacggactaaaagttgaaacgttacggacccgttagaaggaccggtacccggaagggaacccgaccggggccgtttagggtttacggttaaacggttttaaccgttgggttacgttaccggtaaggaacgggttaagggttacggggggtaagggggggtttagggttacgggtaaccgg

SEQ ID NO: 256704 - DNA, 506 bp, Homo sapiens
  misc_feature: GYAE6OF02F1L9R.14.55.E11.1.454.CMB.1.raw
  modified_base (296)..(296): a, c, t, g, unknown or other
  misc_feature (296)..(296): n is a, c, g, or t
  modified_base (336)..(336): a, c, t, g, unknown or other
  misc_feature (336)..(336): n is a, c, g, or t
  modified_base (364)..(364): a, c, t, g, unknown or other
  misc_feature (364)..(364): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgacactctcctgtgcaacgtctggattcagcttcagtagttatggcatgcactgggtccnccaggctccaggcaaggggctggagtgggtggcaggttgngtggtatggacggaagtaatagaaagtntgccgacgccgtagaagggccgattcacatctccagagacaattaccaacaacatgttgtatctgacaatgaatagcctgagacgcgaggacacgctgtagtattctgtgtcagagagtgggaggggtggtggtatcgtagg

SEQ ID NO: 256705 - DNA, 504 bp, Homo sapiens
  misc_feature: GYAE6OF02ILUPC.14.55.E11.1.454.CMB.1.raw
  modified_base (367)..(367): a, c, t, g, unknown or other
  misc_feature (367)..(367): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcacgtgggtcccgccaggcctccgaggcaaggggctgggagtgggtgcaggttgtgtggtatggacggaagtatagaagtntgccgacgccgtagacggccgatcacatctcagagacaatccaacaacatgttgtatctagacaatgaatagctagagagccgagacacgctgtagtattactgtgtcagagagtgggaggggtggtagatcgtagg

SEQ ID NO: 256706 - DNA, 528 bp, Homo sapiens
  misc_feature: GYAE6OF02I32NW.14.55.E11.1.454.CMB.1.raw
  modified_base (368)..(368): a, c, t, g, unknown or other
  misc_feature (368)..(368): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccagccgtgggaggtccctgacactctcctgtgcacgtctggattcagcttcagtagttatggcatgcactgggtccgccaggctccgaggcgaaggggctggagtgggtggcagttgtgtggtatggacggaagtaagtagaaagtntggccgaggccgtgaagggccgtatcaccatcctcagacgacaacttacccaacaacatgttagtatctagactaaagtgaatagcctagacgagccgaggaaccgacggctgtagtacttcgtgtcgtatagagagtggggagggtggtgagtcgtagg

SEQ ID NO: 256707 - DNA, 553 bp, Homo sapiens
  misc_feature: GYAE6OF02JTZP7.14.55.E11.1.454.CMB.1.raw
  modified_base (238)..(238): a, c, t, g, unknown or other
  misc_feature (238)..(238): n is a, c, g, or t
  modified_base (296)..(296): a, c, t, g, unknown or other
  misc_feature (296)..(296): n is a, c, g, or t
  modified_base (341)..(341): a, c, t, g, unknown or other
  misc_feature (341)..(341): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagccctgacnctctcctgtgcaacgtctggattcagcttcagtagttatggcatgcacgtgggtcccnccaggcctccgaggcgaaggggctgggaggtgggtgctaggttgngtggtatggaacggaagtaanaggaaagtntggccgacggccgtaggaacgggccgtattcaccagtcctaccgagacgaacaactaccaacaacagttgttagtactctagactaaatgaatacgaccgtagagacgaccgaaggacgtacggctagtgttaagttacgtgtgtacgagtagtaggtgggagggtggtagacgtacgtagg

SEQ ID NO: 256708 - DNA, 680 bp, Homo sapiens
  misc_feature: GYAE6OF02F07WM.14.55.E11.1.454.CMB.1.raw
  modified_base (251)..(251): a, c, t, g, unknown or other
  misc_feature (251)..(251): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagactattaaatgtatcaanagaaaccaggaaagcccctgacctctgatctatgctgaatccagttttcgacacgtaggttcgggggttaccccgtacgaaagggtttcaaggttgggccgaagggttgggaatttccgtaggggaacctaagtacgttttccaaccttccgtacctaacccgtcacggtactaacgttcctcggtacctaaacccgttagtaaacgttagttttacggaccttaaaccgtttaacctaacgttacgtacctaaacgtacgtaacgtttaaaccgtacccgttaacccccccttacgtaacccgttttccgggaccggtaacgggaacccgaaagggaccggaagactacgaacggtaaccgtaaacgtcgtacggtccgtacgaccgaaccctacgttaccgttcggttaccttacctacttaccccg

SEQ ID NO: 256709 - DNA, 506 bp, Homo sapiens
  misc_feature: GYAE6OF02GIURR.14.55.E11.1.454.CMB.1.raw
  modified_base (296)..(296): a, c, t, g, unknown or other
  misc_feature (296)..(296): n is a, c, g, or t
  modified_base (336)..(336): a, c, t, g, unknown or other
  misc_feature (336)..(336): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgacactctcctgtgcaacgtctggattcagcttcagtagttatggcatgcactgggtccnccaggctccaggcaaggggctggagtgggtggcaggttgngtggtatgacggaagtaatagaaagtatgccgacgccgtggaagggccgagttcaccatctccagagacaattccaacaacatgttgtatctgacaaatgaatacgcctgagagccgaggacacgctgtgtattactgtgtcagagagtgggaggggtggtgatcgtagg

SEQ ID NO: 256710 - DNA, 513 bp, Homo sapiens
  misc_feature: GYAE6OF02GE4U3.14.55.E11.1.454.CMB.1.raw
  modified_base (469)..(469): a, c, t, g, unknown or other
  misc_feature (469)..(469): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgacactctcctgtgcaacgtctggattcagcttcagtagttatggcatgcacgtgggtccgccaggcctccgaggcaagggggctgggagtgggtggcaggttgtgtggtatggacggaagtaatagaaagtatgccgacgccgtagaacgggccgatcacatctccagagacaattaccaacaacatgttgtatctagacaaatagaatagcctagagagccgaggacacgntgtgtattctgtgtcagagagtgggaggggtggtgagtcgtagg

SEQ ID NO: 256711 - DNA, 498 bp, Homo sapiens
  misc_feature: GYAE6OF02JCASF.14.55.E11.1.454.CMB.1.raw
  modified_base (296)..(296): a, c, t, g, unknown or other
  misc_feature (296)..(296): n is a, c, g, or t
  modified_base (334)..(334): a, c, t, g, unknown or other
  misc_feature (334)..(334): n is a, c, g, or t
  modified_base (360)..(360): a, c, t, g, unknown or other
  misc_feature (360)..(360): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgacactctcctgtgcaacgtctggattcagcttcagtagttatggcatgcactgggtccnccaggctccaggcaaggggctggagtgggtgcagttgngtggtatgacggaagtatagaaagtntgccgacgccgtgaggcgattcaccatctccagagacaattccaacaacatgttagtatctgcaaatgaatagctagagagccgaggacacggctgtgtattacgtgtgtcagagagtgggaggggtgtgatcgtagg

SEQ ID NO: 256712 - DNA, 504 bp, Homo sapiens
  misc_feature: GYAE6OF02F5KG1.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaatggtatcaacagaaaccaggaaagcccctgacctcctgatctatgctgcatccagtttgcacagtggggtcccgtcaaggttcagtggcagtggatcgtgggacagatttcactctcaccgtcagcagtctgcaacctgaagtatttgctaacttactactgtcaacagtagttacacgtacccccctctaccgtttcgggacggtacggaccgaaggcggagactcgagaacgaactgtggctgcacatctgtctctac

SEQ ID NO: 256713 - DNA, 507 bp, Homo sapiens
  misc_feature: GYAE6OF02IVTHZ.14.55.E11.1.454.CMB.1.raw
  modified_base (305)..(305): a, c, t, g, unknown or other
  misc_feature (305)..(305): n is a, c, g, or t
  modified_base (323)..(323): a, c, t, g, unknown or other
  misc_feature (323)..(323): n is a, c, g, or t
  modified_base (410)..(410): a, c, t, g, unknown or other
  misc_feature (410)..(410): n is a, c, g, or t
  modified_base (437)..(437): a, c, t, g, unknown or other
  misc_feature (437)..(437): n is a, c, g, or t
  modified_base (469)..(469): a, c, t, g, unknown or other
  misc_feature (469)..(469): n is a, c, g, or t
  modified_base (503)..(503): a, c, t, g, unknown or other
  misc_feature (503)..(503): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaatggtatcaacagaaaccagggaaacgcccctgacctcctgatctatgctgcatccagtttncacagtcggggtcccgtnaaggttcagtggcagtggatcgtgggacagtatttcactctcacgtcacgcagtctgcaactgaagtatttgactaacttactactntacaacagagttaccacgtaccccctntaccgttcggcggtaacggaccaaggcgagancgacgacacgtgtcgctgacactactcgtgtctntacg

SEQ ID NO: 256714 - DNA, 504 bp, Homo sapiens
  misc_feature: GYAE6OF02IML5Q.14.55.E11.1.454.CMB.1.raw
  modified_base (268)..(268): a, c, t, g, unknown or other
  misc_feature (268)..(268): n is a, c, g, or t
  modified_base (319)..(319): a, c, t, g, unknown or other
  misc_feature (319)..(319): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagactatttaaatggtatcaacagaaaccagggaaancccctgacctcctgatcatgctgcatccagtttgcacagtggggtcccgtnaaggttcagtggacagtggatcgtggacagtatttcactctcgaccgtcagcagtctgcaacctgaagtatttcgctaacttactactgtacactagacgttacacgtaccccctcacgtttcgacggacggaccgaaggcgtagatcgagacgaactggtacgctcgcaccatctgtcttctac

SEQ ID NO: 256715 - DNA, 502 bp, Homo sapiens
  misc_feature: GYAE6OF02IH7FY.14.55.E11.1.454.CMB.1.raw
  modified_base (368)..(368): a, c, t, g, unknown or other
  misc_feature (368)..(368): n is a, c, g, or t
  modified_base (491)..(491): a, c, t, g, unknown or other
  misc_feature (491)..(491): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgacactctcctgtgcaacgtctggattcagcttcagtagttatggcatgcacgtgggtccgccaggcctccgaggcaaggggctgggagtgggtgcagttgtgtggtatggacggaataagtagaaagtngcgagccgtagaggcgatcacatctcagagacaataccaacaacatgttgtatctagactaatgaatagcctagagagccgaggacacgctgtgtatctgtgtacagagagtgggagggtggngtactcgtagg

SEQ ID NO: 256716 - DNA, 509 bp, Homo sapiens
  misc_feature: GYAE6OF02GGME5.14.55.E11.1.454.CMB.1.raw
  modified_base (460)..(460): a, c, t, g, unknown or other
  misc_feature (460)..(460): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgacactctcctgtgcaacgtctggattcagcttcagtagttatggcatgcactgggtccgccaggctccgaggcaaggggctggagtgggtgcagttgtgtggtatgacggaagtaatagaaagtatgccgacgccgtagaagggccgattcacatctccagagacaattccaaacacatgttgtatctgacaaatgaatagcctgagagcgaggacacggntgtgtatacgtgtgtcagagagtgggaggggtggtggtagtccgtaagg

SEQ ID NO: 256717 - DNA, 492 bp, Homo sapiens
  misc_feature: GYAE6OF02GXUB4.14.55.E11.1.454.CMB.1.raw
  modified_base (322)..(322): a, c, t, g, unknown or other
  misc_feature (322)..(322): n is a, c, g, or t
  modified_base (434)..(434): a, c, t, g, unknown or other
  misc_feature (434)..(434): n is a, c, g, or t
  modified_base (473)..(473): a, c, t, g, unknown or other
  misc_feature (473)..(473): n is a, c, g, or t
  modified_base (489)..(489): a, c, t, g, unknown or other
  misc_feature (489)..(489): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtnaaggttcagtggcagtggatctgggacagatttcactctcaccgtcagcagtctgcaacctgaagtattttgactaacttactactgtcaacagagttacacgtaccccctnactttcggacgaggaccaaggcgagatcagacgaactgngctgcacatctgtctntac

SEQ ID NO: 256718 - DNA, 503 bp, Homo sapiens
  misc_feature: GYAE6OF02I5NKK.14.55.E11.1.454.CMB.1.raw
  modified_base (491)..(491): a, c, t, g, unknown or other
  misc_feature (491)..(491): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgacactctcctgtgcaacgtctggattcagcttcagtagttatggcatgcactgggtccgccaggctccgaggcaaggggctggagtgggtggcagttgtgtggtatgacggaagtaatagaaagtatgccgacgccgtgaacgggcgatcaccatctccagagacaatccaacaacatgttgtatctgcaaatgaatagcctagagagccgagacacggctgtgtatctgtgtacagagagtgggaggggtggngtagtcgtaagg

SEQ ID NO: 256719 - DNA, 567 bp, Homo sapiens
  misc_feature: GYAE6OF02GY72M.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcttggtacagccgtggggggtccctgagactctcctgtgcagcctctggattcgtctttagcagctatgccatgagctgggcctcgccaggcctccgaggggaggggctgggagtgggtctcgtgcttattccgtggctaggtggtgatatcgaatacgtacgcagacctccggtaggaacgggtccggttcacgttcgttaccgagacgtactaacttaccgaaagaaccactactacgtatcgtgcagatcgaccagccgtagacgacgaccgaggaccacggtacgtagtacttacgtggtacgaccgaaacgaccgtaaggttagttttaggagttaggttaatttacg

SEQ ID NO: 256720 - DNA, 594 bp, Homo sapiens
  misc_feature: GYAE6OF02HYA9K.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagactattaaattggtatcaacagaaaccaggaaagcccctgacctcctgatctatgctgcatccagtttgcacagtcggggtcccgtacaaggttcaggtgacgagtggatcgtagggacagtatttcactctcgtaccgtcacgtcagttctgactaaccgtgaagtattttcgacctaaacgtttactactacgtacaaactacgtaacgttaccaaccgttaccccccttacgtaaccgtttccgggacggacggggtaaccgtaacgggaccggtaagtacgtacgaacggaaccgtaacgtacggtacggtaccgtcggtaccaccgtaacttccgtcgttccgttacgttaacccg

SEQ ID NO: 256721 - DNA, 533 bp, Homo sapiens
  misc_feature: GYAE6OF02GKU34.14.55.E11.1.454.CMB.1.raw
  modified_base (311)..(311): a, c, t, g, unknown or other
  misc_feature (311)..(311): n is a, c, g, or t
  modified_base (381)..(381): a, c, t, g, unknown or other
  misc_feature (381)..(381): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggaggcgtggtccagccgtgggaggtccctgacactctcctgtgcaacgtctggattcagtcttcagttagttatggcatgcacgtgggtccncaggcctccgaggcgaaggggctgggagtggggtgcaggttgtgtggtatgacggaagtaatagaaagtntgccgacgccgtagaggcgatcacatcncaganacatccaanacatgtntatctagacaaatgaagtacgctagagacgaccgaaggaccacggtctgtagttacttacgtgtacgtacgaggagtaggtgggaggggtgtagtagtaccgg

SEQ ID NO: 256722 - DNA, 546 bp, Homo sapiens
  misc_feature: GYAE6OF02IJNNM.14.55.E11.1.454.CMB.1.raw
  modified_base (218)..(218): a, c, t, g, unknown or other
  misc_feature (218)..(218): n is a, c, g, or t
  modified_base (270)..(270): a, c, t, g, unknown or other
  misc_feature (270)..(270): n is a, c, g, or t
  modified_base (361)..(361): a, c, t, g, unknown or other
  misc_feature (361)..(361): n is a, c, g, or t
  modified_base (412)..(412): a, c, t, g, unknown or other
  misc_feature (412)..(412): n is a, c, g, or t
tcagcgtctagtaccacgaccggtgctcgatttagcactcgcacgttgggtttgggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattaagaactatttaaatggtatcaacagaaaccagggaaancccctgacctcctgatctatgctgcatccagtttcgcacgaggtcggggtcccgtacgtaaggttcaaggtcgggactaggtggaattcgngggtacagtatttcactctcaccgtcagctagtctgactaaacctgaagtnttttacgactaaactttactacgtcgtacaacacgtagttaaccacgttaccccctctaccgtttccgggacgacgggacaacgggcgagatacgagtaacgtactgtacggctgcaccgtatcgtgtctctac

SEQ ID NO: 256723 - DNA, 612 bp, Homo sapiens
  misc_feature: GYAE6OF02FUOLD.14.55.E11.1.454.CMB.1.raw
  modified_base (298)..(298): a, c, t, g, unknown or other
  misc_feature (298)..(298): n is a, c, g, or t
  modified_base (372)..(372): a, c, t, g, unknown or other
  misc_feature (372)..(372): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggacggtccctgacactctcctgtgcaacgtctggattcagcttcagtagttatggcatgcacgtgggtccncaggcctccgaggcaagggggctgggaggtgggtgctaggttgtgtggtatggaacggaagtaataggaaagtntcgaccgacggccggtaggaacgggtccgattccacctaatcctaccgagacgaacctaacttacccaaacaactagttagtttgttaatccgtagtacctaaagtagaaacttacgtaccgtagagaccggaccggaaggaccgacggtccttaggttagttacgtttacgtaggttacggtacgtaaggtaggtagggttagggggtacgggggttggtaggtacgtaccggtaaggg

SEQ ID NO: 256724 - DNA, 535 bp, Homo sapiens
  misc_feature: GYAE6OF02JHK8B.14.55.E11.1.454.CMB.1.raw
  modified_base (164)..(164): a, c, t, g, unknown or other
  misc_feature (164)..(164): n is a, c, g, or t
  modified_base (180)..(180): a, c, t, g, unknown or other
  misc_feature (180)..(180): n is a, c, g, or t
  modified_base (305)..(305): a, c, t, g, unknown or other
  misc_feature (305)..(305): n is a, c, g, or t
  modified_base (374)..(374): a, c, t, g, unknown or other
  misc_feature (374)..(374): n is a, c, g, or t
  modified_base (481)..(481): a, c, t, g, unknown or other
  misc_feature (481)..(481): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagctgggttttccncgttgctcttttaagnggtgtccagtgtcaggtgcagctggtggagtcgtgggggagcgtggtccagcctgggaggtccctgacactctcctgtgcaacgtctggattcagcttcagtagttatggcatgcactgggtccncaggctccgaggcaaggggctggagtggggtggcagttgtgtggtatggacggtaagtaatagaaagtntggaccgacggccgtaggaacgggccgattcacatcctacagacgacaactccaacaacatggttagatctgacaaatgaatagcctgagacgaccggagacacggntggtagttattacgtggtcgtacgaggacgtagtgggaggggtgtaggatacgg

SEQ ID NO: 256725 - DNA, 707 bp, Homo sapiens
  misc_feature: GYAE6OF02JI61X.14.55.E11.1.454.CMB.1.raw
  modified_base (284)..(284): a, c, t, g, unknown or other
  misc_feature (284)..(284): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggaggtccctgactactctcctgtgcaacgtctggacttcagcttcagtagttanggcatgcacgtgggtccacaggcctccgaggcgaaggggctgggaggtggggtaggctaggttgtggtggtatggaacgggtaaagtaagtaaggaaaagttgtacgaccccggaaggtcccggtagggaaacggggtcccggtaacgttaccgaaccgtacgttccgtaccgaaggaacgtaaacaaccgttaacccaaaccgtaaactaacgttagttacgttaactacgttagaacgtaaagtacgaaagttaacgtaccgttaggaacggtaacggtaccggaaacgggaaccggtaaccgggtaccgttagggttaaccggttaagtttaacggttaggttacggttacgtaagggtaacggtaggggttacgggggtaacgggggggttaggtacgggttacgtacccgggtaaggg

SEQ ID NO: 256726 - DNA, 514 bp, Homo sapiens
  misc_feature: GYAE6OF02G8PMJ.14.55.E11.1.454.CMB.1.raw
  modified_base (297)..(297): a, c, t, g, unknown or other
  misc_feature (297)..(297): n is a, c, g, or t
  modified_base (370)..(370): a, c, t, g, unknown or other
  misc_feature (370)..(370): n is a, c, g, or t
  modified_base (410)..(410): a, c, t, g, unknown or other
  misc_feature (410)..(410): n is a, c, g, or t
  modified_base (429)..(429): a, c, t, g, unknown or other
  misc_feature (429)..(429): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgacactctcctgtgcaacgtctggattcagcttcagtagttatggcatgcacgtgggtcccnccaggcctccgaggcaaggggctgggagtgggtggcaggttgtgtggtatggaacggaagtaataggaaagtntggccgacgccgtagaagggccgattcaccatctccaganacaatccaacaacatgttntatctagacaaatgaatagcctagacgagccgagacacgctgtgtattcgtgtagtcagagagtgggaggggtggtgagtcgagg

SEQ ID NO: 256727 - DNA, 528 bp, Homo sapiens
  misc_feature: GYAE6OF02GC7D7.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgacactctcctgtgcaacgtctggattcagcttcagtagttatggcatgcactgggtccgccaggctccgaggcgaaggggctggagtgggtggctaggttgtgtggtatgacggaagtaagtaagaaagtatcgaccgacggccgtagaacgggccgattcaccatctacagagacaacttaccaacaacatgttgtatactgacaaatgaatagcctgagagaccgagacgacgctgtagtagttacgtgtgtacagagacgtgggaggggttggtaggtacgtcgtagg

SEQ ID NO: 256728 - DNA, 554 bp, Homo sapiens
  misc_feature: GYAE6OF02HKF6Z.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgctacagtcggggtccctacgaaggttcaggtggcagtggatcgtgggacagtatttcactctcaccgtcagcagtctgacaactgaagtatttgctaaacttactacttgtacaacagtaacgttacaaccgtaccccctacgtaccgtttcggaccgggaacgggtaccgaagggaccgggtaagacgtacgaacggaacggtaacctggtcggtacgtgaccacctagttccgtacgtcttctaccg

SEQ ID NO: 256729 - DNA, 965 bp, Homo sapiens
  misc_feature: GYAE6OF02JK7L5.14.55.E11.1.454.CMB.1.raw
  modified_base (857)..(857): a, c, t, g, unknown or other
  misc_feature (857)..(857): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagttggcgtgagcgttgggtttccgttcgttgtcttcttttaagtaggtgtccagtgtcgaggtgcgagcgtggtggtagtcggtggggagggcggtcggtccgacggccgtacgggtacggtccgtcgacgactctcctcgtacgtacacgtacgtcggtacgttacgtacgtacctggttaccgttaacgttaaggttaacggttacggtacggtacgtacgtacggtaccggtaccgggttaccgggtacccggtaccggtaccggtacccggtaaccgggaacgggtaacggggtaacggggtacggggttacggggtacggggttacggggtacgggtacggttacggggtttacgggttacggggttaacgggttaaacgggttaaacggggttaaaacgggttaaaaacgggttaaaaacgggttaaaacgggttaaaacgggttaaaccgggttaacccgggtaaaccccggggttaaacccgggggttaaacccgggggttaaaacccgggggttaaaacccggggttaaaccccgggtttaaacccggtttaaaccccggttaaaccccggttaaacccggtttaaaccccggttaaacccgggtaaaaccgggttaaaacccggttaaaaacccgttaaaaaccccgttaaaaccccgttaaaaacccgttaaaaccgtttaaacggtttaaacggtttaaccggttaaccgttnacaagtacgtaacgtaacgtaacgtacgtacgtacgacgacgacgacgacgacgtacggtacgttacgttacgttacgttacgtacgtaggtacgtaggtaggtaggg

SEQ ID NO: 256730 - DNA, 545 bp, Homo sapiens
  misc_feature: GYAE6OF02HVXBC.14.55.E11.1.454.CMB.1.raw
  modified_base (503)..(503): a, c, t, g, unknown or other
  misc_feature (503)..(503): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtccaccatcacttgccgggcaagtcagagcattaagaactatttaaatggtatcaacagaaccagggaaagcccctgacctcctgatctatgctgcatcctagtttgcacgaggtcggggtcccgtacgtaaaggtttcaggttggctaggtggatcgtagggactagtactttcactctccaccgtcagctagtctcgacaaccgtgtaacgtacttttagactaactttactactagtacaaactagtacgttaccaccgtaccccctctaccgtttcggacggaacggaccgaaggcgaganacgagaccgagtgtcggctgaccacactcgtctcttactacc

SEQ ID NO: 256731 - DNA, 549 bp, Homo sapiens
  misc_feature: GYAE6OF02GYHTR.14.55.E11.1.454.CMB.1.raw
  modified_base (273)..(273): a, c, t, g, unknown or other
  misc_feature (273)..(273): n is a, c, g, or t
  modified_base (327)..(327): a, c, t, g, unknown or other
  misc_feature (327)..(327): n is a, c, g, or t
  modified_base (373)..(373): a, c, t, g, unknown or other
  misc_feature (373)..(373): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcaattaagaacttatttaaattggtatcaaacagaaaccagggaaacncccctgacctcctgatctatgctgcatccagtttgcacgaggtcggggtccctnaaggttcaggtgcagtggatcgtagggacagtatttcgactctacnccgtcagcagtctgcaacgtagagtatttcgactaacttactactcgtacaactacgtacgttactaccgtacccctacgtaccgtttacggcggtaacggaccgtaagggtacgagagtacgaacggtacgtaacgtggtacgtcgtgaccacgtattcgtacgttctctacccg

SEQ ID NO: 256732 - DNA, 673 bp, Homo sapiens
  misc_feature: GYAE6OF02JLNLW.14.55.E11.1.454.CMB.1.raw
  modified_base (306)..(306): a, c, t, g, unknown or other
  misc_feature (306)..(306): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgacactctcctgtgccaacgtctggattcagtcttcagttagttatggcagtcgcacgtcgggtcccncgaggcctaccgaggccgaaggggtctgggaggtggggtggactaggttgtggtggtagtggaacggtaaagtaataaggaaagtatcggaccgacggccggtaggaacgggtccgtaagttccgaacctactaccgtaccgaaggtaacgtaacctaaacttacccaaactaactagttaggttacgtacttcgtagaactaaagtgtaaacgtacgtaccgttaggaacggtaccggacccggtaaggaaccgtaccgggtcgttaggttacggtttaacgttaacggtaggttacgtaccgaaggtaacgggtagggttaggggggtaacgggggtttggtaacggtacggttaccggtaaggg

SEQ ID NO: 256733 - DNA, 550 bp, Homo sapiens
  misc_feature: GYAE6OF02HCPZC.14.55.E11.1.454.CMB.1.raw
  modified_base (192)..(192): a, c, t, g, unknown or other
  misc_feature (192)..(192): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccggcaagtcagagcaattaagaactatttaaattggtatcaacagaaaccagggaaagcccctagacctcctgatctatgctgcatccagtttgcacaggtcggggtcccgtcgaaaggtttcaaggttggacaggtggatcgtagggacagtatttcacttctacaccgtcagcagtctgccaaccgtgaagtattttgactaactttactacttgtacaacagtaacttactaccgtaccccctataccgtttacgggcggaacggaccgaagggcggagacgtacgacgaacgtaacgtggtacggtctgacctaccattctcgttactctaccg

SEQ ID NO: 256734 - DNA, 567 bp, Homo sapiens
  misc_feature: GYAE6OF02F5WZD.14.55.E11.1.454.CMB.1.raw
  modified_base (326)..(326): a, c, t, g, unknown or other
  misc_feature (326)..(326): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaacgcccctgacctcctgatctatgctgcatccagtttgcacgaggtcggggtccctanaaggttcagtggcagtggatcgtgggactagtacttcactctcaccgtcagcagtctagacaaccgtagtaagtattttgactaacttacttactgtacaacagtacgttaaccaccgtaccccctcgtaccgttcgggacggaacgggaccgaacgggaccggaagtacgtacgaacggtaaccgtaacgtcgggtacggctacggaccaccgtagttacctcggttaccttccgtaccg

SEQ ID NO: 256735 - DNA, 757 bp, Homo sapiens
  misc_feature: GYAE6OF02IH9P1.14.55.E11.1.454.CMB.1.raw
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagctgggtttttcctcgttgctctttttaagaggtgtccagtgtcaggtgcagctggtggagtcgtggggggagcgtggtccaggccgtgggacgtccctgaccactctcgtgtgacaacgtctggacttcgagtcttcaagttagttatggctagtcgctacgttcggggtccccgacggagggtcctaccggagggtacgaagggggtcctagggacggtggggtagtcgaaggtttggtagtacggtagtaggaacggtaaagttaacgtaaaggaaacgttagtcgggacccggtacggtaccggttaggaacgggcccgtaacgttaccgaccgtaactccgtaccgaaggaacgtaaacctaaccgttaacccaaacctaaacgttacgttacggtttaacgttaaacgtacctaacggtaacctaaaaggttacgtaaacgtaccggtaccggtacggaacggaaccgggtaccggaacgggtaaccgtaccgggacgtttacgggtacgttaacgtttaccgtggggtttaccgtaagtaacgggtagggtaacgggttacgggggtacggggggttacgtacggtaccgttaaccggg

SEQ ID NO: 256736 - DNA, 780 bp, Homo sapiens
  misc_feature: GYAE6OF02IKLIL.14.55.E11.1.454.CMB.1.raw
  modified_base (271)..(271): a, c, t, g, unknown or other
  misc_feature (271)..(271): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggatcgtgggggagcgtggtccagcctgggacggtccctgaccactctcctgtgactacgtcgngtctagcgttcctagtagttagttgcgtactgtcgacctcgggttccggcccgacgtacggtcctaacgggcggaaacggggtcgggtacggtagggtcggggtgggtaccgaggtttacggtttgggtcgggttaacggttacggtaagggtaaacgggttaaagttaaggtaaaaggtaacgttcggttacccgggaaccgggaccggtttacgggaaacggggtaccggggtaaccctttacgtaccgaaacgttccgtacccgtaacggaaggttaaaccgaaacctttacccgtaaaacgtaaaccgtaactttacgggtttacgttacttaaccgtttgaaccggtaaacttaacggtaaagtacggtacccgtggtaacggacgtaaccggacggaacgtaaccggcggttacgtttaggtacggtttaaaccttggtcggtacgttaagggaaccggttagggttacgggtaaggggggttcgtacgggtattaacccggg

SEQ ID NO: 256737 - DNA, 729 bp, Homo sapiens
  misc_feature: GYAE6OF02HKNUI.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacggtccctgacactctccgtgtgcaacgtctggattcagcttcagtagttatggcatgcacgtgggtcccgcgaggcctccgaggcgaaggggctgggaggtggggtggcgtagttggtggtggtatggaacggaaagtaagtaagaaagttatcggacccgacggcccggttagggaacgggtcccgtacgttacccgaacctacttccgtacccgaacgaacgtaaacctaaacgttaacccaaaaccgtaaacctaagtttacggtttacgttaacttaccgtagtaacctaaaagttacggtaaacgttacgtacccgttaaggaacgggtaaccgggaacccgggtaacgggaacccgaaccggggttaccgttacgggttacggttttaacgtttaaccggttaggtttacggtaccgtaaagggtaacgggttaaggttacgggggggtaggggggtttagggttacgggtacggttacccggttaagggg

SEQ ID NO: 256738 - DNA, 504 bp, Homo sapiens
  misc_feature: GYAE6OF02GJRVX.14.55.E11.1.454.CMB.1.raw
  modified_base (440)..(440): a, c, t, g, unknown or other
  misc_feature (440)..(440): n is a, c, g, or t
  modified_base (469)..(469): a, c, t, g, unknown or other
  misc_feature (469)..(469): n is a, c, g, or t
  modified_base (493)..(493): a, c, t, g, unknown or other
  misc_feature (493)..(493): n is a, c, g, or t
  modified_base (497)..(497): a, c, t, g, unknown or other
  misc_feature (497)..(497): n is a, c, g, or t
  modified_base (501)..(501): a, c, t, g, unknown or other
  misc_feature (501)..(501): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccggcaagtcagagcattaagaactatttaaatggtatcaacagaaacaggaacgcccctgacctcctgatctatgctgcatcagtttgcacaggtcggggtccctcgaagttcagtggcagtggattcgtggactagtactttcgactctacgaccgtcagcagtctgcaactagaatagtttgacttaacttactactgtacaacagagttactaccgtaccccctntacgttcggacggtacggaccgaggcganactgagtacgaactgtgctgcacntctntctntac

SEQ ID NO: 256739 - DNA, 583 bp, Homo sapiens
  misc_feature: GYAE6OF02IC5MH.14.55.E11.1.454.CMB.1.raw
  modified_base (148)..(148): a, c, t, g, unknown or other
  misc_feature (148)..(148): n is a, c, g, or t
  modified_base (172)..(172): a, c, t, g, unknown or other
  misc_feature (172)..(172): n is a, c, g, or t
  modified_base (288)..(288): a, c, t, g, unknown or other
  misc_feature (288)..(288): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcggngtttcgctaggctcttagtaggtntcagtgtcaggtgcagcgtggtggagtcgtgggggagcgttggtccagccgtggggacggtccctaggacgctctcctgtgcaacgtctggattcagcttcagtattagtggcgtntgcgcgtcggtccgcgacgcgcgacgacggacggtcggtggtggtggtggtgtaggtggtgtagtagtaggtaggtaagtaagtaagtaagtagtacgacgacggacgtacggtacggtacgtacgtactactacgtcgtacgagacgacgtacgtaactaacaactaagttcgttagtacgtcgtatagtaacgtaagtacgacgacgagagacgacgacgacgtacgtacgtgtagtacgtcgtagtcgtgtagtagtaggtacgggtagggtaggtacgtacggtagtacgg

SEQ ID NO: 256740 - DNA, 741 bp, Homo sapiens
  misc_feature: GYAE6OF02G4E4U.14.55.E11.1.454.CMB.1.raw
  modified_base (163)..(163): a, c, t, g, unknown or other
  misc_feature (163)..(163): n is a, c, g, or t
  modified_base (177)..(177): a, c, t, g, unknown or other
  misc_feature (177)..(177): n is a, c, g, or t
  modified_base (195)..(195): a, c, t, g, unknown or other
  misc_feature (195)..(195): n is a, c, g, or t
  modified_base (288)..(288): a, c, t, g, unknown or other
  misc_feature (288)..(288): n is a, c, g, or t
tcagcgtctagtaccacgaccggtgctcgatttagcactcgcacgttgggtttgggggcgtctgggagaggagcccagcactagaagtcggcggtgtttccattcggtgatcagcactgaacacagaggactcacatggagtttgggctgagctgggtttccngttgctctttaagnggtgtccagtgtcaggtncagctggtggagtcgtgggggagcgtggtccagcctgggacgtccctgacactctcctgtgcaacgtctggattcagtcttacagtagttagnggcattcgcacgtcgggtcccaccgagggtcctccgagggacgaagggggcctagggaggttggggcgctaggttgtggtaggtagtcggtaacggtaagtaagtaggaaagttgtcggacccgtacggtcccgtaggaacgggtaccgtacttaccgaaccctagtccgtaccgtaaggtacgtaaccgtaaaccgtttacccgaaaccgttaaccgtacgtttacggtttacgttaacgttaccgttacgtaacgtaaaagttacgtaaacgtaccggtacccgtaggaaacgggtaaccggtaccggtaaacgggtaccgtaaccggggtaccgtttaggtttaacggttaaccggtttaaccggttcgggttaccgttaccggtaagggtacggttacgggttagggggttacggggggtttacggttacggtaccggtttaacccggg

SEQ ID NO: 256741 - DNA, 546 bp, Homo sapiens
  misc_feature: GYAE6OF02FZ1KY.14.55.E11.1.454.CMB.1.raw
  modified_base (255)..(255): a, c, t, g, unknown or other
  misc_feature (255)..(255): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaanagaaaccagggaaagcccctgacctcctgatctatgctgcatcctagtttgcagaggtcggggtcccgtcaaggtttcaaggtggcaggtggatcgtgggactagtattttcacttctcaccgtcagcagtctgacaacctgaaagtattttagacttaacttactactgtacaaactagtacgttaacaccgtaccccctcgtaccgttcgggacggaacgggaaccgtaagggacggagactacgaggaacgaacgtggtcgtctagccactacttctcgttctctacg

SEQ ID NO: 256742 - DNA, 583 bp, Homo sapiens
  misc_feature: GYAE6OF02GWFMD.14.55.E11.1.454.CMB.1.raw
  modified_base (344)..(344): a, c, t, g, unknown or other
  misc_feature (344)..(344): n is a, c, g, or t
  modified_base (387)..(387): a, c, t, g, unknown or other
  misc_feature (387)..(387): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgacactctcctgtgcaacgtctggattcagcttcagtagttatggcatgcacgtgggtccgccgaggcctccgaggcgaagggggctgggaggtgggnggctaggttgtggtggtatggaacggaagtaagtaagaaagtntcggaccgacggccgtaggaacgggccgtattcactatcctcaagacgaacaacttaccaaacaactattcgttagtatctagactaaagtagtaatacgcctaggaacgacggaccgaaggacgacggtcgtcggttagttaagtttacgtggttcgtacgagtaggtaggtggggtagggggttggtaggtacg

SEQ ID NO: 256743 - DNA, 562 bp, Homo sapiens
  misc_feature: GYAE6OF02FYG3P.14.55.E11.1.454.CMB.1.raw
  modified_base (165)..(165): a, c, t, g, unknown or other
  misc_feature (165)..(165): n is a, c, g, or t
  modified_base (259)..(259): a, c, t, g, unknown or other
  misc_feature (259)..(259): n is a, c, g, or t
  modified_base (309)..(309): a, c, t, g, unknown or other
  misc_feature (309)..(309): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagctgggttttccncgttgctcttttaagaggtgtccagtgtcaggtgcagctggtggagtctgggggagcgtggtccagcctgggaggtccctgacactctcctgtncaacgtctggattcagtcttcagtagttatggcatgcacgtggggtcccnccaggctccgaggccaaggggctgggagtgggtggctaggttgtgtggtatggacggaagtaanagaaagtntgaccgacgccgtaggaacgggccgattccaccatcctaccgagaacgaacaacttccaaacaacatgttagtactctgacaaagtgaatagcctagaacgacgccgagaccgacggcgtggttagtaacgttacgtggttacgtacgaggtagtaggtgggtacgggggtgtaggtaacg

SEQ ID NO: 256744 - DNA, 556 bp, Homo sapiens
  misc_feature: GYAE6OF02FPZPO.14.55.E11.1.454.CMB.1.raw
  modified_base (344)..(344): a, c, t, g, unknown or other
  misc_feature (344)..(344): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcacaatcacttgccgggcaagtcagagcattaagaactattaaattggtatcaacagaaaccagggaaagcccctgacctcctgatctatgctgcatccagtttgcacaggtcggggtccctgaaggttcagtgcagtggatcgngggacagtatttcactctcaccgtcagcagtctgactacctagtaagtatttgactaacttactacttgtacaactagtaacgttacaccgtaccccctactaccgtttccggacggtaacgggaaccgaacgggacggaacgtacgtaccgaaggaaccgtaacgtcggtacggacgtcgacctaccgtactcgttcgttcctacgtaccg

SEQ ID NO: 256745 - DNA, 516 bp, Homo sapiens
  misc_feature: GYAE6OF02G6WG1.14.55.E11.1.454.CMB.1.raw
  modified_base (502)..(502): a, c, t, g, unknown or other
  misc_feature (502)..(502): n is a, c, g, or t
  modified_base (513)..(513): a, c, t, g, unknown or other
  misc_feature (513)..(513): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccgggcaagtcagagcattaagaactatttaaattggtatcaacagaaaccagggaaagccccctgacctcctgatctatgctgcatccagtttgcacaggtcggggtcccgtcaaggttcaggtggcaggtggatcgtgggacagatttcacttctctaccgtcagcagtctgacctaactgaagtatttcgactaacttactactgtcaactagacgttacaccgtaccccctctacgtttcggcggacggaccgaaggcgagactacgagacgactgtggctgcacncgtctgttctntac

SEQ ID NO: 256746 - DNA, 522 bp, Homo sapiens
  misc_feature: GYAE6OF02FGJFQ.14.55.E11.1.454.CMB.1.raw
  modified_base (369)..(369): a, c, t, g, unknown or other
  misc_feature (369)..(369): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaacttatttaaatggtatcaacagaaaccagggaaacgcccctgacctcctgactctatgctgcatccagtttcgcacgaggtcggggtccctacgaaggttcagtggcaggtgatcgtggacagtacttcactcncaccgtcacgcagtctcgacaacctgtaagtatttgacctaacttactactagtacaacagtacttaccacgtacccctctacgtttcggacggacggacgaggacggagatacagaacgtactgtggctgaccacactctcgtcttcgtacc

SEQ ID NO: 256747 - DNA, 685 bp, Homo sapiens
  misc_feature: GYAE6OF02H7XLU.14.55.E11.1.454.CMB.1.raw
  modified_base (312)..(312): a, c, t, g, unknown or other
  misc_feature (312)..(312): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtggggggagcgtggtccagcctggggacggtccctgacactctcctgtgcaacgtctggattcagcttcagtagttatggcatgcacgttgggtccnccgaggcctccgagggcgaagggggctgggaggtggggtggcgaggtttgtggttggtatgggaacggaaagttaaataggaaaagtgtcggacccggacggcccggttagggaacggggcccgtaagtttacccaacctaacgtccttaccgaaggaacggtaacctaaaacgtttaacccaaaaccgtaaactaacgttacggttttagtaacgttaccgttacgaacctaaaaacgttgtaaaacttacggtacccgttagggaacggacggacccggaagggaaccacgggtcttaggtagttaacgtttacgtggttacgtacgaaggtacggtaaggttgggggaacgggggtttgggaggtaacgg

SEQ ID NO: 256748 - DNA, 535 bp, Homo sapiens
  misc_feature: GYAE6OF02F3G57.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtcggggtcccgtcaaggttcagtggcagtggatcgtgggacagatttcactctcaccgtcagcagtctgcaacctgaatatttgactaacttattactgttactacaagtattaactaatttaccctacgtaacgttcggaccgaaacgggaccaagggtagaagtacaaacgtaacgtggtacggctagaccacctattctagttccttctacttccttccccg

SEQ ID NO: 256749 - DNA, 634 bp, Homo sapiens
  misc_feature: GYAE6OF02FVB86.14.55.E11.1.454.CMB.1.raw
  modified_base (238)..(238): a, c, t, g, unknown or other
  misc_feature (238)..(238): n is a, c, g, or t
  modified_base (575)..(575): a, c, t, g, unknown or other
  misc_feature (575)..(575): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcgttttaagaggtgtccagtgtcaggtgcagctggtggagtcgtgggggagcgtggtccagcctgggacgtcccngacactctctgtgccaacgtctggattcagtcttcgagttagttatggctagtgctacgtcgggtccgccgaggtcctcgaggaccgaaggggctgggaggtgggtggctaggttggtgtaggtataggaacggtaagtaagtaagaaagtgtacgccggaacgcggtaggaacgggcgtacttacacctatcctacgaagacgtaactaaccttacccaaactaacgtagtacgtttagtactcgtagaaccgtaaagtaacggtaactaggtaccgtagggaacgtaccgaaccggaacggaaccgaccggtcgttaggtacgttacgtttacgngttacggtacgaaggtaggtaggtacgggggtaggggtcgtacggtactacggttaagg

SEQ ID NO: 256750 - DNA, 558 bp, Homo sapiens
  misc_feature: GYAE6OF02F4KK3.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctcgtaggagacagagtcaccatcacttgccgggcaagtcagagcattaagactattaaatggtatcaacagaaaccaggaagccctgacctcctgatctatgctgcatccagtttgcacaggtcggggtccctacgaaggttcagtggctagtggatcgtgggacagtactttcactctcacgtcagcagtctgcaaccgtgaagtagtttcgactaacattactacttagtaccaaactacgtaacgttaccaccgttacccccctagttaccgtttccgggacggtaacgggtaaccgacgggacgtagacgtacgaacggtaacgtaacgtggtacgcgttacgacctaccgtagttcgttcgtcttaccg

SEQ ID NO: 256751 - DNA, 619 bp, Homo sapiens
  misc_feature: GYAE6OF02H5KLE.14.55.E11.1.454.CMB.1.raw
  modified_base (393)..(393): a, c, t, g, unknown or other
  misc_feature (393)..(393): n is a, c, g, or t
  modified_base (477)..(477): a, c, t, g, unknown or other
  misc_feature (477)..(477): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtctggggggagcgtggtccagcctggggaggtccctgacactctcctgtgcaacgtctggattcagcttcagtagttatggcatgcactggggtccgccgaggtcctccgaggcgaagggggcttagggagtgggggtgcgagttggtgtggtataggacggtaagtaaagtaggaaatgnggtaccgacgccgtaggaagggacccagtttcacctatcctaccgaggacgtaactaacttacccaaaactaacatttaggttntaatcctagtacaaaattggaaattacggccttagggaacgacggtacccgaagggacctacgggtcttaggtgtttaactttaccgtggttacgtaccgagggttaagagggttaggggggagggggttggtaggtaacgg

SEQ ID NO: 256752 - DNA, 694 bp, Homo sapiens
  misc_feature: GYAE6OF02GQRHV.14.55.E11.1.454.CMB.1.raw
  modified_base (193)..(193): a, c, t, g, unknown or other
  misc_feature (193)..(193): n is a, c, g, or t
  modified_base (261)..(261): a, c, t, g, unknown or other
  misc_feature (261)..(261): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccggaggtgccagatgtgacatccagatgacccagtctccatcctccctgtctgcatctgtagganacagagtcacatcacttggccggcaagtcagagctaattaagaacttatttaaagttggtaatcaaanagaaaccaggaacgccctgacctctgatctatgctgcagtctagtttcgcacgtagggtcggggtccctagtaaacggtttcaagggtcggactaggtgggtactcggtagggactaaggttacttttcgaccttccgtaccgtaccgtcgtaacggcgtacgttcgtacgtacctaaccgtagtaaacgtacttttacgaacttaaccttaacgttacttacgtaaccgtaaacgtaacgttaacgttaacccgtaacccgtttaaccccccgttaaccgttaccgttttaccggggaccggggtaaccgggtaaaccgaaacggggtacggtaacggtacgtaccgaaacggtaaccggtaacgttacggttacggtacgtaccggaccgttaaccgtacgttaccgttaccgttccgttaccgttacccg

SEQ ID NO: 256753 - DNA, 773 bp, Homo sapiens
  misc_feature: GYAE6OF02JA7JA.14.55.E11.1.454.CMB.1.raw
  modified_base (251)..(251): a, c, t, g, unknown or other
  misc_feature (251)..(251): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagccgtggggagtccctgaccactctcctgngcagcgtctggattcagtcttcagtagttatggcagtgctacggtcgggtcccgccgaggtcctaccgagggcgtaaggggccttggggacggttggggtacggccttagggtttcggtcgggttagggttagtacggtaaagggtaaaggttaaagtaacgggtaaaaagttcgtcggacccggtaacggtcccgggttaagggaaaccggggtcccgtaaacgtttccaaacccgtacgttacccgtaccgaaagggtaaccggtaaaccgtaaacgttacccgaaaacgtaaaccgttacgttacggttagttaaaccgttctaacgggtaaacctaaagttaccgtaaacgttacggacccttaagggaaacgtaaccggtacccggaaaggggtaccctaccggggtaccgtttaacggttagggttaaaccttttaacggccggtttacgtaccggtaaagggtacggtaaggttaggggggtaacgggggttcgttagggtaacccgttaccggg

SEQ ID NO: 256754 - DNA, 697 bp, Homo sapiens
  misc_feature: GYAE6OF02GVUV9.14.55.E11.1.454.CMB.1.raw
  modified_base (240)..(240): a, c, t, g, unknown or other
  misc_feature (240)..(240): n is a, c, g, or t
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
  modified_base (387)..(387): a, c, t, g, unknown or other
  misc_feature (387)..(387): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggtttcctcgttgctcttttaagaggtgtccagtgtcaggtgcagctggtggagtcgtgggggagcgtggtccagcctgggacgtccctgacnctctcctgtgcacgtctggattcagtcttcagttagttanggcagtgcctacgtcgggtcccncgaggtcctccgaggcgaaggggctgggagtgggtgcgtaggttggtggtggtatagggaacggtaaagtagtaagaaaggttntacggacccggaacggtccggtaagggaaacggggtcccgtaagttacccaacccgtattccccgtaccgaaggtaacgtaacctaacttaacccaaaacgtaacttaggttacgtttacgttaacttcgttacgaacctaaaagttagtaaaacgttccgtaccgtacggaacggtaccggaacccggaaggtaacccgtagggtacccgtttaggtacgtttaacgttaacggttacggttacgtacgtaacggtaaggtacgggttaggggggtaacgggggttagtacggaccgttacggtaaggg

SEQ ID NO: 256755 - DNA, 625 bp, Homo sapiens
  misc_feature: GYAE6OF02J16QZ.14.55.E11.1.454.CMB.1.raw
  modified_base (193)..(193): a, c, t, g, unknown or other
  misc_feature (193)..(193): n is a, c, g, or t
  modified_base (253)..(253): a, c, t, g, unknown or other
  misc_feature (253)..(253): n is a, c, g, or t
  modified_base (269)..(269): a, c, t, g, unknown or other
  misc_feature (269)..(269): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacttgccgggcaagtcagagcattaagactatttaatggtatcaanagaaaccagggaaacncccctagacctcctagactctatgactgcactcctaagtttgcacgacggtcggggtacctcgtaacggttcaggtcgcgtaagtggatcgtggacagtcttacgactctccgaaccgtcagctaagtcgtacgtcaaccgtagtaacgttacgttttagaccttaaaccgtttactaaccgttcgaaccgtaaacaggttaacgttaacccgtaaccgttaccccccgttattaccgtttacggggaccgggtacgggtaacccgaagggacgtaggtacgacgtaacggaaccggtacgtacgttcggacctacgaccgtaaccgtcttacgttcgttacccgttactaacccg

SEQ ID NO: 256756 - DNA, 592 bp, Homo sapiens
  misc_feature: GYAE6OF02J2I4R.14.55.E11.1.454.CMB.1.raw
  modified_base (196)..(196): a, c, t, g, unknown or other
  misc_feature (196)..(196): n is a, c, g, or t
  modified_base (304)..(304): a, c, t, g, unknown or other
  misc_feature (304)..(304): n is a, c, g, or t
  modified_base (345)..(345): a, c, t, g, unknown or other
  misc_feature (345)..(345): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
  modified_base (393)..(393): a, c, t, g, unknown or other
  misc_feature (393)..(393): n is a, c, g, or t
tcagcgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggtttttcctcgttgctcttttaagaggtgtccagtgtcaggtncagctggtggagtcgtgggggagcgtggtccagcctgggaggtccctgacactctcctgtgcaacgtctggattcagcttcagtagttatggcatgcacgtgggtccnccaggcctccgaggcgaaggggctggagtgggtgctgttgngtggtatgacggatanagaatntcgccgagccgtagaacggcatcacntctcgagacgactaactaccaacaactatagttgtactcgtagacctaaagtagaacgttacgctaggtacggacgtaccggacggaacgaccggtcgttaggtacgtttaacgttaccgttaggttacgtaccggtaaggaacggtacggttacgggggaagggggtttcggtaagggttacgttacccggtaagggg

SEQ ID NO: 256757 - DNA, 549 bp, Homo sapiens
  misc_feature: GYAE6OF02F8MD5.14.55.E11.1.454.CMB.1.raw
  modified_base (298)..(298): a, c, t, g, unknown or other
  misc_feature (298)..(298): n is a, c, g, or t
  modified_base (503)..(503): a, c, t, g, unknown or other
  misc_feature (503)..(503): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgacactctcctgtgcaacgtctggattcagtcttcagtagttatggcatgcacgtggggtccnccaggcctccgagggcgaagggggctgggagtggggtgctaggttgtgtggtatggaacggtaagtaataggaaagtatggccgacggccgtaggaacgggccgaattccaacctagtctaccgagacgactaattacccaaacaactattgttagtacttcgtagactaaatgaatagccgtagagacgaccgaggacgacggntgtgtatacgtgtgtcagagagtgggtagggtgaggtactcgtagg

SEQ ID NO: 256758 - DNA, 674 bp, Homo sapiens
  misc_feature: GYAE6OF02FVAYN.14.55.E11.1.454.CMB.1.raw
  modified_base (156)..(156): a, c, t, g, unknown or other
  misc_feature (156)..(156): n is a, c, g, or t
  modified_base (392)..(392): a, c, t, g, unknown or other
  misc_feature (392)..(392): n is a, c, g, or t
  modified_base (439)..(439): a, c, t, g, unknown or other
  misc_feature (439)..(439): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttccncgttgctcttttaagaggtgtccagtgtcaggtgcagctggtcggagtctgggggagcgtggtccaggccctggggacgtccctgacactctcctgtcgcaacgtctggattcacgtcttcagtagttatgggcatgcacggtcgggtccgcaggctccgaggccaaggggctaggagtgggtcgctaggttcgtagtcggtatcggaacggaagttaattaagggaaagttacgngacccgtacggtacccggttaggaaacggggccgtattaccgacgtntacctcccgaagtacggaacctaaacgttcccaaacgtaactacgtacggtttagacgttctaggaaccttaaagttcgaaaacgttcgaccgttaggaaccggtacgaccggtaaaggaaccgtaccggtactttacggggttacttaacgtttaacccgtgggttaccggttaacaaggtacgggaggttaggggggaaccggggtttggtacgtaacggtaccggttaaggg

SEQ ID NO: 256759 - DNA, 528 bp, Homo sapiens
  misc_feature: GYAE6OF02GCBOL.14.55.E11.1.454.CMB.1.raw
  modified_base (407)..(407): a, c, t, g, unknown or other
  misc_feature (407)..(407): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgacactctcctgtgcaacgtctggattcagcttcagtagttatggcatgcacgtgggtccgccaggctccaggcaaggggctgggagtgggtggcaggttgtgtggtatgacggaagtaatagaaagtatgccgacgccgtaggaacgggccgattcaccatctccaganacaacttccaacaacatgttagtatctgacaaatgaatagcctaggagacgaccggaggacgacggctgtagtattacgtgttcgtcaggagtagtggggaggggtggtagagtccgtagg

SEQ ID NO: 256760 - DNA, 525 bp, Homo sapiens
  misc_feature: GYAE6OF02FRYZ3.14.55.E11.1.454.CMB.1.raw
  modified_base (344)..(344): a, c, t, g, unknown or other
  misc_feature (344)..(344): n is a, c, g, or t
  modified_base (371)..(371): a, c, t, g, unknown or other
  misc_feature (371)..(371): n is a, c, g, or t
  modified_base (400)..(400): a, c, t, g, unknown or other
  misc_feature (400)..(400): n is a, c, g, or t
  modified_base (430)..(430): a, c, t, g, unknown or other
  misc_feature (430)..(430): n is a, c, g, or t
  modified_base (461)..(461): a, c, t, g, unknown or other
  misc_feature (461)..(461): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgacactctcctgtgcaacgtccggattcagcttcagttagttatggcatgcacgtgggtccgccaggcctccgaggcgaaggggctgggagtgggtgctagttgngtggtatggagtaagtaatagaaagtncgccgacgcgtagaagggccatcacatcncagagacaatccaacactattgtagtatcngacaagtgaatagctagagacgaccgagacncgctagtagtattacgtgtacgtacgagtagaggtggggtaggggtgtagacgtacgtaggtag

SEQ ID NO: 256761 - DNA, 544 bp, Homo sapiens
  misc_feature: GYAE6OF02GMNMX.14.55.E11.1.454.CMB.1.raw
  modified_base (277)..(277): a, c, t, g, unknown or other
  misc_feature (277)..(277): n is a, c, g, or t
  modified_base (451)..(451): a, c, t, g, unknown or other
  misc_feature (451)..(451): n is a, c, g, or t
  modified_base (508)..(508): a, c, t, g, unknown or other
  misc_feature (508)..(508): n is a, c, g, or t
  modified_base (532)..(532): a, c, t, g, unknown or other
  misc_feature (532)..(532): n is a, c, g, or t
  modified_base (540)..(540): a, c, t, g, unknown or other
  misc_feature (540)..(540): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcaattaagaacttaatttaaattggtatacaaacagaaaccaagggaaacncccctagacctcctgatctatgctgcatccagtttcgacacgaggttcgggggtcccgtcaaaggttcaggttggctaggtggatcgtagggactagtatttccacttcctcaccgtcgacgctacgttctgacctaaaccgtagaacgttattttcgacttaacttactactntacaactagacttacaccttacccctctacgtttcggacgaacggaccgaaggcganatcgagacgatggtcgctagcacntctctctntacc

SEQ ID NO: 256762 - DNA, 716 bp, Homo sapiens
  misc_feature: GYAE6OF02I8ZD8.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgacactcctcctgtgcacgtctggattcagtcttcaggttagttagtggcagtgctacgtcgggtcccgcgtaggcctccgaggacgaaggggctaggaggtgggtggcgtaggttgtggtaggtagtaggaacggaagttaagaaggtaaagttagcggacccgacggtccggtagggaaccgggtccgtaacgttacccgaaccctacgttacccgtaccgaacgtaacggaaacctaaacgttaaccccgaaaccctaaacgttagtttacgtttacggttaacttccgtacgaaacgtaaacgttaacgtaaacgttaacgtacccgtaggaacgggaaccgggaccggaaaccgggtaaccgaaccgggtcgttaggtttacgttaacgttttacggttacggttacggttaacgaggtaaggtacgggttaggggtacggggggttaggtacgggtacgtacggttaacggg

SEQ ID NO: 256763 - DNA, 562 bp, Homo sapiens
  misc_feature: GYAE6OF02IWM0V.14.55.E11.1.454.CMB.1.raw
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccggnaagtcagngcaattaagaactatttaaatggtatcaacagaaaccaggaaagccctagacctctgatctatgactgcatccagtttgcatagtggggtccctacaaggttcagtggcagtggatctggacagtattcacgtctcacgtcagcagtctgaccaactgaagtatttgactaactttactactcgtactaacagtagttaccacttaccccctgtaaccgtttccgggacggtaacgggtaccaaacgggtacgggtaacagttaccgaaggaaccgtaacgtcggttacggcgttacggacctacccgtaagttaccctggttacccttcgttaacccg

SEQ ID NO: 256764 - DNA, 627 bp, Homo sapiens
  misc_feature: GYAE6OF02HDLY8.14.55.E11.1.454.CMB.1.raw
  modified_base (345)..(345): a, c, t, g, unknown or other
  misc_feature (345)..(345): n is a, c, g, or t
  modified_base (377)..(377): a, c, t, g, unknown or other
  misc_feature (377)..(377): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgacactctcctgtcgcaacgtctggattcagcttcagttagttatggcatgctacgtggggtcccgccaggcctccgaggccaaggggctgggaggtgggtgcagttgngtggtatggaacggtaagtaagtaggaaagtntcggacccgacgcccggtaggaacggggtcccgtaagttccgaaccctaagtccctaccgaaggaacgaactaaacttacccaaactaacctattagtttacgtattcgtagactaaatgaaattacgaccgtaggacgacggaccggaaggaaccgacggtcgttagtagttaacgttaacgttggttacggtcgtaaggtaacggtaggttaggggtagggggttaggtaggtacgtaccggtaaggg

SEQ ID NO: 256765 - DNA, 774 bp, Homo sapiens
  misc_feature: GYAE6OF02JZ9Z9.14.55.E11.1.454.CMB.1.raw
  modified_base (171)..(171): a, c, t, g, unknown or other
  misc_feature (171)..(171): n is a, c, g, or t
  modified_base (281)..(281): a, c, t, g, unknown or other
  misc_feature (281)..(281): n is a, c, g, or t
  modified_base (302)..(302): a, c, t, g, unknown or other
  misc_feature (302)..(302): n is a, c, g, or t
  modified_base (350)..(350): a, c, t, g, unknown or other
  misc_feature (350)..(350): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggtttcctcgttgctcttttaagnggtgtccagtgtcaggtgcagctggtggagtcgtgggggagcgtggtccagccgtgggaggtccctgacactctctgtgctaacgtctggattcgagcttcagtagttanggcagtgccacgtcgggtccncgaggctccgaggcgaaggggctgggacgtgggtcggctaggtttggnggtacgggtataggaaccgggtaagtaacgtaggaaaagttcgtcgacccggtacggtccggttagggaaagggggtcccgtaagtttacccgaacccgtattcccgtacccgaaggtaacgtaaaccgtaaacgttaacccgtaaaaccgaaaccgttaacgtttacggtttaacgtacttaccggttaacggaaccgttaaaaagtacgggttaaaccttacggggaaccctttaagggaaccggtaaacgggtacccggtaaaccggggtaacgtaacccgggttaccgttagggtttaagggtttaacctttaccggttaagggtttacggtaacccggtaaagggttaccggttaaagggttccggggggttaaagggggggttcggtaacgggtttaacggtacccggttaaaggggg

SEQ ID NO: 256766 - DNA, 625 bp, Homo sapiens
  misc_feature: GYAE6OF02IYDJO.14.55.E11.1.454.CMB.1.raw
  modified_base (251)..(251): a, c, t, g, unknown or other
  misc_feature (251)..(251): n is a, c, g, or t
  modified_base (280)..(280): a, c, t, g, unknown or other
  misc_feature (280)..(280): n is a, c, g, or t
  modified_base (300)..(300): a, c, t, g, unknown or other
  misc_feature (300)..(300): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgacactctcctgtncaacgtctggattcagcttcagtagttanggcatgctacgtgggtcccnccagggcctccgagggccgaagggggtcctggggaggttggggcggactaggttgtgtgggttactgggaacggtaaagtaataaggaaacgttatcggcccgaacggtccggtaggacgggtcccgtattcacctagtcctccgaacgacgaactaacttacccaaacaaccgagttcgtttacgtacttcgtacgaactaaagtgtaaacgttcgaccgtaggaacggacgtacccggaaggaaccgacgggttacgtgttagtacgtttacgttggtcgtacaggtaggagttggggtagggttggtagtacgtcggtaagg

SEQ ID NO: 256767 - DNA, 694 bp, Homo sapiens
  misc_feature: GYAE6OF02JCNXD.14.55.E11.1.454.CMB.1.raw
  modified_base (156)..(156): a, c, t, g, unknown or other
  misc_feature (156)..(156): n is a, c, g, or t
  modified_base (296)..(296): a, c, t, g, unknown or other
  misc_feature (296)..(296): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttccncgttgctcttttaagaggtgtccagtgtcaggtgcagctggtggagtctgggggagcgtggtccagcctgggagtccctgacactctcctgtgcaacgtctggattcagcttcagtagttatggcatgcacgtgggtccnccaggcctccgaggcaagggggctgggagtgggtaggcaggttgtggtggtatggaacggaagttaataggaaagtatggacccgtaacggcccgttagggaaacggggtcccgaagtttaccgaaccgacgttacctaccgaagtaacggaacctaaacgttacccgaaactaaactacttacggtttacgttaacttacgttacggaacctaaaagttacgtaaacgttacggacccgttaggtaacggtaaccgtacccgggaaacgggtaaccgaaccggggtacgttacgggttacggttaacgtttaaccggttaggttacggttaccgaaggtacggtaacggttacggggtaaggggggttgggtaacgggtacgttacccggtaagggg

SEQ ID NO: 256768 - DNA, 521 bp, Homo sapiens
  misc_feature: GYAE6OF02HGFBL.14.55.E11.1.454.CMB.1.raw
tcagcgtctagtaccacgaccggtgctcgatttagcactcgcacgttgggtttggggaggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgacactctcctgtgcaacgtctggattcagcttcagtagttatggcatgcacgtgggtccgccaggctccgaggcaaggggctgggagtggggtggcaggttgtgtggtatggacggaagtaagtagaaagtgtgccgacgccgtgaacgggccgatcaccatctcagagacaattccaacaacatgttgtatctgacaaatgaatagcctagagagccgagacgacggctgtgtattacgtgtgtcagagagtgggaggggtggtgagtacgg

SEQ ID NO: 256769 - DNA, 831 bp, Homo sapiens
  misc_feature: GYAE6OF02F11Y4.14.55.E11.1.454.CMB.1.raw
tcagcgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggacgtccctgacactctcctgtgcaacgtctggattcagtcttcagttagttatggcatgcacgtggggtcccgccaggcctccgagggcgaaggggctgggaggtggggtggctaggttgtggtggtatggaacgggtaaagttaaagtaaggaaaggttagtcggacccggtaacggtcccgggtagggaaacggggcccgtaacgtttacccgaacccgtaacgttcccgtacccgaaggtaaaccggtaaaccctaaacgtttaaccccaaaaccgtaaaccgttaaagtttacggttttaacgttaactttaccgttaacggtaacctaaaaacgttaacggtaaaacgtttaaccggtaaccccgttaagggtaaaccgggtaaccgggtaaccccggggtaaacggggtaaacccggtaacccgggggttaccgtttacggggtttaacggtttaaacggtttttaaaccggttacgggtttaacggttaaccggttaaaggggtaacgggttaacggggttaggggggggttaaacggggggggtttaggggtttaacgggttaaccggtttaacccgggttaaaggggg

SEQ ID NO: 256770 - DNA, 847 bp, Homo sapiens
  misc_feature: GYAE6OF02GCBYK.14.55.E11.1.454.CMB.1.raw
  modified_base (244)..(244): a, c, t, g, unknown or other
  misc_feature (244)..(244): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtccctgacnctctcctgtgcaacgtctgattcagtcttacagttagttagtcggctagttcggaccacggttcgggggtacccccgccgtaacggggtccctacccggaaggggtacccggaaagggggggtccttagggggggtaacggggtttggggggtcggtaccggttaaggggtttttcgggttagggtttacggggtttaaaacgtacgggggaaaaccgggggttaaaaaaggtttaaaaggttaaaaggggtaaaaaacggtttacgtaccggggtaaccccgggaacccgggttacccggggttaaggggaaaaccgggggtccccggttaacgttacccgtaacccgtaacgttacccgttaacccgaaggtaacggaaaccttaaaccgttaacccaaaacctaaacctaagtttacgtttagttacttacctacggtaactaaaagttagtaaacgttacgtaccgtaggtaacggacgaccggaacgggaaccgaccggtcgttaggttacgtttaacggtttacgttacggttacggtacgtaaggtaggtacgggttaggggtaggggggttaggtacggtacgttaccggtaagg

SEQ ID NO: 256771 - DNA, 770 bp, Homo sapiens
  misc_feature: GYAE6OF02I5L11.14.55.E11.1.454.CMB.1.raw
  modified_base (244)..(244): a, c, t, g, unknown or other
  misc_feature (244)..(244): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagccgtgggacgtccctgaccnctctcctgtgcaacgtctggattcgagtccttcgagttagttatggcatcgctacgtcggggtcccgccgaggcctaccgaggaccgaagggggcttaggggacggttggggtcgcgtaggttggttggtagggtactaggggaacggtaaagttaagtaaggaaaagttgtacggacccggtaccggaccggtagggaacgggtcccgtaacttccgaacctacgtcccgtaccgtaaggaacgtaaacctaaaccgttaacccaaaaccgtaaaccgttaagttcgtttaacgttacgttacgttacggtaaccttaaaaggttaacgtaaacgttaacgtaccccggttaaaggaacggtaaccgggtaaccgggtaaaccgggtaaccgtaccgggtccgttaacgggttacgtttaacggtttaaccggttcggtacgggttaaccgaaaggttaacgggttaacgggttacgggggttaaggggggtttcggggtaacggttacggttaccggtaagggg

SEQ ID NO: 256772 - DNA, 561 bp, Homo sapiens
  misc_feature: GYAE6OF02GGVAC.14.55.E11.1.454.CMB.1.raw
  modified_base (237)..(237): a, c, t, g, unknown or other
  misc_feature (237)..(237): n is a, c, g, or t
  modified_base (259)..(259): a, c, t, g, unknown or other
  misc_feature (259)..(259): n is a, c, g, or t
  modified_base (340)..(340): a, c, t, g, unknown or other
  misc_feature (340)..(340): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtcccngagactctcctgtgcagcctcnggattccaccttcagtacctatgctatgcacgtgggtccgcaggcctccgaggcgaggggctgggagtgggtgcgtattanatcacagtgataggaactaaagnggacnctagtcgccgtacgtccgtaggaacggcctaattccaactactctaccagacacaaattccaaagtaaccacgtacgaacgttatccgtagaactaaagtacgaaacgacgtaccgtagacgaagccggaggacacgggctggtagttacgttacgtgtagtacaggtaggagtagggtagggggtggtacgg

SEQ ID NO: 256773 - DNA, 660 bp, Homo sapiens
  misc_feature: GYAE6OF02H1SCF.14.55.E11.1.454.CMB.1.raw
  modified_base (174)..(174): a, c, t, g, unknown or other
  misc_feature (174)..(174): n is a, c, g, or t
  modified_base (299)..(299): a, c, t, g, unknown or other
  misc_feature (299)..(299): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcgtggtttcgcgtaggctctttaagaggtntccagtgtcaggtgcagctggtggagtcgtgggggagcgtggtccagccgtgggaggtccctgaccacgtctcctgtgcaacgtctggattcagcttcagtagttatggcatgcactgggtaccnccaggctccgaggcaaggggctgggagtgggtgctagttgtgtgtagtgaacggtaagtaataggaaatgtacgccgacggaccgtaggaaacgggtccgtacgttaccaccgtacgttccgtaccgacggaacgtaaacctaactttaacccaaacctaaacctaagttacgtttagttaacttacgtacgacctaaaagttagaaacgttacgtaccgttaggaacgacgaccggaaacggtaaccgaaccgggtcgttacggttacggtttaacgtttaacgttacggttacggttaacgaaggtacggtaaggttagggggtaaggggggttacggtaggtacgtaccggttaaggg

SEQ ID NO: 256774 - DNA, 557 bp, Homo sapiens
  misc_feature: GYAE6OF02GJBEN.14.55.E11.1.454.CMB.1.raw
  modified_base (172)..(172): a, c, t, g, unknown or other
  misc_feature (172)..(172): n is a, c, g, or t
  modified_base (280)..(280): a, c, t, g, unknown or other
  misc_feature (280)..(280): n is a, c, g, or t
  modified_base (300)..(300): a, c, t, g, unknown or other
  misc_feature (300)..(300): n is a, c, g, or t
  modified_base (373)..(373): a, c, t, g, unknown or other
  misc_feature (373)..(373): n is a, c, g, or t
  modified_base (414)..(414): a, c, t, g, unknown or other
  misc_feature (414)..(414): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtctggggggagcgtggtccagcctgggacgtccctgacactctcctgtgcaacgtctggattcagcttcagtagttanggcatggcacgtcgggtccnccaggcctccgaggcaagggggctgggagtgggtgctaggttgtggtgtatggaacggaagtagaagaaagtntgccgacgccgtaggaacgggccattcacctatctacaganactaatccaaacaacattagttatactctagactaaattagaatacgtacctaggagacgacggacggaactacgggcttagtgtacgttacgtgtacgtacgaggtagtaggtggggaggggttggtaggtactcggtaagg

SEQ ID NO: 256775 - DNA, 749 bp, Homo sapiens
  misc_feature: GYAE6OF02H1L19.14.55.E11.1.454.CMB.1.raw
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgacactctcctgtgcaacgtctggattcagtcttcagtagttatggcatgcacgttggggtcccgccagggcctaccgagggccgaaagggggcctagggaggtggggtggctaggtttgtggtggttagtaggacggtaaagttaagtaaggaaagtagtcggacccggtacggtccggtaggaacggggccgtaacgtttccgaacccgtagttaccgtacccgtaaaggtaacggaacctaaacgtttacccaaaaccgtaaacctaagtttaggtttaacgttaacttaccgttacgtaacgtaaaaacgttgtaaaacgttaacgacccgttaagggaaacggtaacgggtaaccccggaagggtaaaccgtaaccgggtaccgttacggttaggtttaacggttttaaccgttaggttacggttaaccgtaaggggtaacggtacgggttacggggggtaagggggggtttacgggttagggtaacggttaacccggg

SEQ ID NO: 256776 - DNA, 623 bp, Homo sapiens
  misc_feature: GYAE6OF02GI6DO.14.55.E11.1.454.CMB.1.raw
  modified_base (300)..(300): a, c, t, g, unknown or other
  misc_feature (300)..(300): n is a, c, g, or t
  modified_base (377)..(377): a, c, t, g, unknown or other
  misc_feature (377)..(377): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggacgtccctgacactctcctgtgcaacgtctggacttcagcttcagtagttatggcatgcacgtgggtccncaggcctccgaggcgaaggggctagggagtgggtgctaggttgtggtggtatcggaacggtaagtaagtagaaagtntcgaccgacggccggtaggaacgggtccgtagttaccgaccgtacttccgtaccgaaggtaacgtaactaacttacccaaactaactagttagttacgtacttcgtacgaactaaataggtaaactacgtccgtaggaacgacggaccggaggaaccgacggtctaggttagttaacgttacgtaggttacgtacgtaacggaggtaggtcgggggtagggggtaggtaggtacgtacggtaaggg

SEQ ID NO: 256777 - DNA, 533 bp, Homo sapiens
  misc_feature: GYAE6OF02HNMFQ.14.55.E11.1.454.CMB.1.raw
  modified_base (181)..(181): a, c, t, g, unknown or other
  misc_feature (181)..(181): n is a, c, g, or t
  modified_base (428)..(428): a, c, t, g, unknown or other
  misc_feature (428)..(428): n is a, c, g, or t
  modified_base (450)..(450): a, c, t, g, unknown or other
  misc_feature (450)..(450): n is a, c, g, or t
  modified_base (474)..(474): a, c, t, g, unknown or other
  misc_feature (474)..(474): n is a, c, g, or t
  modified_base (495)..(495): a, c, t, g, unknown or other
  misc_feature (495)..(495): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtctgggggagcgtggtccagcctgggagtccctgacactctcctgtgcagctcaggattcattttagcgtaatatgccatgagctgggtccgccaggcctccgagggaaggggctggaggtgggtctcaggcaatcagtggttctagtggaagtacattcgacgtccgtctccgtggaacgggccggttctccatctccagagacaatccaagaacnctactattctacaaagtgacancctagaacgtacgaagacgacggngtgtattttgaggtagaagtntacgagtctatagactacctagtttgggaggtcttacg

SEQ ID NO: 256778 - DNA, 655 bp, Homo sapiens
  misc_feature: GYAE6OF02GPX6H.14.55.E11.1.454.CMB.1.raw
  modified_base (172)..(172): a, c, t, g, unknown or other
  misc_feature (172)..(172): n is a, c, g, or t
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
tcagcgtctagtaccacgaccggtgctcgatttagcactcgcacgttggggctctgggagaggagcccagcactagaagtcggcggtgtttccattcggtgatcagcactgaacacagaggactcaccatggagtttgggctgagctgggtttcctcgttgctcttttaagnggtgtccagtgtcaggtgcagctggtggagtcgtgggggagcgtggtccagcctgggagtccctgacactctcctgtgcctaacgtctaggacttcagcttcaagttacgttanggtcatgcacgtgggtcccnccaggcctccgaggtccgaaggggtctgggaggtggggtgactaggttgtggtggtatcggaacggtaaagttaactaggtaaagtgtcggacccgacggtcccggtaggaaacggggtccgtaagtttaccgaacctagttcctacccgaagacgtaacctaaacttacccaaaactaacgtagttagttacgtaacttcgtagtaactaaagtgtaaacttacgtcctaggaacggtaacggaaccggaacggaaccacgggtcgttacggttacgttaagtttaccgtaggtcggtacgaggtaggtacggttggggtaggggttcgtacggtacgtcccgtaagg

SEQ ID NO: 256779 - DNA, 572 bp, Homo sapiens
  misc_feature: GYAE6OF02H54AP.14.55.E11.1.454.CMB.1.raw
  modified_base (305)..(305): a, c, t, g, unknown or other
  misc_feature (305)..(305): n is a, c, g, or t
  modified_base (342)..(342): a, c, t, g, unknown or other
  misc_feature (342)..(342): n is a, c, g, or t
  modified_base (422)..(422): a, c, t, g, unknown or other
  misc_feature (422)..(422): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgacactctctgtcgcaacgtctggattcgagcttcagtagttatggcatgcatggtccnccaggctcaggcgaagggctggagtgggtgcagttgngtggatggacggaagtaatacggaaagtatgcccgagccgtagaacgggcagttcacgatctcagagacaattccgaaanaactagtcgttagtaactctacgactaaaacgttagaacgtacgacccgttaggaacgacggaccgaacggaaccgtacggacgttgtacggtacttaacgtgtaggttaccgaggtaggagtggggagggggttgtacggagtaaccgg

SEQ ID NO: 256780 - DNA, 532 bp, Homo sapiens
  misc_feature: GYAE6OF02IWRZM.14.55.E11.1.454.CMB.1.raw
  modified_base (253)..(253): a, c, t, g, unknown or other
  misc_feature (253)..(253): n is a, c, g, or t
  modified_base (422)..(422): a, c, t, g, unknown or other
  misc_feature (422)..(422): n is a, c, g, or t
  modified_base (440)..(440): a, c, t, g, unknown or other
  misc_feature (440)..(440): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgaccactctcctgtncgaacgtctggattcagcttacagtagttagtggcatgctacgtgggtccgccaggctccaggcgaaggggctaggagtgggtggctaggtgtggtgtatggacgaagtaataggaaagtatgaccgagccgtaggaaggtcatcacatcctcagacacaactaccaanaactatagttatatctanacaaatgaatgactagagacgcgaggacgacgcgtgtagtagttctgtagtacagaggagtacggggagggttgtacggtagtaccgtaagg

SEQ ID NO: 256781 - DNA, 616 bp, Homo sapiens
  misc_feature: GYAE6OF02I2ANP.14.55.E11.1.454.CMB.1.raw
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctgggtaggagtcgtgggggagcgtggtccagcctgggacggtccctgaccactctcctgtgcaacgtctggattcagtcttcagtagttatggcatgacacgtgggtccgccgaggcctccgaggcgaaggggctgggagtgggtgctagttgtgtggtatggaacggtaagtaataagaaagtgtacggaccgacgccgtaggaacgggccgtatcacgtatccgtacgagagaacaacttaccaaacaactagttgttagtactctagactaaaagtgaaacgtacgaccgtagaacggaaccgaccgggaacgaccgtaccggtacgttacggtagttaacgttacggttgtaggttaccaagggtaagtaacgggttgggggtaacggggggttaggtacgtaaacgg

SEQ ID NO: 256782 - DNA, 644 bp, Homo sapiens
  misc_feature: GYAE6OF02G2NGR.14.55.E11.1.454.CMB.1.raw
  modified_base (300)..(300): a, c, t, g, unknown or other
  misc_feature (300)..(300): n is a, c, g, or t
  modified_base (368)..(368): a, c, t, g, unknown or other
  misc_feature (368)..(368): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggagtccctgacactctcctgtgcaacgtctggattcagtcttcagttagttatggcatgcacgtgggtccncgaggctccgaggcgaaggggctgggagtgggtgctgttgtgtggtatgacggaagtaatagaaagtntcggaccgacgccggtaggaacgggccgtacttccgacctactccgtaccgaagaacgactaacttacccaaaacgtaactaagttacgtttagtacttcctagtaacctaaattaggtaaactacgtacccgttaggaacggtacggaccgggtaacggaaccgaccgggtacgttacggttacgttaacgttaacgttaggttcggtaacgtagggtaacggtagggttgggggtaagggggggttaggtacgggtacggtaccggttaagggg

SEQ ID NO: 256783 - DNA, 631 bp, Homo sapiens
  misc_feature: GYAE6OF02IE0GN.14.55.E11.1.454.CMB.1.raw
  modified_base (165)..(165): a, c, t, g, unknown or other
  misc_feature (165)..(165): n is a, c, g, or t
  modified_base (199)..(199): a, c, t, g, unknown or other
  misc_feature (199)..(199): n is a, c, g, or t
  modified_base (248)..(248): a, c, t, g, unknown or other
  misc_feature (248)..(248): n is a, c, g, or t
  modified_base (284)..(284): a, c, t, g, unknown or other
  misc_feature (284)..(284): n is a, c, g, or t
  modified_base (575)..(575): a, c, t, g, unknown or other
  misc_feature (575)..(575): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagcgtgggttttccncgttgctcttttaagaggtgtccagtgtcaggtncagctggtggagtcgtgggggagcgtggtccagcctgggagtcctgacnctctctgtgcagtctggattcagcttcagtagttanggcatgctacgtcggggtcccacgaggtcctccgagggcgaaggggctgggaggtggggtgctaggttgtggtggacgtaggagtaaagtaagaaggtaaacgttagcggacccggacggccggttagggaacggggtcctattccaaccgtactccgtaccgaagtaacgacctaactaccgaaacaactagttgttacgttacgtctagtaactaaagtagaaacttacgccgtaggaacgacgggaccggaaggaaccgtcggtacttaggtaggttaactttaccgngtcgttaacgaggtacggtagggtacgggggtaggggttgtacggtacgttacggg

SEQ ID NO: 256784 - DNA, 629 bp, Homo sapiens
  misc_feature: GYAE6OF02GCW89.14.55.E11.1.454.CMB.1.raw
  modified_base (300)..(300): a, c, t, g, unknown or other
  misc_feature (300)..(300): n is a, c, g, or t
  modified_base (343)..(343): a, c, t, g, unknown or other
  misc_feature (343)..(343): n is a, c, g, or t
  modified_base (372)..(372): a, c, t, g, unknown or other
  misc_feature (372)..(372): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgacactctcctgtgcaacgtctggattcagtcttcagttagttatggcatgcacgtcgggtccncgaggctccgaggcgaaggggctgggagtgggtgctaggttgngtggtatggacggtaataataggaaagtntcgaccgacgccgtaggaacgggccgtattccacgatccgtcagaacgtactaattacccaaactaactagtacgttatacgttctagtactaaagtagaattacgaccgtaggaacgtacgaccggaacggtaacgaccggtacgttaggttacgtttaacggtttaccgttagggtttacggtaaccgtaaggtaaggttacggggttaggggggtaacggggggttaggtacggtaaccggttccggtaaaggg

SEQ ID NO: 256785 - DNA, 665 bp, Homo sapiens
  misc_feature: GYAE6OF02HYQAO.14.55.E11.1.454.CMB.1.raw
  modified_base (180)..(180): a, c, t, g, unknown or other
  misc_feature (180)..(180): n is a, c, g, or t
  modified_base (310)..(310): a, c, t, g, unknown or other
  misc_feature (310)..(310): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccaggcctgggacgtccctgacactctcctgtgcaacgtctggattcagtcttacagtagttatggcatgcacgtcgggtccnccaggctccgaggccgaaggggctgggagtggggtcggctaggtttgtggtggtatggaacggtaaagtaagtaaggaaagtagtcggacccggtacggccggttaggaacggggtccgtattccacctagtcctacgagtacgaactaacttaccaaacgtaactacttgttacgtactacgtagaactaaaagtacgtaaacgtaacgccgtaggaacggtacggaaccggaagggtaccgtaccggtacgttcggttacgttaacgtttaccggttacgttacggttaccggaaggtaacgggtagggttagggggttaaggggggtttaggtacgggtacgttaacccggg

SEQ ID NO: 256786 - DNA, 567 bp, Homo sapiens
  misc_feature: GYAE6OF02FJ5OY.14.55.E11.1.454.CMB.1.raw
  modified_base (225)..(225): a, c, t, g, unknown or other
  misc_feature (225)..(225): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagngcattaagaactattaaatggtatcaacagaaaccagggaaacgccccctgacctcctgatctatgctgcatccagtttgcacgagtcggggtcctcgaaggttcagtggcagtggatcgtgggacagtattcactctacaccgtcagcagtctgaccaacgtagaagtactttagacttaacttactacttcgtactaacgtagtaacgtttaccaccgttaccccctactaccgtttcggacgggtacggaaccgtagggacggaacgtacgacaacggaacgaacgtcggtacggtaccgtgacctaccgtacgttccgttacgttaccttcttacccg

SEQ ID NO: 256787 - DNA, 544 bp, Homo sapiens
  misc_feature: GYAE6OF02FX7YH.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacaggtcggggtacccgtcaaggttcagtggcagtggatcgtgggaacagtatttcactctcaccgtcagcagtctgacaaccgtagaacgtattttcgactaactttacctactagtacaaacagtagttaccacgtacccccctctaaccgtttcggacgggtaacgggaccgaaggcgagatcgaaggaacgaactggtacggctagaccaccattccgtcgttccttactaccg

SEQ ID NO: 256788 - DNA, 666 bp, Homo sapiens
  misc_feature: GYAE6OF02FHAQ0.14.55.E11.1.454.CMB.1.raw
  modified_base (171)..(171): a, c, t, g, unknown or other
  misc_feature (171)..(171): n is a, c, g, or t
  modified_base (189)..(189): a, c, t, g, unknown or other
  misc_feature (189)..(189): n is a, c, g, or t
  modified_base (238)..(238): a, c, t, g, unknown or other
  misc_feature (238)..(238): n is a, c, g, or t
  modified_base (308)..(308): a, c, t, g, unknown or other
  misc_feature (308)..(308): n is a, c, g, or t
  modified_base (355)..(355): a, c, t, g, unknown or other
  misc_feature (355)..(355): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctgttgctcttttaagnggtgtccagtgtcaggtncagctgggtggagtcgtgggggagcgtggtccagcctggggacgtcccngacactctctgtgctaacgtctggacttgagtcttacgagttgttatggcatcgctacgtcggggtcccncgaggcctaccgaggcgaaggggctgggaggtggggcgctaggttgnggttaggtagtcggaaacgggtaaagtaagtaaggaaagtcgtcggacccggacgtccggtaggaaccgggtccgtaacttccaacctagtcctaccgaaggaacgtaacctaaacgttacccaaactaacgttaacgttcgtttacgtaccttacgtacgaacttaaacgagtaaacgtacgaccgtaaggaacggtaccgaccggtaaacggaccgtaccggtcgttagtacgtacgtttacgtggttacgtacggaagtaaggttacgggtcgggggtaaggggttggtacggtacgtacgggtaagg

SEQ ID NO: 256789 - DNA, 725 bp, Homo sapiens
  misc_feature: GYAE6OF02JPEG9.14.55.E11.1.454.CMB.1.raw
  modified_base (225)..(225): a, c, t, g, unknown or other
  misc_feature (225)..(225): n is a, c, g, or t
  modified_base (255)..(255): a, c, t, g, unknown or other
  misc_feature (255)..(255): n is a, c, g, or t
  modified_base (308)..(308): a, c, t, g, unknown or other
  misc_feature (308)..(308): n is a, c, g, or t
  modified_base (327)..(327): a, c, t, g, unknown or other
  misc_feature (327)..(327): n is a, c, g, or t
tcagcgtctagtaccacgaccggtgctcgatttagcactcgcacgttgggtttgggggcgtctgggagaggagcccagcactagaagtcggcggtgtttccattcggtgatcagcactgaacacagaggactcacatggagtttgggctgagctgggttttcctcgttgcttacttttaagaggttgtccagtgtcaggtgcagctaggtggagtcgtggggggngtcgtggtccagccgtgggagtccctgacnctctctgtcgacgacgtcgtaggattcgagtctttacgagttagttagcggtnagtcgctacgtgggtcccnccgaggcctccgagggcgtaggggctagggaggtggggtagcgttaggttcgtagggttgtagtacggacggtaaagtaacgtaggaaagttgtacggccggtaaccggtacggtagggaacgggtccgtaacgttaccgaaccgtacgtacccgttaccgaacggtaacgtaaaccgttaaacttaacccgaaaccgttaaaccgtaagtttacggtttacgttactttacgtacggtaactaaagttacggtaaacttaacgtaccggttacggaaggtaaccggtaaccgggaaggtaaccggaccgggttccgtaggtttagttaacgtttacgttaggtcgtagtaaggtacggtaagggtcgggtaagggggttcggtacgggtagtacggg

SEQ ID NO: 256790 - DNA, 580 bp, Homo sapiens
  misc_feature: GYAE6OF02FV475.14.55.E11.1.454.CMB.1.raw
  modified_base (156)..(156): a, c, t, g, unknown or other
  misc_feature (156)..(156): n is a, c, g, or t
  modified_base (190)..(190): a, c, t, g, unknown or other
  misc_feature (190)..(190): n is a, c, g, or t
  modified_base (239)..(239): a, c, t, g, unknown or other
  misc_feature (239)..(239): n is a, c, g, or t
  modified_base (298)..(298): a, c, t, g, unknown or other
  misc_feature (298)..(298): n is a, c, g, or t
  modified_base (369)..(369): a, c, t, g, unknown or other
  misc_feature (369)..(369): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttccncgttgctcttttaagaggtgtccagtgtcaggtncagctggtggagtctgggggagcgtggtccagcctgggagtccctgacnctctcctgtgcaacgtctggattcagcttcagtagttatggcatgcacgttggggtccncgaggcctccgaggcaaggggctgggagtgggtggctagttgtgtggagtgacggaaatagtaagaaagtntcgccgacgccggtagaaggggccgtattccgaccatccgtaccgaaggacgaacaagttacccgaaacaaccgtagttagttagtatcgtgaactaaatcgaaatacggctaggacgacgaccggagtaccacgggtctagtagtagttcgtgttcgacgtaaggagtaggtagggggtagggggttggtacggtacgtaccggtaaggg

SEQ ID NO: 256791 - DNA, 634 bp, Homo sapiens
  misc_feature: GYAE6OF02FOPRH.14.55.E11.1.454.CMB.1.raw
  modified_base (273)..(273): a, c, t, g, unknown or other
  misc_feature (273)..(273): n is a, c, g, or t
  modified_base (317)..(317): a, c, t, g, unknown or other
  misc_feature (317)..(317): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaacttatttaaattggtatacaacagaaaccagggaaacncccctgacctctgtatctatcgctgcatcctagtttcgacacgnggttcggggtccctacgtaacggttcaggtcggcaggtggtatcgtgggactagtatttcacttctccaccgtcacgcacgtctacgacctaacgtagtaagttacttttacgacttaacgttaacttacgttacgtacaacgtaacgtaacgttaccgaacccgttaccccctacgtaccggtttaccgggtaccgggaaccggggtaacccgaacggggtaccggtaggtacgtaccgaacgggtaaaccgtacgttacggtcggtaccgttcggaccgtaccctaacgtccttacggttccttaccgttacccg

SEQ ID NO: 256792 - DNA, 607 bp, Homo sapiens
  misc_feature: GYAE6OF02FE632.14.55.E11.1.454.CMB.1.raw
  modified_base (157)..(157): a, c, t, g, unknown or other
  misc_feature (157)..(157): n is a, c, g, or t
  modified_base (173)..(173): a, c, t, g, unknown or other
  misc_feature (173)..(173): n is a, c, g, or t
  modified_base (288)..(288): a, c, t, g, unknown or other
  misc_feature (288)..(288): n is a, c, g, or t
  modified_base (310)..(310): a, c, t, g, unknown or other
  misc_feature (310)..(310): n is a, c, g, or t
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
  modified_base (535)..(535): a, c, t, g, unknown or other
  misc_feature (535)..(535): n is a, c, g, or t
tcagcgtctagtaccacgaccggtgctcgatttagcactcgcacgttgggcgtcgtgggagaggagcccagcactagaagtcggcggtgtttccattcggtgatcagcactgaacacagaggactcaccatggagtttgggctgagctgggtttccncgttgctcttttaagnggtgtccagtgtcaggtgcagcgtggtggagtcgtgggggagcgtggtcccaggcctggggacgtccctgacactctcctgtgcaacgtctggacttcgagcttcgagtagttanggctagtgctacgtgggtcccncgtaaggctccgagggtcaaggggctagggagtggggtcgcaggttgnggtggtanggaacggaagtaacgtaggaagtgtcggaccgacgccggtagaacgggccgtacttccacctactccgacgaacgacgaacttacctaacaaacgtactagtcggttatacgtacgacgtaactaagtacgagtaccgtacgagtacgaccgacgtacggaccgtacgngttagtacgtacgttggtaggtacggtagtacgaggtacggtacgtacgtagttacggtaggtacggtaggg

SEQ ID NO: 256793 - DNA, 706 bp, Homo sapiens
  misc_feature: GYAE6OF02FQ2EL.14.55.E11.1.454.CMB.1.raw
  modified_base (313)..(313): a, c, t, g, unknown or other
  misc_feature (313)..(313): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacggtccctgacactctcctgtgcaacgtctggattcagtcttacagttagttatggctatcgccgtacgttcggggtacccnccgtagggcctcccgaggggaccgaaggggggcttggggaggttggggtggtacgtagggtttggtcggtaggttaacgtgggaaacggtaaagtaaagtaaggtaaagtacgtacggacccggacggtacccggttaagggaaccgggtccgtacgttaccgacccgtactaccgtaccgaagaacgtaacctaaccttacccaaaccaactagttagtttacgtaacttacgtacgtacgtaaagtagaacgtagtaccgtaggaacgaccggaccggaacggaacgtacggtacgttagttacgttacgttaacgttacggttacggttacgtaacggtaggtagggttacggggtagggggttagggttaggtacgtaccggttaaggg

SEQ ID NO: 256794 - DNA, 752 bp, Homo sapiens
  misc_feature: GYAE6OF02I5JY7.14.55.E11.1.454.CMB.1.raw
tcagcgtctagtaccacgaccggtgctcgatttagcactcgcacgttgggtttgggggctctgggagaggagcccagcactagaagtcggcggtgtttccattcggtgatcagcactgaacacagaggactcacatggagtttgggctgagctgggttttcctcgttgcttcttttaagaggtgtccagtgtcaggtgcagctggtggagtcgtgggggaggcgtggtccagcctggggacggtccctgacactctcctgtgcaacgtctggattcagtcttcagtcgttagtgcatcgcacgtcggggtcccgccacgggcctccgagggcaaggggctgggagtggggtgcaggtttgtggtggtatggaacgggtaagtaaataggtaaaagttagtcggacccggaacggtcccgggtagggaaacggggacccgtaactttaccgaacccgtacgttacccgttacccgaaaggaaccgtaaacctaaaaccgtttaccccaaaaccgtaaaccgtaacggttacggttttaggttaacgttaccgtaacggtaccgtaaaaagttacggtaaagttaaccggtacccgttacgggaacggtaaccggacccggaaacggggaaccgtaccgggtccgttacgggtttacggttaaacgttttaaccgttagggttaccgttacgtaacgggtaaaggtagggtttagggggtagggggggtttagggttacggtacggtacccggg

SEQ ID NO: 256795 - DNA, 743 bp, Homo sapiens
  misc_feature: GYAE6OF02HH1UQ.14.55.E11.1.454.CMB.1.raw
  modified_base (190)..(190): a, c, t, g, unknown or other
  misc_feature (190)..(190): n is a, c, g, or t
  modified_base (278)..(278): a, c, t, g, unknown or other
  misc_feature (278)..(278): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggagtcgtggtccagccgtggggacgtccctgaccactctccgtgcgcaacgtctggattcagtccttnagtacgttagtggcatcgcctacgtcgggtcccgaccgacgggcctccggacgggcgaacgggggctaggggtaggttgggggtcgtacgtagggtttggtggttacggggtataggaacggggtaaaagttaacggtaaaggaaacggttaggtcggaccggtaaccggtccggtagggaacggggtccgtaactttcccgaacctaacgtccgtaaccgaacggaccgtaaacgtaaccttacccgaaaacctaaacgtacgtttacggttacgttaacttcgtacgtaactaaaacgtagtaaactacgtccgttagaacggaacggacccgggaacggaaccgtacgggaccgtttaggttacgtaacgttttacgtcgggttacgttaaccggaagggttaagggttaacgggttgggggggaaggggtttcggggtaggtaccggttaccgggtaaggg

SEQ ID NO: 256796 - DNA, 745 bp, Homo sapiens
  misc_feature: GYAE6OF02F632F.14.55.E11.1.454.CMB.1.raw
  modified_base (255)..(255): a, c, t, g, unknown or other
  misc_feature (255)..(255): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagccgtgggacgtccctgactactctcctgtcncaacgtctggacttcgagtcttcagtagttatggctatcgctacggtcgggtcccgacgaggcctccgaggccgaaggggctacgggaggttgggtcggacgtagggtttgtggttaggtagtacggaaacgggtaaagttaagtaaggtaaaagttcgtcggacccggtaacggcccggttaagggaaaccggggtcccgtacgttacccgaaccctaactccgtaccgaagtaaccgaaacctaaaacgttaacccgaaacctaaacgttaacgttacgtttagttaacttccgttaacgtaaaccgtaaaacgttacggtaaattaaccgtaccgttaagggaacggtaaccgggaaccggtaaacggtacccgtaaccgggtacgttacggttaagtttacgtttaacggttcggttacgtaacgtaacggtaaggttaggttacgggggtaagggggttcgtacgggtacggtaccggttaaggg

SEQ ID NO: 256797 - DNA, 618 bp, Homo sapiens
  misc_feature: GYAE6OF02HSHDE.14.55.E11.1.454.CMB.1.raw
  modified_base (281)..(281): a, c, t, g, unknown or other
  misc_feature (281)..(281): n is a, c, g, or t
  modified_base (304)..(304): a, c, t, g, unknown or other
  misc_feature (304)..(304): n is a, c, g, or t
  modified_base (376)..(376): a, c, t, g, unknown or other
  misc_feature (376)..(376): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggagtccctgacactctcctgtcgcaacgtctggattcagcttcagttagttanggcatgcctacgtcggggtcccnccgaggcctccgaggcgaagggggctgggaggtgggtggcagttggtgtcggtatggaacggtaagttaaanaggaaatgtcgccgacggtccggtggaaacggggccgtagtccacctatcctccgagacgaactaacttaccaaacaactaattagttagttactacgtacgaacaaagttagtaaatacgtaccgtagaacgacgaccggacgaaccgacggtacgtaggttacgttaagttacgttgttacggtacgtaacggaggtacggtaggggtacgggggttgggtaggtacgtaccggtaaggg

SEQ ID NO: 256798 - DNA, 749 bp, Homo sapiens
  misc_feature: GYAE6OF02FQGF2.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgacactctcctgtgcaacgtctggattcagcttcagtagttatggcatgcacgtcgggtaccgccaggcctacccgaggacgaaggggctgggaggtggggtaggcctaggtttggtggttaggtacgtaggacgggtaaagttaagtaaggtaaaagttagtcggaccgacggccggtagggaaacgggccgtacgtttaccgaaccctacgttaccgtacccgtaaggaaacgtaaccgtaaaacctttacccgaaaaccgtaaacctaaacgtttacggttttacggttaacttaccgttaacgtaaccgttaaaaacgttacggaaaagtttaacccggtacccgttaacggtaacgggaacggtaccccgggaaagggaaccggtaaccgggtaccgtttacggttaacgttaacgtttaaccggttcggttacggttaacgtaaggtaaggtaagggttacggggtagggggggttagggttacgggtacggttaccggtaaagggg

SEQ ID NO: 256799 - DNA, 629 bp, Homo sapiens
  misc_feature: GYAE6OF02JCNH9.14.55.E11.1.454.CMB.1.raw
  modified_base (248)..(248): a, c, t, g, unknown or other
  misc_feature (248)..(248): n is a, c, g, or t
  modified_base (298)..(298): a, c, t, g, unknown or other
  misc_feature (298)..(298): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctgttgctcttttaagaggtgtccagtgtcaggtgcagctggtggagtctgggggagcgtggtccagcctgggagtcccctgacactctcctgngcaacgtctggattcagcttcgagttagttatggcatgcacgtgggtccncgaggcctcgaggcgaaggggtctgggaggtgggtagctaggttggtgtggtatcgggaacggaagtaataggaaagttcgtcggacccggtaggcccgttaagggaacgggtccgtagttaccacctacgtcctaccgagaacgtaacctaacgttacccaaactaacctagttagtttagtaacttacgtacgaacctaaagtagtaaacgtaacggtccgtagtaacggacgaccgtacggaacgacgtcgtaggttacgttacgttcgttcggttatacggtagtacggtagggtggggtaggggttggtaggtacgtacggtaagg

SEQ ID NO: 256800 - DNA, 720 bp, Homo sapiens
  misc_feature: GYAE6OF02IZGWK.14.55.E11.1.454.CMB.1.raw
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccagccgtgggacggtccctgacactctccgtgtgctaacgtcgtggtattcagtcttacaggttagttagtggactagtcgaccgtacggtcggggtccccgccgacggtcccgtaccgacgggacgaacgggggtcgtgggaggtggggtcggacgtaggttggtggtaggtagtgggaacggtaaagtaagtaaggaaagtcgtcggaccggacgtccggtagggaaccgggtccgtaactttacccgaaccctagttcccgtaccgaaggaaccgtaactaaacctttacccgaaaactaaccgttaagttcgtttaagtcttacgtacgtaaacctaaagttacgtaagtaccgtaccgttagaacggtcgaaccggtaacgggaaccgtacggttacgttaggtttaacgttacgtttacgttggttacgtacgtaagggtacggtagggtaggggggttaacggggttaggtacggtaaccgg

SEQ ID NO: 256801 - DNA, 740 bp, Homo sapiens
  misc_feature: GYAE6OF02I3KP4.14.55.E11.1.454.CMB.1.raw
  modified_base (156)..(156): a, c, t, g, unknown or other
  misc_feature (156)..(156): n is a, c, g, or t
  modified_base (261)..(261): a, c, t, g, unknown or other
  misc_feature (261)..(261): n is a, c, g, or t
  modified_base (282)..(282): a, c, t, g, unknown or other
  misc_feature (282)..(282): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttccncgttgcttctttaagaggtgtccagtgtcaggtgcagcgtggtggagtcgtgggggagcgtggtccagccgtgggacgtccctggacactctcctgtgcacgtcnggatcagtcttcagtagttancggctatggccacgtcggggtcccacgaggtcctccggaggccgaagggggtctggggacggtgggtcggactagggtttcgaggttggtagtacgggtaacggtaaaggttaaagtaacgaaaggttacgtggaaccccggtaaccggaccggttaagggaaccgggtcccgtaagtttacccgaaccgtacttaccgacccgaaggtaaacgtaaccgtaaccgttaacccgaaaccaaacgtaacgtttgggttaactacgtacgtacgtaaacctaaagtacgtaacgtaacggccgtaagggtaacggtaccgggaacccggtaagggaaaccgttacccgggttacgttacggttaggtttaaccgtttaccggttaggttacgtaaccgttaaggaagggttccggttaaggggggtacggggtttaacggttagacgtttacggtaaggg

SEQ ID NO: 256802 - DNA, 664 bp, Homo sapiens
  misc_feature: GYAE6OF02FG4BS.14.55.E11.1.454.CMB.1.raw
  modified_base (156)..(156): a, c, t, g, unknown or other
  misc_feature (156)..(156): n is a, c, g, or t
  modified_base (302)..(302): a, c, t, g, unknown or other
  misc_feature (302)..(302): n is a, c, g, or t
  modified_base (360)..(360): a, c, t, g, unknown or other
  misc_feature (360)..(360): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttccncgttgctctttaagaggtgtccagtgtcaggtgcagctggtggagtcgtgggggagcgtggtccagcctggggacgtccctgacactctcctgtgcaacgtctggattcagtcttcagttagttatggcatgcacgtggggtcccnccgtaggcctccgaggcgaagggggctgggaggtgggtggctaggttgtggtggtagnggaaacgggtaataaagaggtaaaagtagtcggacccggacggacccggtaggaaacggggtcccgtattaccgaccctaacgtcctaccggtaagaacggtaactaaacctttacccaaactaacctaagttggtttacgttaacttcgttacgaactaaagttcgtaaacgttcgacccgttagaacggtacggaccggtagggaaccgtacgggtcttaggttacgttacgttaacgttggtcgtacgaaggtagtacggttacgggggtagggggttacggtggtacgttccggtaaggg

SEQ ID NO: 256803 - DNA, 713 bp, Homo sapiens
  misc_feature: GYAE6OF02GUP42.14.55.E11.1.454.CMB.1.raw
  modified_base (323)..(323): a, c, t, g, unknown or other
  misc_feature (323)..(323): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatcgtgtaggagacagacgtcacatcactggccggcaagtcagagcaattaagaacttaatttaaatggtatactaacgaagaaaccgtaagggaaacgcccctagacctcctgtactctatcgctcgctactcctagtttncagtacggtcggggtaccctacgtaaaggttccgaaggtcggacgtaggtacgggtacttacggtacgggaacgtacgttaactttttaccgaacccgtttctaacccggtacccgtaccgtaacgtcgtaacgttccgtacgaaccgtaaccgtagtaaacgtttagtttaccgtaacttaaacctttacgttaccgtaacgttaccgtaaacgtacggttaacgttaaacccgtacccgttaccccctacgttaccggtttacccgggacgggtaaccgggaccggtaacgggcgtaacgacgtaaccggtaacgtaacggtaaccgttgggtaccgtacgttaccgtccgtaacctacgttacgtacggttacctacccgttacccg

SEQ ID NO: 256804 - DNA, 683 bp, Homo sapiens
  misc_feature: GYAE6OF02H9P3J.14.55.E11.1.454.CMB.1.raw
  modified_base (173)..(173): a, c, t, g, unknown or other
  misc_feature (173)..(173): n is a, c, g, or t
  modified_base (351)..(351): a, c, t, g, unknown or other
  misc_feature (351)..(351): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttggctgagctgggttttcctcgttgcttacttttaagnggtgtccagtgtcaggtgcagcgtgggtaggagtcggtggggggagcgtggtaccaggcccgtggggacggtccctggaaccaccttcgtcccgtaggtcgacctaaacggttccgtgggtactttcgaggtccttacgaggttagtttagtcggctagtcgctacgtcggggtcccnccgaggcctccgaggcgaacggggtcgtagggaggtcgggtggcgtaggtttggtggttacgggtagtagggaacggtaaagtaagtaagtaaaaggttcgtacggacccggtaaccggccggtaagggaaccgggtccggtattaccgaaccgtctaccgtaccgagaacgactaacttaccaaacgtaactagttacgttagtacttactagaactaaagtacgtaatacgacctagacgtacgcggagacgacgtcgtagttacgttacgtacgttgtccgtagtacgaggtcggtaggggtacgggttggtcggtacgtacggtaggg

SEQ ID NO: 256805 - DNA, 823 bp, Homo sapiens
  misc_feature: GYAE6OF02FP8OV.14.55.E11.1.454.CMB.1.raw
  modified_base (193)..(193): a, c, t, g, unknown or other
  misc_feature (193)..(193): n is a, c, g, or t
  modified_base (275)..(275): a, c, t, g, unknown or other
  misc_feature (275)..(275): n is a, c, g, or t
tcagcgtctagtaccacgaccggtgctcgatttagcactcgcacgttgggtttggggagtcgtcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcaattaagaactatttaaattggtaatcaacagtaaaccagggaaacnccctgacctcctgactctatgctgctatcctagtttcgacacgtaggttcggggtacccgtagtaacggttcaagggtcggcgtaggtcggtacgtcgttacggggaactaggtaactttccgtacgttccgttaccgtacccgtacgtaacgtcgtaacggtttaccgtacggtaaccgttaacccgttaggtaaacgttttaacgtttttaccgtaaccgtttaaaaccgtttaacccgtttaaccgtttacgtaaacccgttaaaccgtaacggttaaaccgtttaaacccgttaaccccgggttttaaccccccccgttacgtttaaccccggtttttacccgggggaaccgggtttaacccgggggtaaacccggtaaaaccgggggttaccggggttaaaccggttaacccggttaacgggaacccgggtaaacccggttaaaccgtttaccggggtacggttaccggtaaccgtttaacccgtaaccccgttaaccggtttacccgtttaccggttttacccgttaccccgttaaccccgg

SEQ ID NO: 256806 - DNA, 818 bp, Homo sapiens
  misc_feature: GYAE6OF02JOJUN.14.55.E11.1.454.CMB.1.raw
tcagcgtctagtaccacgaccggtgctcgatttagcactcgcacgttgggtttgggggctctgggagaggagcccagcactagaagtcggcggtgtttccattcggtgatcagcactgaacacagaggactcaccagtggagtttgggctgacgcttgggttttcctcgttgctcttttaagaggtgtccagtgtcaggtgcagctggtggatcgtgggggagcgtggtccagcctgggacgtccctgacactcgtcgtgcgcaacgtctggattcgaagtctttacgaagttacgttacgtcggactaacgttcgacctaacggttcgggtacccgacctagggtccctacccgaagggtacctaaaggggggcccttaggggaaacgggtttggggggtaacgtccgttaggttttacggtcggttagggttaacgttcgggaaaaacgggtaaagtttaaagtaaccgggtaaaaagttccgttacgggacccggaacggtttacccgggaagggtaaaccggggtaccccgtaagtttaccggaaaccccgtaacgtttcccgttaaaccccggaaaggttaaacgtaaacccgttaaaaccggtttaccccaaaaacggtaaaccttaggtttaccggtttagttaaacctacgtttaacggaaccttaaaagttcgaaacgtttacgacccgtaaggaacgttaaccggacgtaagaccgtacgggtaccttagtaacgtattaccagggttacaacgttaagggacttaagggtaccggggttaggggtcgttaaccggacgttaaccggg

SEQ ID NO: 256807 - DNA, 597 bp, Homo sapiens
  misc_feature: GYAE6OF02I28KW.14.55.E11.1.454.CMB.1.raw
  modified_base (301)..(301): a, c, t, g, unknown or other
  misc_feature (301)..(301): n is a, c, g, or t
  modified_base (347)..(347): a, c, t, g, unknown or other
  misc_feature (347)..(347): n is a, c, g, or t
  modified_base (377)..(377): a, c, t, g, unknown or other
  misc_feature (377)..(377): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgacactctcctgtgcaacgtctggattcagcttcagtagttatggcatgcacgtcggggtcccnccgaggcctccgaggcgaagggggctgggagtggggtgcaggttgnggtggtatggacggaagtaataggaaagtntgaccgacgccgtagggaacgggtccgagttccaccatcctccaggacgaactaactacccaaacaactattcgttagtactctagaacaagttagaaatacggtactaggaacgacggaccggaaggaacccgacggtacgttagtagttaacttacgtcggttagtcgaaggtaggtacggtaggggtaggggttggtacggtacgttacggtaaggg

SEQ ID NO: 256808 - DNA, 558 bp, Homo sapiens
  misc_feature: GYAE6OF02F6ZAN.14.55.E11.1.454.CMB.1.raw
  modified_base (289)..(289): a, c, t, g, unknown or other
  misc_feature (289)..(289): n is a, c, g, or t
  modified_base (375)..(375): a, c, t, g, unknown or other
  misc_feature (375)..(375): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgaccactcctctgtgcaacgtctggattcagcttcagtagttanggcatgcacgtgggtccgccgaggctccgaggcgaaggggctggagtgggtgctagttgtgtggtatggaggaatagtagaaagtntcgccgacgtccgtaggaacggccgtatccactactctaccgagagacaattacccaaacaacagttgttacgtatcgtagactaaatgtaaatacgccgtagagacgaccgaaggaccgacggtgtcggtagttacgttacgtgttcgtacgaggagtaggtgggtaggggtagtggtacgg

SEQ ID NO: 256809 - DNA, 835 bp, Homo sapiens
  misc_feature: GYAE6OF02JGSEL.14.55.E11.1.454.CMB.1.raw
  modified_base (157)..(157): a, c, t, g, unknown or other
  misc_feature (157)..(157): n is a, c, g, or t
  modified_base (173)..(173): a, c, t, g, unknown or other
  misc_feature (173)..(173): n is a, c, g, or t
  modified_base (177)..(177): a, c, t, g, unknown or other
  misc_feature (177)..(177): n is a, c, g, or t
  modified_base (191)..(191): a, c, t, g, unknown or other
  misc_feature (191)..(191): n is a, c, g, or t
  modified_base (207)..(207): a, c, t, g, unknown or other
  misc_feature (207)..(207): n is a, c, g, or t
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (262)..(262): a, c, t, g, unknown or other
  misc_feature (262)..(262): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttccngttgcttcttttaagnggtntccagtgtcaggtncagctggtggagtcgngggggagcgtggtccagccgtgggacgtccctgacnctctcctgtcncaacgtcnggattcgagtcttcgagttagttatggctagtcgctacggtcgggtccccgccgaggtcccgtaccggagggccggaaagggggccgttagggggacgggttgggggttcggacgttagggttttgggtcggttagggttaagtttaccgggaaaacggggttaaaaggtttaaacgtaaagggtaaaacggttacgtacccgggacccgggtaaccgggtaccgggtacggggtaaacgggggtccccttaacgtttaacccgaacccgtaccgttacccgtacccgaaaggtaccgtaaaaccttaaacccgtttaacccaaaaccgtaaaccttagtttacggttttacggttaacttaccggtaacgaaacttaaacggttaagtaaccgttaaccggtcccgttaagggaaccggagggtaaccccgggaacgggtaacccgtaaccggggttaccgttggtttaacggttacgttttaaacggtcggtttaacggtacgtaagggtacggtacggggttaggggggttacggggttagggttacggttacggttaccgggttaaggg

SEQ ID NO: 256810 - DNA, 682 bp, Homo sapiens
  misc_feature: GYAE6OF02JFB23.14.55.E11.1.454.CMB.1.raw
  modified_base (156)..(156): a, c, t, g, unknown or other
  misc_feature (156)..(156): n is a, c, g, or t
  modified_base (172)..(172): a, c, t, g, unknown or other
  misc_feature (172)..(172): n is a, c, g, or t
  modified_base (308)..(308): a, c, t, g, unknown or other
  misc_feature (308)..(308): n is a, c, g, or t
  modified_base (324)..(324): a, c, t, g, unknown or other
  misc_feature (324)..(324): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttccncgttgctcttttaagnggtgtccagtgtcaggtgcagctggtgagtcgtgggggagcgtgggtccaggtccgtggggagttccctggaaccactccgtccgtggtgtaccaacgtctaggattccaggtccttcaaggttacttagtggacntagctacgtgggtccncaggcctccagggcgaagggctgggaggtcgggtagcgtagttgcgtggtatggaacggtaagtaataaggaacgttagcgaccggtaacgtccggaggaacgggtccgtaacgtacgtaacccgacgtacctacgaacgtacgaaccgtaactttaaccgaaaccgtaacgtacgttacgttacgtaacgttacgtcgtaaacgaacgttacgaacgttaaccgtacgttacggaacgacggtaccggtaacggaccgtacggtacgtcggttaacgtacgtttacgtacggttacgtacgttacgaagggttacggtagggttacggggtaggttacggtaggtaccggttaaggg

SEQ ID NO: 256811 - DNA, 759 bp, Homo sapiens
  misc_feature: GYAE6OF02HIYHZ.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcgttgggttttcctcgttgcttcttttaagaggtgtccagtgtcgaggtgcgagtcgtggtggagtcggtgggggagtcgtcggtccaggccgtgggaccgtccctagacctacgttcctccgtggtcgaccgtaacgttcgtggtacttcgagttccttacgtagttagttagtggctagttcgaccgtacgggttccgggtaccccgaccgtaacgggcccttaccggaaggggaccggtaaagggggtccgttaggggtacgggttgggggtacggtaccggttagggtttggtggttacggtaagttacgggaaacggtaaaagttaagtaaaggaaacgttcgacggacccgaacggtccgggtaagggaacccgggaccggttactaccgtacctactcccgtaaccgaggtaacgaacctaacttaacccgaaactaacttagttagttaacgtactacgtacgaaactaagtaacgtaatacggaccgtagggaacgtaccgaccgggaacgaaccgggtacgtacgttgttaacgttacttaggtcgttaggtacgaaggttaggtagggtggggtagggttaggtacggttacggtacgtaaggg

SEQ ID NO: 256812 - DNA, 619 bp, Homo sapiens
  misc_feature: GYAE6OF02HOUHY.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtcctccatccctccctgtctgcatctgtaggagacagagtcacatcacttcggccgggacaagtcaggagactaattaagaacttaattttaaagttggttaactacaaacgtaacgaaaaccgaagggaaacgaccccctagtaccctacctgtaacttcgtaatcggctacgctactccgtagttttcgactacgtcgggtacggggtccgtacgtaggttacaggtgcgtaggtgtatcgaggactagtattcactctccgtacgtacacgtacacggttctcgactaacgtagtagttatttcgacttacttacttactctacgaacgagtacgtacgacctaccgccccgttactaccggtttacggacgggtacgaaccgtaacgggcggacgtacgtacggaacgaaccgtagtacgtacgcgtacgacctaccgcttactgtccttaccg

SEQ ID NO: 256813 - DNA, 758 bp, Homo sapiens
  misc_feature: GYAE6OF02IFW7D.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtagagacagagtcacatcacttcggccggcaagtcagacgcaattaagaacttatttaaaattggttaatacaaacgtaacgaaaaccgaagggaaacgccccgtagacccctacctgactactatgctcgcactccgtagttttacgacctacgtacggttcggggttacccgtacgtaaacggtttcgaaggttcgggacgtaaggtcggtaacgttccggtaggggtaacctagtaacgttttaccgaccttacccgttaccgtaacccgtttaccgacgtaccgtacggttacctacggtaccaaaccgttaggtaaacgttactttttacggaaccttaaactttaaccgttaaccgtacgttaaccgtaacgtaaacggttaacgtttaacgtaacgtaacccgtaaccccgggtttacgggttaacccggttaccgggtaacccgggaacggggtaacccgtaaagggtacgggtaacggtaacgtaaccggaaaacggtacgttacgggtacggtacctacggtacccgaaccttacgttaccgttgttacctttcctaacccg

SEQ ID NO: 256814 - DNA, 654 bp, Homo sapiens
  misc_feature: GYAE6OF02HGNSD.14.55.E11.1.454.CMB.1.raw
  modified_base (255)..(255): a, c, t, g, unknown or other
  misc_feature (255)..(255): n is a, c, g, or t
  modified_base (291)..(291): a, c, t, g, unknown or other
  misc_feature (291)..(291): n is a, c, g, or t
  modified_base (309)..(309): a, c, t, g, unknown or other
  misc_feature (309)..(309): n is a, c, g, or t
  modified_base (367)..(367): a, c, t, g, unknown or other
  misc_feature (367)..(367): n is a, c, g, or t
  modified_base (413)..(413): a, c, t, g, unknown or other
  misc_feature (413)..(413): n is a, c, g, or t
  modified_base (504)..(504): a, c, t, g, unknown or other
  misc_feature (504)..(504): n is a, c, g, or t
tcagcgtctagtaccacgaccggtgctcgatttagcactcgcacgttgggctctgggagaggagccagcactagaagtcggcggtgtttccattcggtgatcagcactgaacacagaggactcaccatggagtttggctgagctgggttttcctcgttgcttacttttaagaggtgtccagtgtcaggtgcagctgggtggacgtcgtggggggaggtcgtggtccaaggccgtgggacggtccctgacacgtcncctgtcgcagtctggattccagtcttcagttagtanggcatgcacgtggtaccncaggccttacgaggcgaaaggggggtctcggggagtcggggtacggctagggttttgnggttggtaacgtggagggttaaaaagagttaaagaaaaccgtcggngtaccccgaaggggtctaggggaaacggtcgtacgttaccgacaactcgtaccgagtaacgactaaccgtacaacaacagttgtagtactntagaactaagtaagtaactacggacctagaacggacgtacccgaaaggaccgacgtcgttacggttagtaaccgttagtaacccggttggttaaccgtagacgggtaacggttagggggtacgggggtaggttacgacgttacggaaggg

SEQ ID NO: 256815 - DNA, 804 bp, Homo sapiens
  misc_feature: GYAE6OF02HZ2II.14.55.E11.1.454.CMB.1.raw
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
tcagcgtctagtaccacgaccggtgctcgatttagcactcgcacgtttgggtttggggagtctcagtcaggacacagcatggacatgagggtccccgctcagctccgtggggctcctgctactctggctccgaggtgccagatgtgacatccagatgacccagtctccatcctcctgtctgcatcgtgtagganacagngtcacatcagttggccgggacaaagtcagacgtactaagtttaaagaacttaattttaaaacgttggttaaactacgtaaaacaaacggaaaaccgaacgggggaaaaccgtacccccgtagtacccttaccgttacgtaacttaccgttaacttcggacgtcgtacctaacgttacccgttaaggttttccgaccgtaacggttacggggttacgggggtccccgttaacggttaaacgggtttccgaaggttcgggtacgtacgggttaacggtcgttacgggtacgggtacgtaacgtttacgtttacctaccgttccgtaccgtaccgtacgacgtactaacgttctacggacctaaccgtaacgtaagttacgttttacgaaccttaaactttaccgtacgttaccgttaacaaacgttaacggtaactttaacccgtacccgttaacccccgttacgtttaccggttaccgggtaaccgggtaaacccgggacggtaaacggggtacggacgtaacgtacggaaccggtaacgtaaccgtcgggtacgtacccgtacgacccgtaacctcgtttaccgtacgttccgttaccttacccg

SEQ ID NO: 256816 - DNA, 779 bp, Homo sapiens
  misc_feature: GYAE6OF02IHAC2.14.55.E11.1.454.CMB.1.raw
  modified_base (269)..(269): a, c, t, g, unknown or other
  misc_feature (269)..(269): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggtttttccctcgtttgcttcttttaagaggtgtccagtgtcaggtgcagctggtggagtcgtgggggagcgtggtccagccgtgggacgtccctgaccactctcctgtcgacaacgttcnggtattcagtcttcgagttagttatggctagtcgcacgtcgggtccgccgaggtcctaccgagggcgaacggggcgtagggagggttggggtacggtacgtagggtttcggtgggtttagggtacgtagggaacgggtaaagttaaacggtaaggaaaagttcgtccgggaacccggaccgggtacccggtaagggtaacccggggacccggttacgttacccgtaacccgtacgttacccgtacccgtaacgggaaaccgtaaaccgtaaaccgttaacccaaaaccgtaaaccttaagtttacgtttacgttaacgttcgtaacgtaaactaaacgttaacgtaaacgttaacggtaccgttaaggaacggtaaccggaccggggaaacggaacccggtacgggtacgttacggttacggtttaacgtttacgttacggtggttaacggaggtaagggttagggtacgggggtaggggttagggtacggttacggtaccgggttaggg

SEQ ID NO: 256817 - DNA, 771 bp, Homo sapiens
  misc_feature: GYAE6OF02FKRIU.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcgtgggttttcctcgttgctcttttaagaggtgtccagtgtcaggtgcagctgggtggagtcgtgggggaggccgtggtccagcctgggacgtcccctgacactctcctggtcgcaacgtctggattcagtctcagtagttatggcagtgcacgtcgggtccgccaggcctccgaggcgaagggggtctgggaggtggggtggcaggtttggtggtaggttactgggaacggtaaagttaaagtaagaaacggttagtcggacccggtacggacccggttaggaacggggtcccgtaacgtttaccaacccgtacgttacccgtacccgtaaggaacggaacctaaactttacccgaaaacctaaaccgtagtttacgtttaggttaaccttaccgtaacggaaaccttaaaacggttacgtaaaacgttacggacccgttaagggtaaacgggaccgggaacccggtaaacggggaaccccggtaacgggttacccgttagggtttaacggttaaccggttttaacggtcggtttaacgggttaccgaaaggggtaacgggtaacgggtttacggggggggtaacggggggttaggtaaccggttaccgggttacccggtaagggg

SEQ ID NO: 256818 - DNA, 723 bp, Homo sapiens
  misc_feature: GYAE6OF02JAC60.14.55.E11.1.454.CMB.1.raw
  modified_base (238)..(238): a, c, t, g, unknown or other
  misc_feature (238)..(238): n is a, c, g, or t
  modified_base (374)..(374): a, c, t, g, unknown or other
  misc_feature (374)..(374): n is a, c, g, or t
  modified_base (385)..(385): a, c, t, g, unknown or other
  misc_feature (385)..(385): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctgttgctcttttaagaggtgtccagtgtcaggtgcagcgtggtggagtcgtgggggagcgtggtccagccgtgggacgtcccngacactctctgtgcaacgtctggattcgagtcttcgagttagttagtggactagtcgcctacggtcggggtccccacgaggccctaccgaagggccgaagggggtctaggggacggttgggtcggactaggtttgnggttacggtancgggaacggtaaagttaagtaaaggaagttacgtcgggaccccggtacgggtcccgtagggaaccgggtcccgtaacgttacccgaacccgtacgttacccgtaccggtaacggaacgtaaccttaaaccgttaaccccgaaaccgtaaacgttaacgtttacggtttacgttaacttacgttacgtaactaaacgtagtaaaccgttacgaccgttaggaacggacgacccgggaaggtaaccgacggtacgttaggttagttacgttacggtggttacgtaacgaggtaggtacggggtggggtacggggttggtacggtacgttaccggtaaggg

SEQ ID NO: 256819 - DNA, 626 bp, Homo sapiens
  misc_feature: GYAE6OF02GESMW.14.55.E11.1.454.CMB.1.raw
  modified_base (244)..(244): a, c, t, g, unknown or other
  misc_feature (244)..(244): n is a, c, g, or t
  modified_base (312)..(312): a, c, t, g, unknown or other
  misc_feature (312)..(312): n is a, c, g, or t
  modified_base (388)..(388): a, c, t, g, unknown or other
  misc_feature (388)..(388): n is a, c, g, or t
  modified_base (559)..(559): a, c, t, g, unknown or other
  misc_feature (559)..(559): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagccgtgggacgtcctgacnctctcctgtcgcaacgtctggattcagtcttcgaggttagttatggacagtgctacgtcggggtcccnccgaggcctacgaggacggaaggggtctgggaggtgggtcgcgtaggttggtggtaggtatggaacggtaagtaanaaggtaaagtagcgaccggacgacggtaggaacgggaccgtataccacctactacctacgagacgaactaactaccaaacaactagttagttatactcgtagaactaatagaagtacgactaggacgacggacgtaggaccgacgtcgtaggttacgttaacgtttacggnggttcgtaacgtaaggtagggtacgggtacgggggtagggggttacggtaggttacgcggttaaggg

SEQ ID NO: 256820 - DNA, 836 bp, Homo sapiens
  misc_feature: GYAE6OF02FQ5LX.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggttgtccagtgtcaggtgcagctggtggagtcgtgggggagcgtgtccagccgtgggacgtccctgacactctcctgtgcaacgtctggattcagtcttcaggttagtagtggcagtgctacggtcggggttcccgccgaagggtccctacccgaggggaccggtaaaggggggtccgttaggggtaacgggttgggggtcggggaccgttaaggggttttggttcggtttagggggttaacgtaacggggtaaaccgggggtaaaaggtttaaaagttaaaggggaaaaacggttacggttacggacccgggtaaccgggtaccccggttaggggtaaaccggggtacccgtaacgttacccgtaaaccctacgttacccgtacccgaaggtaacgaaacctaaacgttaacccaaaccgtaacgttaacgttagtttacgttaacttaccgttacgtaacgttaaacgtaaggtaacgttacggtacccgttaaggaacggtaaccgggtaaccgggaaccgggaaacgtacccgggttagtttacgggttagtttaaccggttttacgttaggttaccgggttaacgacgggtaaggttgggttacgggggggttaagggggtttacgggttacgggtaccgttaccggggttaaacggg

SEQ ID NO: 256821 - DNA, 753 bp, Homo sapiens
  misc_feature: GYAE6OF02INGU5.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgacactctcctgtgcaacgtctggattcagtcttcagttagttatggcatgctacgtggggtcccgcagggcctccgaggcgaaggggctgggagtgggtgctaggtgtgtggtatggacggtaagtaataggaaagtagtcgacccgaacggccggtagggaaacgggtcccgtagtttacccaaccgtacgttcccgtacccgaaaggaaccgtaaacctaaaacgtttaccccgaaaaactaaacgttaagtttacggttttaacggttaacgttaccgttaacggaacctaaaagttacggtaaaacgttacggtaccccgttagggaaacggtaaccggtaacccgggaaagggtaaaccccgtacggggttaccgttagggtttaacggttttaacgtttaaccggtttacgggttacggttaacccgtaaggggtaaaacggtacgggtttaaggggggggtaagggggggtttacgggttaacgggtaccggttacccggttaaaggggg

SEQ ID NO: 256822 - DNA, 730 bp, Homo sapiens
  misc_feature: GYAE6OF02IWYR2.14.55.E11.1.454.CMB.1.raw
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgaccactctcctgtgcaacgtctggattcagcttcagtagttanggcatgcacgtggggtcccncaggcctaccgaggccaaggggctggaggtgggtgctaggttggtgtagggtatggaacggtaagttaataaggtaaagtatcgggacccgaacgggcccgtagggaaacgggtcccgtaattacccgaaccctagttaccccgtcccgtaaaggtaacggtaaacctaaaaccgttttaacccccaaaaccgttaaaccgtaagttttacgggtttaacgtaacgttaccgttaacgtaaaccttaaaagtaggttaaaaccgttacgtacccgttaggaacggtaacggaacccggtaaggaacccggaaccgggtcgttaggttacggtttaacgtttaacccggttaggtttacggtacgttaaggaacggttaagggtacggggggtaaggggggttgggtacggtaacggttccggtaagggg

SEQ ID NO: 256823 - DNA, 596 bp, Homo sapiens
  misc_feature: GYAE6OF02GY5U5.14.55.E11.1.454.CMB.1.raw
  modified_base (242)..(242): a, c, t, g, unknown or other
  misc_feature (242)..(242): n is a, c, g, or t
  modified_base (332)..(332): a, c, t, g, unknown or other
  misc_feature (332)..(332): n is a, c, g, or t
  modified_base (356)..(356): a, c, t, g, unknown or other
  misc_feature (356)..(356): n is a, c, g, or t
  modified_base (471)..(471): a, c, t, g, unknown or other
  misc_feature (471)..(471): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgacnctctctgtgcaacgtctggattcagtcttcagttagttatggcagtgctacgtgggtccgccgaggcctccgaggcgaaggggctagggngtgggtgctaggttgtgtggtagnggaacggtaagtaagtaaggaaagtgtcgccgacggccggtagaacgggccgattaccacctactcctacgaagacgaactaacttaccaaacaactattagttagtactcgtanacgtaaagtagaactacgacgtagagacgaccggaacggaacgacggtacgtagttacgtacgtttacgtaggttagtacgtaggtaggtaggtaggggtggggttaggtagtacgtacgtaggg

SEQ ID NO: 256824 - DNA, 650 bp, Homo sapiens
  misc_feature: GYAE6OF02HEYSE.14.55.E11.1.454.CMB.1.raw
  modified_base (303)..(303): a, c, t, g, unknown or other
  misc_feature (303)..(303): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgacactctcctgtgcaacgtctggattcagtcttcagtagttatggcagtgcctacgtggggtcccnccgaggtcctccgagggcgaagggggtctgggaggtgggtcggctaggttgtggtgggtatgggaacggtaaataagtaggtaaagtatacggacccgtacggccgtaggaacgggcgattccacctactctaccgagagaactaacttacccgaactaacacttagttagtactactgacgtaaagtagtaacttacgaccgtaggaacggtaccgaccggaacggaccgtaaccggtcgttacggttacgtttaacgtttaacggttacggttacggtacggtaaggtaaggtacgggttagggggtacggggggttacgggtacgggtacgttaccggtaaggg

SEQ ID NO: 256825 - DNA, 723 bp, Homo sapiens
  misc_feature: GYAE6OF02F773Y.14.55.E11.1.454.CMB.1.raw
tcagcgtctagtaccacgaccggtgctcgatttagcactcgcacgttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccggggggaggcttggtacgaggccgggggggtccctgacactctcctgtgcagcctcgaggtattctatttttacgcgaaatatgccatgagctcgggtccgccgaggcctaccggaggggaaggggcgtagggaggttgggtcctcgagacaatccgtaggttggtttaccgtaggtagggtaaagtacgtacgtttaccggaccggtcccgttaccgtcccggtacgggaaccggggtcccggtttaccctcccgtacttcccgtacccgaaggaacgtaactaaaccttacccgaaaacgtaaacctaaccttacttaacttttaccttactaaagttcggaactaacgtacccgtaagaaaacggtaacgaaacggaaccgacggggtacgttacggtttagtttttgtagtaagtaaagtagttaacggaagttacttaagtacgtaacttaacccgtaaggtttacggggtacggttacctttcgtaacgttggttacggtaccgggg

SEQ ID NO: 256826 - DNA, 601 bp, Homo sapiens
  misc_feature: GYAE6OF02ICEOO.14.55.E11.1.454.CMB.1.raw
  modified_base (302)..(302): a, c, t, g, unknown or other
  misc_feature (302)..(302): n is a, c, g, or t
  modified_base (344)..(344): a, c, t, g, unknown or other
  misc_feature (344)..(344): n is a, c, g, or t
  modified_base (365)..(365): a, c, t, g, unknown or other
  misc_feature (365)..(365): n is a, c, g, or t
  modified_base (392)..(392): a, c, t, g, unknown or other
  misc_feature (392)..(392): n is a, c, g, or t
  modified_base (568)..(568): a, c, t, g, unknown or other
  misc_feature (568)..(568): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtggggggaggcgtggtccagccgtgggagtccctgacactctcctgtgcaacgtctggattcagtcttcagtgtatggcatgcacgtcggggtccnccgagggcctccgagggcgaagggggtctggggaggttgggnggctaggttggtggtgggtanggaacggaaagttaagtaagaaagttnacggacccgacggccggtaggaacgggtccgagtccacctacttacctccgaagacgactaaacttaccaaactaactagttgttagtacttcgtacgataaatagaactacgccgtagaacgagaccggaggaaccgcggcttagttagtaacgttcgttggtagtcgaggtagnggttaggggaggggtggtagtacgtacgtaggg

SEQ ID NO: 256827 - DNA, 772 bp, Homo sapiens
  misc_feature: GYAE6OF02JN5IW.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggtttcctgttgctcttttaagaggtgtccagtgtcaggtgcagctggtggagtcgtgggggagcgtggtccagccgtgggaggtccctgaccactctccgtgtgcaacgtctggattcagcttcagttagtatggcagtgactacggtcgggtccgccgaggcctccgaggcgaacggggctagggaggtggggtggctagggttgtaggtggtagtggaacggtaaagtaagtaaggaaagtatcggacccgaggcccggtagggaaaccgggcccgtaagttacccacccgtatccgtacccgaaggtaccgaacgtaaacctttaccccgaaaacgtaactaacgttacggtttataaccgtcttaacggaacgttaaaacgtaggtaaaacgttaccggtaccgtaaggtaacgggaaccggtacccgggtaaaacgggtaacccggtaccgggtacggtttacgggttaaacggtttaaccggtttaaccggtttacgggttaccggttaaacccggttaaaggggtaaccgggtttaaggggttacgggggggggttaaaccgggggggtttcgggttaaaccgggtaaccgggttttaccccggggttaaaaggggg

SEQ ID NO: 256828 - DNA, 651 bp, Homo sapiens
  misc_feature: GYAE6OF02HUB0X.14.55.E11.1.454.CMB.1.raw
  modified_base (224)..(224): a, c, t, g, unknown or other
  misc_feature (224)..(224): n is a, c, g, or t
  modified_base (298)..(298): a, c, t, g, unknown or other
  misc_feature (298)..(298): n is a, c, g, or t
  modified_base (507)..(507): a, c, t, g, unknown or other
  misc_feature (507)..(507): n is a, c, g, or t
  modified_base (514)..(514): a, c, t, g, unknown or other
  misc_feature (514)..(514): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctcgaggtgccagatgtgacatccagatgacccagtctccatcctcctgctgcatctgtaggatacagagtcaaccatcacgttgccgggtcaagtcangactaattaagaacttatttaaaattggtaatacaacgtaagaaacaagggaaccgaccctcgaccttcaggtntccgtatcgtctgtactactccgtaagtttcgacgtaacgtcgggttccgggggttacccctacggtaacggtttaccgaggttacgggacctagggtcggaagttccgtaggggaacctaagtacctttacgaaccttccgtacgtaccgtacgactcgtaacctcgtaccgctaaccgtagtacgttattacgacctaacttacctntacgtanaactagtacgttacaccgtacccctgttacgttaccggaacggtacggaaccggtaacggcggaacacggtaccgaagtaacggtaactggcgttacctacggtcaacccggtattccgtacgtttcctacttaccg

SEQ ID NO: 256829 - DNA, 759 bp, Homo sapiens
  misc_feature: GYAE6OF02F9VOT.14.55.E11.1.454.CMB.1.raw
  modified_base (242)..(242): a, c, t, g, unknown or other
  misc_feature (242)..(242): n is a, c, g, or t
  modified_base (251)..(251): a, c, t, g, unknown or other
  misc_feature (251)..(251): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgacnctctcctgngcaacgtctggattcagtcttacgagttagttatggacagtgcctacgtcggggtcccgccaggtcctacccgaaggggccgaaagggggtccgttaggggacggttcggggtcggacgtagggtttggtggttagggttacgtacgggaaccgggtaaagtttaaacgtaaaggtaaagttagtaccggacccggtaaccggcccggttaaggggaaacggggtcccgtacgtttacccaacccgtaactccgtaccgaaggtaaccgaacctaaaccttacccgaaaactaaaccgttaagttacgtttacggttaaccttccgttaagtaacctaaaagttacggtaaacgttacggtacccttagggaacggtacgggaacccggtaaaccgggaacggtaaccgggtacttagggttacgttaacgttacggttaggttacggtaacgtaaggaggtaggttacgggggagggggttacggtaggtacggttaccggtaaggg

SEQ ID NO: 256830 - DNA, 573 bp, Homo sapiens
  misc_feature: GYAE6OF02HWYME.14.55.E11.1.454.CMB.1.raw
  modified_base (308)..(308): a, c, t, g, unknown or other
  misc_feature (308)..(308): n is a, c, g, or t
  modified_base (345)..(345): a, c, t, g, unknown or other
  misc_feature (345)..(345): n is a, c, g, or t
  modified_base (381)..(381): a, c, t, g, unknown or other
  misc_feature (381)..(381): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcctggggagtccctgacactctcctgtgcaacgtctggattcagcttcagtagttatggcatgcacgtggggccncgaggctccgaggcgaaggggctgggagtggatggcngttgtgaggtataggacggaaagtataagaaagttntcggaccgacgccggtaggaacgggccgtattaccacgtactctaccgagaacgaacaacttaccaaacaactatagttgtatcgtagactaaatagtaaatacgactaggagacgacgacggacgacggtcgtggttagttacgttacgttagtgtacgaggaggtaggtaggggtaggggggtgtacggg

SEQ ID NO: 256831 - DNA, 649 bp, Homo sapiens
  misc_feature: GYAE6OF02GBT6P.14.55.E11.1.454.CMB.1.raw
  modified_base (185)..(185): a, c, t, g, unknown or other
  misc_feature (185)..(185): n is a, c, g, or t
  modified_base (250)..(250): a, c, t, g, unknown or other
  misc_feature (250)..(250): n is a, c, g, or t
  modified_base (292)..(292): a, c, t, g, unknown or other
  misc_feature (292)..(292): n is a, c, g, or t
  modified_base (403)..(403): a, c, t, g, unknown or other
  misc_feature (403)..(403): n is a, c, g, or t
  modified_base (482)..(482): a, c, t, g, unknown or other
  misc_feature (482)..(482): n is a, c, g, or t
  modified_base (602)..(602): a, c, t, g, unknown or other
  misc_feature (602)..(602): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagctgggttttcctcgttgctcttttaagaggtntccagtgtcaggtgcagctggtgagtcgtgggggagcgtggtccagccgtgggacgtccctgacnctcctctgtcgcacgtctggattcagtcttcagttagttacnggacatgccagtcgggtcccacaggcctaccgaggaccggaggggcgtagggaggtgggtcgaccgtaggttgtagtgggtactgggaacggtaattaagaaggtaacgtntacgggaccgtacgcggtagggacgggtaccgtattcgaacctgttacctaccgaagactaaccgtaacttacccaaanaacgtattaggttacgatttaccgtaggaaactaaaggtcaaacgttacgacccgttaggaagaccggacccgggaagtacccggtacgtccgttaggttaacgttagttaccgttaggngttaccgaaggtcgttaacgggtgggggtacggggtcgtagtaacgg

SEQ ID NO: 256832 - DNA, 582 bp, Homo sapiens
  misc_feature: GYAE6OF02HEU2N.14.55.E11.1.454.CMB.1.raw
  modified_base (259)..(259): a, c, t, g, unknown or other
  misc_feature (259)..(259): n is a, c, g, or t
  modified_base (283)..(283): a, c, t, g, unknown or other
  misc_feature (283)..(283): n is a, c, g, or t
  modified_base (303)..(303): a, c, t, g, unknown or other
  misc_feature (303)..(303): n is a, c, g, or t
  modified_base (343)..(343): a, c, t, g, unknown or other
  misc_feature (343)..(343): n is a, c, g, or t
  modified_base (351)..(351): a, c, t, g, unknown or other
  misc_feature (351)..(351): n is a, c, g, or t
  modified_base (376)..(376): a, c, t, g, unknown or other
  misc_feature (376)..(376): n is a, c, g, or t
  modified_base (459)..(459): a, c, t, g, unknown or other
  misc_feature (459)..(459): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttggctgagctgggttttcctcgttgcttcttttaagaggtgtccagtgtcaggtgcagctggtggagtcgtgggggagcgtggtccagcctgggagtccctgacactctcctgtcgactacgtntggattcagtcttcagttagttanggacatgcacgtcgggtccncaggcctcgaggcgaaggggctgggagtgggtgctgttgnggtgtagngaacggtaataagtaaggaagtacngaccgagccgtaggaacggtcgatacacctatccacgagacgacaactaccaaacaactagttagttagtactacgtcgtaanaagtagtaactacgacgtacggaagacgaccggaagaccgtacgtcgtagttacgttacgttctaggtcgttaacgacggtagtaggtacgggggtagggttcggtacggtagtaccggtagg

SEQ ID NO: 256833 - DNA, 637 bp, Homo sapiens
  misc_feature: GYAE6OF02I5TVK.14.55.E11.1.454.CMB.1.raw
  modified_base (283)..(283): a, c, t, g, unknown or other
  misc_feature (283)..(283): n is a, c, g, or t
  modified_base (557)..(557): a, c, t, g, unknown or other
  misc_feature (557)..(557): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtggtggagtcggtgggggaggtcggtcggtccagccgtgggtacggtccctgactacgtcctccgtgtcgctaacgtctggacttcngtcttcgagttagttagtgacacgtgcacgtggtccgcgaggtcctcgaggcggaacggggctgggtacgtgggtcgcgtaggttggtggtggtagtggaacggtaagtaataaggtaatagtcggtaccgacggcgtaggacgggccgtattacaaccatccgtacagacgactaacgtaccaactaacgtattagttacgtacttacgtacgtaactaaacgtagtaactacgtaccgtaggacggacgaccggaaacggaccgaccgggtntaggttacgttacgttagtacggttagtacgtagagttacgggtaggggtagggttacggagttacggtaccgttaaggg

SEQ ID NO: 256834 - DNA, 786 bp, Homo sapiens
  misc_feature: GYAE6OF02IRXB4.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacgtccctgacactcctcctgtgcaacgtcgtggtacttcgacgtcctttacgagttaagttagtggctatcggctacgtcgggtccccgccgagggccctaccgagggcgaaggggtctaggggtaggtcggggtggcgtaggtttggtggttgggtaagtacggtaaggaaagtttaacgtaaaggaaaacggttagtacggcccggtaaccggtcccggttaagggaacggggtcccgtaacgtttaccgtaaccctaacgttccctaacccggtaacggtaaaccggtaaaccgtaaaccgttttaaccccaaaacgtaaaacccgttaagttttaccggtttacggttaaccgtttacgttacgtaaaccgtaaacgttaacggtaaacgttaacggtaccgtagtaaccgggaacgggtacccggaacgggaccgtacgggttaccgttacgggttagttaacgtttacgttacgttaggtaaccgtaaggtagggttacggtaagggggttacgggggttagggtacggttacggttacggtaacggg

SEQ ID NO: 256835 - DNA, 619 bp, Homo sapiens
  misc_feature: GYAE6OF02FJ45X.14.55.E11.1.454.CMB.1.raw
  modified_base (226)..(226): a, c, t, g, unknown or other
  misc_feature (226)..(226): n is a, c, g, or t
  modified_base (320)..(320): a, c, t, g, unknown or other
  misc_feature (320)..(320): n is a, c, g, or t
  modified_base (382)..(382): a, c, t, g, unknown or other
  misc_feature (382)..(382): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggacaagtcagngcattaagaactaattaaattggtatcaacagaaaccagggaaacgacccctaggaccctcctgtatctatgctgacactcctagtttgcacgnggtcgggggtccctcgtaacggttcaggtcggacagtggactcgtagggacagtactttacncgtcctcacccgtcaagctagtccgtgacctaaacccgtagtaaacgtttacttttacggaaccttaaacgtttaccttaacgtacgtaccaaagtacgtacgtttaaccaccgttaccccctcgttaccgttaccgggacggaccgggtaacaacgggacggtacgactacgacggaaccgtaagtcgtagggtacctagccgaaccgtacttacgttccgttacgttactacccg

SEQ ID NO: 256836 - DNA, 562 bp, Homo sapiens
  misc_feature: GYAE6OF02H4YDX.14.55.E11.1.454.CMB.1.raw
  modified_base (296)..(296): a, c, t, g, unknown or other
  misc_feature (296)..(296): n is a, c, g, or t
  modified_base (326)..(326): a, c, t, g, unknown or other
  misc_feature (326)..(326): n is a, c, g, or t
  modified_base (362)..(362): a, c, t, g, unknown or other
  misc_feature (362)..(362): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgaccactctcctgtgcaacgtctggattcagcttcagtagttatggcatgcactgggtccncaggcctcaggcgaaggggctggagtgggngctagttgtgtggtatgaacggaagtataggaaatngccgagccgtaggaacgggcgattcaccatcctcagagactaattcccaaactaacagtgttagtactctagacaatagaatcgcctggaagtacgaccggaggacgaccgggcttaggtacgttacgttactggttacgtacgaaggtaaggtacggtagggggtacggggggttaggtacggtacgtaccggtaaggg

SEQ ID NO: 256837 - DNA, 557 bp, Homo sapiens
  misc_feature: GYAE6OF02HX6QP.14.55.E11.1.454.CMB.1.raw
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
  modified_base (376)..(376): a, c, t, g, unknown or other
  misc_feature (376)..(376): n is a, c, g, or t
tcagcgtctagtaccacgaccggtgctcgattttagcactcgcacgttgggctctgggagaggagcccagcactagaagtcggcggtgtttccattcggtgatcagcactgaacacagaggactcaccatggagtttgggctgagctgggtttttcctcgttgcttcttttaagaggtgtccagtgtcaggtgcagctggtggagtcgtgggggagcgtggtccagccgtgggacgtccctgaccactctcctgtcgcaacgtctggattcagcttcagtagttanggcatgcacgtggggtccncaggctaccgaggcgaaggggctgggagtgggtgctaggttgtgtggtatgacggtaagtaatagaaagtncgcgacggcgtaggacggctataccacatcacagacacaactaccaaacaacacgttgttagtatctacgtacaaatgaaatacgcctagagacgacggagacgacgcttaggtcgtaacttctaggtacgtcgaagtaggaggtaggggtacgggttgggtaacggtacgtacggtaagg

SEQ ID NO: 256838 - DNA, 707 bp, Homo sapiens
  misc_feature: GYAE6OF02IGKGF.14.55.E11.1.454.CMB.1.raw
  modified_base (159)..(159): a, c, t, g, unknown or other
  misc_feature (159)..(159): n is a, c, g, or t
  modified_base (176)..(176): a, c, t, g, unknown or other
  misc_feature (176)..(176): n is a, c, g, or t
  modified_base (314)..(314): a, c, t, g, unknown or other
  misc_feature (314)..(314): n is a, c, g, or t
  modified_base (318)..(318): a, c, t, g, unknown or other
  misc_feature (318)..(318): n is a, c, g, or t
  modified_base (331)..(331): a, c, t, g, unknown or other
  misc_feature (331)..(331): n is a, c, g, or t
  modified_base (346)..(346): a, c, t, g, unknown or other
  misc_feature (346)..(346): n is a, c, g, or t
  modified_base (448)..(448): a, c, t, g, unknown or other
  misc_feature (448)..(448): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccagtggagtttgggctgagcgttgggttttccncgttgcttactttaagnggtcgtaccagtgtcgaggtgcagcgtggtggagtcggtagggggacgtcggtggtccagtccgtgggtaccggtcctaggactccgtctccgttgcgacacgttcgtggatcagctttacgagttagttgtcggctntcgngtacgtggtaccnccgacgtcacgcggngaacggggtctggaggttgggcgtgtaggttgtggtggtaaacgtggaacgtaaaggtaaagtaacggtaaaagtgtaccggaccggacggtccggggtaanaacgggggtccgtaagtttccgaaacgtcttaccggtaaccgagtaaaccgaaattacctaaaccggaaacctaacttacggtttagttacgttactaccgtggaacctaaagtaagtaacgttaaccgacgtaaggaagtaacccgggacggaacgtacgtacgtcggtagttcggttaaacgtttcgaagttaggtccgttaaggagggtaggacgggggttaacggggagttaacgttacgggtaccgttaagggg

SEQ ID NO: 256839 - DNA, 806 bp, Homo sapiens
  misc_feature: GYAE6OF02HI0HS.14.55.E11.1.454.CMB.1.raw
  modified_base (180)..(180): a, c, t, g, unknown or other
  misc_feature (180)..(180): n is a, c, g, or t
tcagcgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagcggtggtttcgcgtaggcgtcttaagaggtntccagtgtcaggtgcagcgtggtggagtcgtgggggaggcggtggtaccaggcccgttgggggacgtccccgttaggaaccaccttcctcccgtaggtcgtaccaaacggtctgggtattcgagtcctttcgaaggttaacgtttagtagggctaagtcggaaccgtacggtccgggggttccccacccgaaggggtccctaccggacgggaccggaaggggccgtgggggtagggttgggtacgggtacgttagggtttgggtacggttgggtaacgtaagggtaaacgggttaaagttaaacggtaaaggtaaaacgttacggtaccggaccccgggtaacggtaccccgggttaggggaacccgggtcgtaaccttaccgacctaacgtccgtaacgaacgaacgtaacctaactaacctaacgaaacgttcgtttacgttactacgttaccgtacgtaactaaagtacgtaagtaccgacgtaggtaacggtaaccggtaaccggacggtaaccgtaccgggtacgttcggtttagtttaacgttcgttaggttacgtaaccggtaaggtaggttacgggttagggggttaacggggttcggtaggttaacggtacgttagg

SEQ ID NO: 256840 - DNA, 679 bp, Homo sapiens
  misc_feature: GYAE6OF02GJ94J.14.55.E11.1.454.CMB.1.raw
  modified_base (244)..(244): a, c, t, g, unknown or other
  misc_feature (244)..(244): n is a, c, g, or t
  modified_base (253)..(253): a, c, t, g, unknown or other
  misc_feature (253)..(253): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtccctgacnctctcctgngcaacgtctggacttcagtcttcagttagttagtggctatcggctacggttcggggtcccgccgacggccctccgagggaccgaagggggtctagggaggttggggtcggcgtaggtttggtaggttgggtaagtagggaacgggtaaagttaagtaaaggtaaagtacgtcggacccggtacggaccggttagggaacgggtcccgtacttaccgacctacgtcctaccgagaacgtaactaactaccaaactaactagttagttagtactacgtagaacgtaatagaacgtacgtacctaggacgtacgaccggaacggaaccgtacggtacgttcgttagtttaacgttacgttaggttacgtacgtaaggtacgggtaagggttcgggggtaggggttcggtaggtacgtaccggttaaggg

SEQ ID NO: 256841 - DNA, 613 bp, Homo sapiens
  misc_feature: GYAE6OF02HKEWY.14.55.E11.1.454.CMB.1.raw
  modified_base (298)..(298): a, c, t, g, unknown or other
  misc_feature (298)..(298): n is a, c, g, or t
  modified_base (350)..(350): a, c, t, g, unknown or other
  misc_feature (350)..(350): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtgtccagcctgggacgtccctgacactctcctgtgcaacgtctggattcagtcttcagtagttatggcagtgcacgtgggtccnccgaggcctccgaggcgaacgggggctagggaggtcgggtggcaggtttggngtgggtatggaacggtaagtaaacgtaggaaacggttagcgtacccgacgggtcccgtagggaacgggtcccgtaagttccgaacctatccgtaccgaacgtacgaactaactttacccaaacaaccttagtagttagtactcgtagactaaagtagaaactacgctaggagacgccggaggacgacgggtctagtagttacttacgtggtagtacgtagaaggtaggtacgggtaggggttaggacggttacgtcgtaaggg

SEQ ID NO: 256842 - DNA, 623 bp, Homo sapiens
  misc_feature: GYAE6OF02H9KYX.14.55.E11.1.454.CMB.1.raw
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagcttgggttttcctcgttgcttctttttaagaggtgtccagtgtcaggtgcagctgggtggagtcgtgggggaggcgtggtccagccgtgggacggtccctgacactctcctgtgcaacgtctggattcagcttcagttagttatggcatcgcacgtgggtcccgccgaggcctaccgagggaccgaagggggctgggagtggggtgcgtaggttgtggtggtataggaacggtaaagtaataggaaagtgtcgaccgacgccggtaggaacgggcctattaccgaccactctaccagaacgactaacttacccaaactaactattgttagtactactagtaactaaagttgaaatacgcgtagacgacggacccgaagggaccgacgggtcttaggtacgttaacttacgttcggttacgtacggaggtaacggtaggttaggggggtagggggttcggtgtaacccggg

SEQ ID NO: 256843 - DNA, 682 bp, Homo sapiens
  misc_feature: GYAE6OF02I6Y3I.14.55.E11.1.454.CMB.1.raw
  modified_base (165)..(165): a, c, t, g, unknown or other
  misc_feature (165)..(165): n is a, c, g, or t
  modified_base (182)..(182): a, c, t, g, unknown or other
  misc_feature (182)..(182): n is a, c, g, or t
  modified_base (201)..(201): a, c, t, g, unknown or other
  misc_feature (201)..(201): n is a, c, g, or t
  modified_base (306)..(306): a, c, t, g, unknown or other
  misc_feature (306)..(306): n is a, c, g, or t
  modified_base (370)..(370): a, c, t, g, unknown or other
  misc_feature (370)..(370): n is a, c, g, or t
  modified_base (566)..(566): a, c, t, g, unknown or other
  misc_feature (566)..(566): n is a, c, g, or t
tcagcgtctagtaccacgaccggtgctcgatttagcactcgcacgttgggtttggggagcgtctgggagaggagcccagcactagaagtcggcggtgtttccattcggtgatcagcactgaacacagaggactcaccatggagtttgggctgagctgggtttccncgttgcttcttttaagnggttgtccagtgtcaggtncagtctggtggagtcgtggggggacgcgtggtccaggcccgtggggacggtccctggaccactcgtcctgtgcaacgtctggatttcgagtcttcagtagtttanggcagtgccacggttcggggtcccgacctagggccctaccgagggtcgaacgggggctaggggnggttgggcggtcggtggtttcggtggttgggtactgggaacgggtaaagttaagtaaggaaacggttactcggacccggtaacgggccggttaggaacggggtccggtaacttcccgaaccgtaatccgtacccgaaggtaacgaactaacgttacccaaactaactacgtttgttacgtaattctcggaactaanacgtaaatagcccgagtaacggcgaacccggaggtaccgacggtcgtttaggtaacgttattacggttgtacgtcggaagtacgggtggtagggggtagggggtaggtctaacggg

SEQ ID NO: 256844 - DNA, 761 bp, Homo sapiens
  misc_feature: GYAE6OF02FZM2P.14.55.E11.1.454.CMB.1.raw
  modified_base (317)..(317): a, c, t, g, unknown or other
  misc_feature (317)..(317): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgcttcttttaagaggttgtccagtgtcaggtgcagcgtggtggagtcgtgggggagcgtggtccagccgtgggagtccctgacactctccgtgtgcctaacgtctggtattcgagtcttacagttagttatggctatcggctacgtcggggtcccnccgaggtcctaccgagggaccgaagggggctagggaggttgggtcggactaggtttggtcggtaggtaactggaaacggtaaagttaaagtaaggtaaaagtcgttcggacccgtaacggtcggttaagggaaacgggtcccggtaacgtttacccgaacccgtacgttacccgtacccgtaagtaaaccggtaaacctaaaccgttaacccgaaaaccgtaaaccgtaagtttacggtttacgttaacgttaccgttacggtaaacctaaagttaccgtaaacgttaacgtacccgttaggaacggtaccgggaaccggtaagggaaccggtaacggttacgtttacggtacgtttaacgtttacggttacggttacggtaacgaaggttaacggtaggttacggggggtacggggttaggtacggtacgggttccgtaaggg

SEQ ID NO: 256845 - DNA, 727 bp, Homo sapiens
  misc_feature: GYAE6OF02JOKRU.14.55.E11.1.454.CMB.1.raw
  modified_base (171)..(171): a, c, t, g, unknown or other
  misc_feature (171)..(171): n is a, c, g, or t
  modified_base (305)..(305): a, c, t, g, unknown or other
  misc_feature (305)..(305): n is a, c, g, or t
  modified_base (362)..(362): a, c, t, g, unknown or other
  misc_feature (362)..(362): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggtttcctcgttgctcttttaagnggttgtccagtgtcaggtgcagctaggtggagtcgtgggggagcgtggtaccagccgtagggacgtccctagacctcgtctcccgtggtacgaccaacggttcgtggtacttcgacgtcttcgagttagttcgnggcagttcgcacggttggcccacgcggctccgaggtcgaaggggctgggagttgggngtacagggttgtaggtcggttaatggaacgggtaagttaagtaaggaaacggttgacgtacccggtacggcgttaagggaacgggtccgtattacccaacgtactcgtacgtaacgagtaactacgtaacctaaataaccgtagttacgttacgtaacttcgaatacggtaaaacgtcggtaaactacggtaccgtaaggaacccggttacgggaacccgttaaacgggacctaccggggttactagggttttagttaaaccgtttaccggtaagggttttcccggaacggaaaggttaccggggttaaacggggtacggggttaccggggggttaaggtcccgtttacgacccgggtttaaagg

SEQ ID NO: 256846 - DNA, 728 bp, Homo sapiens
  misc_feature: GYAE6OF02F4SJA.14.55.E11.1.454.CMB.1.raw
  modified_base (282)..(282): a, c, t, g, unknown or other
  misc_feature (282)..(282): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgacactctcctgtgcaacgtctggattcagtcttacagtagttanggcatcggcacgttcggggtcccgccgaagggcctaccgaagggccgaaaggggggtctgggacggtggggtaggctaaggttcggtggtaggtatggaaacggtaagttaaagtaacggtaaaagtagtcggacccgaacggtccggtagggaaacgggtccggtaattaccgaaccctacttaccgccgtaaggaacgtaacctaaactttaacccgaaaacctaaaccgaagtttacggtttaagttaacttaccgttaggaacctaaaagtacggtaaaacttacggtaccgtaggaacggaacggaccggtaaagggaacccgtaagggtccttaggtttaacttaaggtttaacccgttagttacggtaaccgtaaggtaaacggtagggttaggggggtaagggggtttagggacggttaacggttaccggtaacgggg

SEQ ID NO: 256847 - DNA, 814 bp, Homo sapiens
  misc_feature: GYAE6OF02GFZTG.14.55.E11.1.454.CMB.1.raw
tcagcgtctagtaccacgaccggtgctcgatttagcactcgcacgttgggtttgggggctctgggagaggagcccagcactagaagtcggcggtgtttccattcggtgatcagcactgaacacagaggactcaccatgggagtttgggctgagcttgggtttttccctcgttgcttacgttttaaggaggttcgtccagttcgtcgagggtgcgaggtcgttgggtggtaggttcgggtagggggggacggtcggtcgggtacccgaggtcccggttggggtaccggttcccccgtaggaacctaccgttccgtccgttaggtcgaccgtaacggttcgtaggtactttaccgacgttcctttacgtaaggtttaaggttagcggtacctagttcggaccgtaccgggttccggggtccccaccggacgggtccctaccggagggacggaacgggggtcgtaggggtacgggtggggtcggacgttaggttggtaggttagggtagtacggaaacgggtaattaaggtaaaggtaaacgtgtaccggtacccggaccgggtccggtaagggaaccggggtaccgttaacttacccgaaccgtacgttacccgaccggtaaagtacgtaaacctaaccgttaacccgaaacttaacgtacgtttagttacgtaacttccgtaagaacgttaaagtacggtaacgtacgtccgaaggaacgtacgaccggaacgaccgtacgggtcttaggtacgtttacgtacgttggtacgtagaggttaggtcggtagggggtagggtcggtagtcggtacgg

SEQ ID NO: 256848 - DNA, 712 bp, Homo sapiens
  misc_feature: GYAE6OF02GED2C.14.55.E11.1.454.CMB.1.raw
  modified_base (160)..(160): a, c, t, g, unknown or other
  misc_feature (160)..(160): n is a, c, g, or t
  modified_base (179)..(179): a, c, t, g, unknown or other
  misc_feature (179)..(179): n is a, c, g, or t
  modified_base (185)..(185): a, c, t, g, unknown or other
  misc_feature (185)..(185): n is a, c, g, or t
tcagcgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagcgtggtttccncgtagctctttaagaggtntcagtntcagtgcagcgtggtggagtcgtgggggagcgtggtccagccgtggggagtccctgactactctcctgtgacgtaacgtctaggtacttcagtccttagaaggttagttagtggactagttggcctacggttcggggccccgaccgtacgggtcctaccgagggtacggaagggggtccttaggggagggttcggggtcggacttggtttggtggtggtacgtacggaagggtaagtaaagtaaggaaagtagtcggaccggtacgtaccggtagggaaccgggtccgtaacgttaaccaccgtaagtcctacccgaaggtaaacgaaaccttaacgttaacccaaaacgtaaccgttagttacggtttaactacgttacgttacgaaacgtaaacttacggaaattaccggtaccgtagaacgtaccggacggtacgaaccgtacgggtcttagttacgtaacgttcgtaggtactacgtaggaacggtggtaggggggtacggtggacgttaccggtaggtaagg

SEQ ID NO: 256849 - DNA, 789 bp, Homo sapiens
  misc_feature: GYAE6OF02JPHO4.14.55.E11.1.454.CMB.1.raw
  modified_base (156)..(156): a, c, t, g, unknown or other
  misc_feature (156)..(156): n is a, c, g, or t
  modified_base (246)..(246): a, c, t, g, unknown or other
  misc_feature (246)..(246): n is a, c, g, or t
  modified_base (255)..(255): a, c, t, g, unknown or other
  misc_feature (255)..(255): n is a, c, g, or t
  modified_base (288)..(288): a, c, t, g, unknown or other
  misc_feature (288)..(288): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttccncgttgctcttttaagaggtgtccagtgtcaggtgcagtcgtggtggacgtcgtgggggagtcggtggtccagccgtgggagtccctgacnctctcctgngacactcgtggattcagtcttcaggtacgttancggctagtcgacgacggtcgggtcccgccgaggccgttaccagggcggtaacggggcctgggtaggttcgggtactcggaggaccgttaagtccgtagggtttcggttacgtagggtggtaaacgttacgaagttcccgggacgtccccggttcgtacgggtacgggtaccggggtcccggttccgtacgtacttccggtaccgaacggtaacgaacgtaaccgttaccgaaacgtaacctaccgtttaccgtttaaacttttccgttaacgtaaacggtcggtaacgtaacggtacccgttaaaggaaaaccgggttaaccggaaacggtaaacccggttaccggggtaacggtttcggtttaacggtttttaggttcgggttaaacggttaaggttaaacggttaacggttaaaccggttcgttaacggtaaccgttaaccggtaacccggtttaaggtttaccgggggttaccgggtttaccgttttacgggtaacgg

SEQ ID NO: 256850 - DNA, 876 bp, Homo sapiens
  misc_feature: GYAE6OF02JGDR8.14.55.E11.1.454.CMB.1.raw
tcagcgtctagtaccacgaccggtgctcgatttagcactcgcacgttggggtttggggagtctcagtcaggacacagcatggacatgacgggtccccgctcagctccgtgggctcctgctactctggcgtccgaggtgccagatgtagacactccagatcgaccacgtcctcctactcctcctcgtctcgcactcgtagtaggagacgagacgtacacactacgtacgtacggtaccggacgacgtacgacggaacgcaagttaaacgtaaacgttaaacgttttaaaaacgtttaaggttaaacgttacctaaacggtaaacgtaaaacccggtaaacggggtaaaaccggtaaccccgtaacggtaaacccgttacccgttaacggtaaccgttaaccgttaacgttacggtaccgtacgtaccgtaaccgttaccgttaacggtttacgtacctaacgtaacggttaccggggttacccggtaacgtaacgggttaccgtacggtacgggtacgtaacggtacggtaacgtacggtacgggtaacgtaacggttaacgtttaaccgtaaccgtaccgttaccgtaaccgtacgtaacggtaccgtacgtacgtacgtaaccgtaaccgtacgtaacgttaacgtttacgtaacgtaaaccgttaacgtaacgttacgttaacgtaacgtaacgtaacgttaaccgtaacccgttaaccccgttaacctacgttaccggtacggtaccggtaaccggtaccggtaacggtacgtaacggtaaccggtaaccggtaaaccggtaaccggttaacggttaacggttaaccggttaaccggtaaccggtaacccgtaaccggttaccggttaaccgg

SEQ ID NO: 256851 - DNA, 784 bp, Homo sapiens
  misc_feature: GYAE6OF02FF8IR.14.55.E11.1.454.CMB.1.raw
  modified_base (180)..(180): a, c, t, g, unknown or other
  misc_feature (180)..(180): n is a, c, g, or t
  modified_base (252)..(252): a, c, t, g, unknown or other
  misc_feature (252)..(252): n is a, c, g, or t
  modified_base (315)..(315): a, c, t, g, unknown or other
  misc_feature (315)..(315): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagctgggttttcctgttgctcttttaagnggtgtccagtgtcaggtgcagctggtggagtcgtggggggagcgtggtccagccgtggggacgtcctagacnctctcctgtgcacgtctggattcagtcttcgagttagttatggcagtgccacgtcggggtccnccgaggcctccggagggcgaaggggtctagggaggttgggtggctaggttggtcggtggtacgttgggaaacgggtaaagttaaacgtaaagggtaaaacgttagtaccgggacccgggtaaccggtacccgggtaagggaaaccgggggtaccgtaaactttacccgaaacccgttaccgttacccgtaacccgaaagggtaaccgtaaaacccgtaaacctttaccccgaaaaacgtaaaccgttagttaacggtttaacgtaaccgttaccgtaacggaaaccttaaaaggtacgttaaacttaccgggtacccgttaaggaaaccggtaacggaccccgggtaaagggaacccgttaccgggtacgtacgggtttaacggttaacctttaccgggtgttaccggtaacgtaagggtaacgggtaagggttcgggggggtaagggggttcggtaaccggttaacgg

SEQ ID NO: 256852 - DNA, 898 bp, Homo sapiens
  misc_feature: GYAE6OF02G00KD.14.55.E11.1.454.CMB.1.raw
  modified_base (818)..(818): a, c, t, g, unknown or other
  misc_feature (818)..(818): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagtcttgggttttcctcgttgcttcgttttaaaggaggttcgtccgaggttgtcgtaggtcgcagtcgtgggtggagttcggtaggggggaggtcggtcggtccaggtccggtggggacggttccccgtggaacctacgttcctcccgtaggtcgtaccgtaaccggttcctcgggtaactttccgaacggtctttacgaggttaagttacgtgggcaagtcgaccgtacggttcggggtccccgaccggaacggtccctaccgggacggtacggtaaacggggggtccgtaggggtaaggggtttcggggtccggaacggtttacgggtttgggtacgggtttacgggtaaacgttcgggggaaaacggggttaaaaagtttaaaggttaaaacgggttaaaacggggtttacggtaccgggtaaacccccggggtaaccgggtcccgggttaaagggggtaacccgggtacccgtttaatttaccccggaacccttaacgttaccggtaccgaaaaggtaaccggttaaaacccttaacggttaaacccgaaccgtaaacgttaacggtttcggtttaacgggtaccttacgttaacgaaactaaggttaacgaacgtttacgcccgtaagtacggaaacggtccgaaaggacccgtacgggtcttacgggttntaacggtttgtacggttacgaaccggtaagccgggttagggtacggggtgggttaccgggtacgtacggtaacggtaagg

SEQ ID NO: 256853 - DNA, 696 bp, Homo sapiens
  misc_feature: GYAE6OF02HWNYK.14.55.E11.1.454.CMB.1.raw
  modified_base (372)..(372): a, c, t, g, unknown or other
  misc_feature (372)..(372): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggagcgtggtccagccgtgggacgtccgtagactacctctccgtgtcgacaacgtctggtacttcgagtcttcgagttagttagtggactagtgcctacgtcgggtcccgacgacggcctccgaggccgtaaggggcgtgggaggtcgggtggngtagttggttggtagtagtagacgggtaaagtaagtaacggaaagtagtcggaccgtacggtccggtaggaaccgggtacgtacgttaccgtaccgtactccgtacgaacgtacgaacgtaaccgtaaccaaaccgtaaacgtaagtacggttacgttacgtacgtacgtacgtaaataacgtaacgtagtaccgtacgtaggaacggtttacgacgggtaaccgacggtacgttacggttacggttaacgtttaccgtaggttacgtacggtaaggtaggtagggtacggggttaggggttagggtaggtacggttaaccggg

SEQ ID NO: 256854 - DNA, 760 bp, Homo sapiens
  misc_feature: GYAE6OF02JC71N.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttggctgagctgggttttcctcgttgcttctttaagaggtgtccagtgtcaggtgcagcgtggtggagtcgtgggggagtcgtggtccagccggtgggacgtccctgacacgttcctccgtgtgacctaacgtctggattcgagtcccttgtaggtttagttagtggctagtcggctaacggttcggggccctccgaggtcccacccggaggacggaacgggggtccgtaggggacggtgggggtgtccgttagggttgtggtaggtacggtaggaacgggtaaagttaacgtaaaaggaaggttacgacgggtacccgaacgggttaccggaagggaaccgggtaccggtaactttccgaaccgttactaccgttaccgaaggtaaacgtaacgtaaaccgtaccaaaaccgtaaccttagttacgttagttaaaccgtcgtacgtaacgtaaagtaacgtaaacgtaccgtacgtaacggaacgggtaccgaaccgggaacggtaaaccggtaccggtagttacggtaactttaacggttaccgtttaggtaacgttaacgacggttaaacgggtagggttaggggaccgggggttggtaacggtacggttaacccgtaagggg

SEQ ID NO: 256855 - DNA, 670 bp, Homo sapiens
  misc_feature: GYAE6OF02JEOA6.14.55.E11.1.454.CMB.1.raw
  modified_base (251)..(251): a, c, t, g, unknown or other
  misc_feature (251)..(251): n is a, c, g, or t
  modified_base (317)..(317): a, c, t, g, unknown or other
  misc_feature (317)..(317): n is a, c, g, or t
  modified_base (382)..(382): a, c, t, g, unknown or other
  misc_feature (382)..(382): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgaccnctctcctgtgcaacgtctggattcagcttcagttagttatgggacagtcgctacgtcggggtcccnccgagggtcctaccgagggcgaagggggtctggggagtgggggtggcaggtttggtggtggttanggaacggaagtaataggaaagtagtcggccggacggccggtagggaacggggcccgtaatttccgaacctacgtaccctaccgtaggaacgaacctaacttaacccgaaactaactacgttagtttactacgttcgtacgtactaaagtaggtaactacggtaccgtagtaacgggacgacccgggaacggaccgaccgggtgttaggtacgttaacttaccgttggtacgttacgaaggtaacggtagggttggggggacggggtttggtacggtagttaacccggg

SEQ ID NO: 256856 - DNA, 707 bp, Homo sapiens
  misc_feature: GYAE6OF02F4R0E.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactaatttaaattggtatcaacagaaaccagggaacgcccctgacctcctgatctatgctgcactccagtttgactacgaggttcgggggtcccgttacgtaacggttacgaaggttcgggacgtaggtgggtaacgttcggtacgggaacgtaagttacttttaccacctcgtaccgtacccgtcgtacggccgtaacgttccgtacgtacccgtaaccgttaggtaaacgttacggtttttacaccgttaaaaccttttacttaaccgttacgtaacctaaacgtacggttaaacgtttaaccgaacccgttaaccccccgttcgtaaccgtttccgggacgggttaaccggggaaacccgaaggggtacgggaacggtacgtacgaacggtaaccggtaaacgttcgggtcggtcccgtacggtaacccgtacgtaccgttcggttaccggtttacgtacccgttacccg

SEQ ID NO: 256857 - DNA, 796 bp, Homo sapiens
  misc_feature: GYAE6OF02F5XN8.14.55.E11.1.454.CMB.1.raw
  modified_base (239)..(239): a, c, t, g, unknown or other
  misc_feature (239)..(239): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgctcttttaaggaggtgtccagtgtcaggtgcagctggtgagtcgtgggggagcgtggtccagccgtgggacgtcccngaccactctccgtgtcgactacgtctggtattcagtcgttacagttacgttagtgactacgtgaccgtacgtcggggttacccgccgtaacggccgttaccggaacgggtccggaaagggggtcgttaggggtaagggttcgggggtggtccgtagggtttcggtacggtttggtagtacggaaacggtaaaaggttaaagttaacggaaacgttagtcgggacccggtaaccgggtcccgtaaggggaaccgggtaccgtaacgttaccgtacctaacgttacccgtaccgaacggtaacctaaacgtaaaccttaacccaaacgtaaacgttagttaccggtttagttactaccgttagaaccttaaaaggtaacgtaactaacggtacgtaagggtaccgaaacgggacccggtaagggaaccgtacgggtacgttaccgggttaagttaccgtttacggttaacggttcgttaaacggtaaccggtagggttaaggggttacggggggtaacgggtttcgggttacgggttaacccgttaccggttaaagggg

SEQ ID NO: 256858 - DNA, 658 bp, Homo sapiens
  misc_feature: GYAE6OF02FSQQV.14.55.E11.1.454.CMB.1.raw
  modified_base (304)..(304): a, c, t, g, unknown or other
  misc_feature (304)..(304): n is a, c, g, or t
tcagcgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctggggttttcctcgttgctcttttaagaggtgtccagtgtcaggtgcagctggtggagtctgggggagcgtggtccagcctgggagtccctgacactctcctgtgcaacgtctggattcagcttcagttagttatggcagtgcacgtgggtccnccgaggctccgaggccaaggggctggaggtgggtggctaggttgtggtggtatgggaacggtaagtaataggaaagtagtcgcccggtaacggccggttaggaacggggtcccgtattaccgaacccgtatcccgtaccgaaggacgaacctaaacttcccaaaactaaaccgtagttacggtttacggttacttaccgtaggaacctaaaagttacgtaaagttacgtacccgtaggaacggaacggtaccgggaacggtaccgaaccgggtcgttcggttagtactttaacgttggttacgtacgtaggtaaggtaggtgggggtagggggttggtagtacgtcggtaacgg

SEQ ID NO: 256859 - DNA, 715 bp, Homo sapiens
  misc_feature: GYAE6OF02JOQI5.14.55.E11.1.454.CMB.1.raw
tcagcgtctagtaccacgaccggtgctcgatttagcactcgcacgttgggtttggggagtctcagtcaggacacagcatggacatgagggtccccgctcagctcctggggctcctgctactctggctcgaggtgccagatgtgacatccagatgacccagtctccatccctcctgtctgcatctgtaggagacagagtcaccatcacgttggccggacagtcgagacgctaattaagaacttaatttaaagttggtaactacaacgaacgaaaccgtaggaaaccgtccccgtagaccctacgtacgtactactacgtacgtcctacgctaacttccgtagtttcgactaccgtacgggttaccgggttacccgtacgttaacggttacgtaggtcggtacgtaggtacggtacggttcggtagggtaacgtagtttacttaccgtaccgttccgtacgtacccgttacgacgtccgtaacggttcctcggtaacctaacgtacgttaaagttacgttttaccgtaacgttaacgtttaccgtaacgttaccgtactaaaccgtacgttaacgttacccgtacccgttacccctacgttacggttaccggaccgggtaacggaacgtacgggtacgacgtacgtaccgaacggtaacgtacggtacggtacgtacgtccgtacgccgttagttccgttacgttccgtactacccg

SEQ ID NO: 256860 - DNA, 933 bp, Homo sapiens
  misc_feature: GYAE6OF02I6VDR.14.55.E11.1.454.CMB.1.raw
  modified_base (156)..(156): a, c, t, g, unknown or other
  misc_feature (156)..(156): n is a, c, g, or t
  modified_base (209)..(209): a, c, t, g, unknown or other
  misc_feature (209)..(209): n is a, c, g, or t
  modified_base (310)..(310): a, c, t, g, unknown or other
  misc_feature (310)..(310): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcgtggttttccncgttagcttcgttttaagaggtgtccagtgtcaggtgcagctggtggagtcgngggggagcgtggtccagtccgtgggacgtcccgtggaccacttcgccgtagtgaccaaccggttctggtactttcgaggtcctttacgagttacggttacngggtccaaggtttcgtaccgtaaccggttcgggggtccccgtaaacccgtggggtaccccttacccgggaagggtacccgggtaaacggggggttcccttcgggggaaacgggtttgggggggttccggggtaacccctttaaggggttggttccgggttaggggtaaccgttacgggggtaaacccggggtaaaggtttaaaacgttaagggtaaaaaccgggtttggttacgggaacccccggggttaaaccgggccccggggtttaagggaaaacccggggggttccccttaaggttaccccgaaacccggttacgttaccggttaccccgaaggtaaaccggtacccttaaaacggtttacccccgaaacgtaacccggttagtttaacgggtttaccttaagtacgttaccgtaacgtaaaacggttcaaaacgtttacggtcggttaaacgggtcggtaaaccggttacccgggacggttaacggtaacccgggttcgttacggttaccggtttaacgggtttaacccttcgggtaacggtttaaccggaaaggttcggggaacgtttacgggggggtaacgggtttaacggtcggaacgtttaccccgggaacggg

SEQ ID NO: 256861 - DNA, 725 bp, Homo sapiens
  misc_feature: GYAE6OF02G1LCX.14.55.E11.1.454.CMB.1.raw
  modified_base (165)..(165): a, c, t, g, unknown or other
  misc_feature (165)..(165): n is a, c, g, or t
  modified_base (328)..(328): a, c, t, g, unknown or other
  misc_feature (328)..(328): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagcgtgggtttccngttgctctttaagagtgtccagtgtcaggtgcagctggtgagtcgtgggggagcgtggtccagccgtggggacggtccctggaccactctccgtgtcgctaacgtcgtaggtattcagtcttacgagttagttagtcgactatcggactacggtgggtccccncgtaggcctaccgagggacggaacggggntgggaacggtggggngacttagggttcgtagggttacggtatagggaaacggtaaattaaacgtaagaaagttacgtcgggacccgacggtacgggtacggaacgggtccgtaacttaccgaacccgtaagttacccgtaacgaaacggtacgtaaaacctacgttaaccctaaaacggaacttagttaacgttgttaactacgtacgaaactaaacgttagtaaacgtaccgtacgtaaggtaacgacggaaccggaagtaaccggtcgggtacgtttaaggttacggtaacgttttaccgggtgttaacgtacgtaagggtacggttagggttaagggggtaacggggtttcgtaggttaacccgg

SEQ ID NO: 256862 - DNA, 763 bp, Homo sapiens
  misc_feature: GYAE6OF02FV3M7.14.55.E11.1.454.CMB.1.raw
  modified_base (156)..(156): a, c, t, g, unknown or other
  misc_feature (156)..(156): n is a, c, g, or t
  modified_base (240)..(240): a, c, t, g, unknown or other
  misc_feature (240)..(240): n is a, c, g, or t
  modified_base (249)..(249): a, c, t, g, unknown or other
  misc_feature (249)..(249): n is a, c, g, or t
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttccncgttgctcttttaagaggtgtccagtgtcaggtgcagctggtggagtcgtgggggagcgtggtccagcctgggagtccctgacnctctcctgngcaacgtctggattcaggtccttcagtacgttanggacagtgcctacggtggggtcccnccgagggcctaccgagggacgaagggggtctaggggacgttgggggtcgcgtaggtttggtggtgggttactgggaaaccggtaaggttaaagtaacggaaaggttatcgggacccgaacgggtcccgggttaagggaaaccgggggtcccgtaagtttacccgaacccgtacgttccctaaccggaggtaacgtaaaccgtaaacttaccccaaaacgtaacgttaacgttaggtttcgtaacttcgtacggtaaccaaaagttaggaaacgttaccggtaccgtagggtaacgtaaccgggcccgggtaaacgggtaccggtaccgggtcgtttaccgggttaggtttaacgttttccggtaacggttaccgggttaacgaaccgggttaggtaaccggttgggggggttaaacggggggtttagttacggggtacgttaccggttaacgggg

SEQ ID NO: 256863 - DNA, 800 bp, Homo sapiens
  misc_feature: GYAE6OF02HD6PP.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcgttgggttttcctcgttgcttacgttttaagaggtgtccagtgtcaggtgcagcgttgggtggagttcggtgggggacgcggtggtccaggccgtggggacgtccctggacctctccgtccgtgtcgacgtaccgtcttaggtacttcgagtccttcctaaggttaagtttacgtcgggactaaggttcaccggtaccggtttcggggtaccccggtacccgtacggggcccttaccggaacggggtaccgggaaacgggggtccggttaggggtaccggggttagggggttaggtccggttaggtttggtggtttaggtacggtagggaacggtaaaacgttaaggtaagtaaaggtagttaccggccggaacgggtaccggtaacgggtaacgggtcccggtacttacccgacctacgttacctaccgaaagtaacgtaaacccgtaaacttaacccaaaccgtaacgttaacgttacgttagttaccgtacgtaacgtaacctaaagttacgtaaacgttacggtacgtacggaacggaccggtaaccggtaaccggacgtaacccggttggtaccgttagttaacgttcggtgtacggtacgaaggtaggtagggtacgggggtagggtaggtacgacgttaccggtaagg

SEQ ID NO: 256864 - DNA, 723 bp, Homo sapiens
  misc_feature: GYAE6OF02HL2Y8.14.55.E11.1.454.CMB.1.raw
  modified_base (320)..(320): a, c, t, g, unknown or other
  misc_feature (320)..(320): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagcgttgggttttcctcgttgcttcttttaagaggttgtccagtgtcaggtgcagctgggtggagtcgtgggggagcgtggtccagcctggggacgtccctgacactctcctgtcgctaacgtctggattcgagcttacagtagttatggcagtgccacgtcgggcccncgaggcctccgaggccgaaggggctagggtagttgggggtagggtaagtttaatacgtctaagttagtcggtaagttagggaaaacttaaaagttaaaacggtaacttaagtcggactaacggtaccgttaccgggtaacggaacgggtacccgtaacgttaacccaacccgtaacgttaccgtaccgaacggtaacgaacctaaccgtttacccgaaacggtaacccaacgtactacggttacttccgttacgtaacgtaaacgtaacgtaaaccgtacgaacccgttaggaacgtacgtacggttacgggaacggtaccgaaccgggtacgtaacggttacgttaacgtttacggttacggttacggaacggtaaaggtacggttacgggtacggtaacgg

SEQ ID NO: 256865 - DNA, 679 bp, Homo sapiens
  misc_feature: GYAE6OF02GKZ6M.14.55.E11.1.454.CMB.1.raw
  modified_base (282)..(282): a, c, t, g, unknown or other
  misc_feature (282)..(282): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggacaagtcagagacaattaaagaacttaattttaaattggtaatacaacaagaaaccgagggaaacncccctagaccctctgactctatgctgctactcctagtttcgacctacgacggttcggggtcccgtagtaacggttcaggtcggacgtaggtgtacgtcggtaggggaactagtactttccaccgttcctaccaccgtcacgctacgttctacgaccaaccgtagtaacgttattttacgaccttaactttactacgttacgtacaacgtacgttaacgttaacccgtaaccccgttaccccccgtacgttaacccgggtttaccggggaaccgggtaaaccggggaaacccgtaaggggaccgggtaacgtactacggaaccgtaacggtaaacgtcgggtaccggtcgtaaccgacccgtaaccgtacgttccttacgttaccgttacttaccccg

SEQ ID NO: 256866 - DNA, 632 bp, Homo sapiens
  misc_feature: GYAE6OF02IUGY0.14.55.E11.1.454.CMB.1.raw
  modified_base (312)..(312): a, c, t, g, unknown or other
  misc_feature (312)..(312): n is a, c, g, or t
  modified_base (351)..(351): a, c, t, g, unknown or other
  misc_feature (351)..(351): n is a, c, g, or t
  modified_base (366)..(366): a, c, t, g, unknown or other
  misc_feature (366)..(366): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccagccgtgggaggtccctgaccactctcctgtgacaacgtctggacttcagtctttcgagttagttatggacatcgccacgtcgggtcccnccgaggcctccgaggcggaaggggctagggaggtggggnggacgtaggtttggngttagggtagtggaacgggtaaagttaagtaaggtaaaagtgtcggacccgacggtccggtagggaacggccgtacttacacctactcgtacgagtaacgaactaacttaccaaacgtaactagttacgttagtactacgtagaactaagtacgaaacgtccgaactggaacgacgtaccggaacggacgacggtgtagttagtacgttacgtgtagtcgtaagacggtaggtagggtaggggtggtacggtacgtacggtacggg

SEQ ID NO: 256867 - DNA, 738 bp, Homo sapiens
  misc_feature: GYAE6OF02H08JO.14.55.E11.1.454.CMB.1.raw
  modified_base (180)..(180): a, c, t, g, unknown or other
  misc_feature (180)..(180): n is a, c, g, or t
  modified_base (209)..(209): a, c, t, g, unknown or other
  misc_feature (209)..(209): n is a, c, g, or t
  modified_base (252)..(252): a, c, t, g, unknown or other
  misc_feature (252)..(252): n is a, c, g, or t
tcagcgtctagtaccacgaccggtgctcgatttagcactcgcacgttgggctcgtgggagaggagcccagcactagaagtcggcggtgtttccattcggtgatcagcactgaacacagagactcaccatggagtttggctgagcgttgggttttcctcgttagcttctttttaagaggtntccagtgtcaggtgcagctggtgagtcgnggggagcgtgccagccgtgggacgtccctggacacttcgtccngtcgcacgtctaggcttacagctttacgagttagttacgccggtatacgtcgacctaccggtcgggtcccgaccggtaggtcctacccggtaaggcccgtaaggggccgttaggacgggtttgggacggtacgtaggtttggtacggtaggtacgttacggaaacggtaagtttaacgaaaggtaacgtgtaccgtacggaacgtcccggtaagggtacggacccgtattccgaactactccgaaccgtagtaacaacgtaactttaaccgaaactaacgtcgtttacgttattacccgtcttaggaaaccttaaagtacccggaaaagttcctaaccgaggtaacggtaccgggtacccggaaaggaccgtaccgggtagtttaggtaccgtttaaggttttccgaggttaccggtaacgtacggtaaccggtggggttaacgggggtacggggttaccgttagtaacccggtttacgtaacggg

SEQ ID NO: 256868 - DNA, 692 bp, Homo sapiens
  misc_feature: GYAE6OF02FVLN4.14.55.E11.1.454.CMB.1.raw
  modified_base (172)..(172): a, c, t, g, unknown or other
  misc_feature (172)..(172): n is a, c, g, or t
  modified_base (251)..(251): a, c, t, g, unknown or other
  misc_feature (251)..(251): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtggggagcgtggtccagccgtgggacgtccctgacactctcctgcncgaacgtctggactttcgagtcttacagttagttagtggacctatgcctaaccggtcgggtacccgccgagggccctaccggagggacgaacggggcgtgggaggtcggggtagcgtaggttgtggtagggtatacggaacggtaagtaagtaggtaaaacgtgtacgcccggtaaggtcccggtagggaacgggtccgtacgtacgaaccctataccgtaccaaggtaccgaacgtaaacttacccgaaaccaaactaagtttacgttacgttacttacgttacgaacctaaagttaagaaacgtaccgtaccgttacggaacggtaccggtaacggaacggtaccgtacgggtcgttacggtacgttaacgtttcgtaacggttcgtaccgtagtaggtaggttacggggtggggttaggtcggtacgtaccggtaagg

SEQ ID NO: 256869 - DNA, 676 bp, Homo sapiens
  misc_feature: GYAE6OF02H96VU.14.55.E11.1.454.CMB.1.raw
  modified_base (156)..(156): a, c, t, g, unknown or other
  misc_feature (156)..(156): n is a, c, g, or t
  modified_base (318)..(318): a, c, t, g, unknown or other
  misc_feature (318)..(318): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttccngttgctctttaagaggtgtccagtgtcaggtgcagctggtggagtcgtggggggagcggtggtccagccgtggggacgtccctgaccacttctccgtgtcgcctaacgtcgtaggtattcagtcttcgagttagttatggcagtcgctaccggtgggtcccnccgacggcctaccgagggaccgaagggggtcctggggacggttgggtggacgtaggtttggtcggtaggttaagtacgggaacggtaagttaaagtaaggtaaaacggtgtaccggacccggaccggtccggtaaggaacgggccgtagttaccgtaccacgtcctaccgagaacgaacctaacttaccaaactaactagtttacgttcgtacttacgacgtacgtaaagtacgtaacgtacgtaccgtagacggtaacgccggacgacgacggtcgttgtagtttacgtacgtaggttacgtacggtaagtacggtaggtacggggtaggggttcggtacggtacggttcgtaaggg

SEQ ID NO: 256870 - DNA, 910 bp, Homo sapiens
  misc_feature: GYAE6OF02F2NMM.14.55.E11.1.454.CMB.1.raw
  modified_base (264)..(264): a, c, t, g, unknown or other
  misc_feature (264)..(264): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcgtggttttcctcgttgctcttttaagaggtgtccagtgtcaggtgcagctggtgagtcgtgggggagtcgttggtacgacggtccgggggggtccctgacgactctcctgtgcagcctnaggtatacctattttacgcgtaatatgccatggagtcgtcgggtacccgccgaggtccgttccgaagggggaacgggggtccgttaggggtagggtacggggttcctaccgacggtacgtaagttacgtaacgggttcggtttaccgttagggttaagggttaaacggttaaactacggtttaccggtaaccggtccccggttaccgtttcccgggtaacggggttaaaaccggggggttccccggtttaaccgttcccgtaacgttccccgtttacccgaaaggtaccggtaaaccttaaacgttaaaccgtaaaaccggtaaaccctaaccggttaccttttaaaccgtttttaccgttaaaaccgttaaacgttaccgggtaaacgttaaccgtacccggtttaaaggaaaaccggttaaaccggaaaacgggtaaccgggtaaacccggggttacggtttaacggttttaacgggttttttacgttccgggtttaaaggtaaacggttaacggttaaacggtaacgggtttaaccttaaacggttaccgtaacggttaacccgtttaaagggtttaccggggggtacgggttaacccgtttttaccgaacgggtttccgggtaaggtttaaccccggggggg

SEQ ID NO: 256871 - DNA, 726 bp, Homo sapiens
  misc_feature: GYAE6OF02IBU1D.14.55.E11.1.454.CMB.1.raw
  modified_base (169)..(169): a, c, t, g, unknown or other
  misc_feature (169)..(169): n is a, c, g, or t
  modified_base (189)..(189): a, c, t, g, unknown or other
  misc_feature (189)..(189): n is a, c, g, or t
  modified_base (324)..(324): a, c, t, g, unknown or other
  misc_feature (324)..(324): n is a, c, g, or t
  modified_base (351)..(351): a, c, t, g, unknown or other
  misc_feature (351)..(351): n is a, c, g, or t
  modified_base (364)..(364): a, c, t, g, unknown or other
  misc_feature (364)..(364): n is a, c, g, or t
  modified_base (573)..(573): a, c, t, g, unknown or other
  misc_feature (573)..(573): n is a, c, g, or t
tcagcgtctagtaccacgaccggtgctcgatttagcactcgcacgttgggctctgggagaggagcccagcactagaagtcggcggtgtttccattcggtgatcagcactgaacacagagactcacatggagtttgggctgagctgggttttcctgttgcttctttaagnggttgtccagttgtcaggtncagtcgtggtggtagtcgtgggggggagtcggtcggtaccagtccgtagggggaccgttccctagacctacctccttccgtggtcgccgtaaacgttcgttaggatttccgaggtcctttcaacggtttagttancggctatcggcacggtcggggtacccnccgaggctaccgnggtacggaaggggcttagggaggtgggtcgcgttagttggtacggtgtaagttaggaacggttaaagtaaagtaagaaaggttcgacgacccggtaccggtcggtaacgggaaccggtccggtaagtaccacccgtacgttcccgaacgtacgtaacgtaaccttaaactaacccgaaactaaaccgtagtttcgtttatactacgtanaaagtaaacgtagtaagtcctacgtacggagtaaccggccggaaaggtaccgacgggttcttacggtacgtttaacgttcggttacgtcggacgttaagggacggtagggttacggggtaggggttacggtttcggacgttccgggttaaggg

SEQ ID NO: 256872 - DNA, 649 bp, Homo sapiens
  misc_feature: GYAE6OF02GSNO9.14.55.E11.1.454.CMB.1.raw
  modified_base (182)..(182): a, c, t, g, unknown or other
  misc_feature (182)..(182): n is a, c, g, or t
  modified_base (186)..(186): a, c, t, g, unknown or other
  misc_feature (186)..(186): n is a, c, g, or t
  modified_base (253)..(253): a, c, t, g, unknown or other
  misc_feature (253)..(253): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagcttgggttttcctcgttgcttcttttaagnggtntccagtgtcaggtgcagcgtggtggagtcggtgggggagcgtggtccagccgtgggacgtcctgacnctctctgtcgacaacgtcgtggattcacgtctcagtagttagtggactatgactacgtcgggtcccgcgacggccgtccgaggacgaggggtctgggaggtgggtcggcgtaggttgtgggtagtagtggaaaggtaagttaaagaacggtaaagtacgtacggaccggtacggaccggtagggtaacggccgtacgttaccgactacgtaccgtaccgtagaacgtaacgtaactacccaaacaactagttacgttgtactacgtagaactaagtagtatacgacgtagacggtacgaaccggtacggaccgtaggtacgttagtcgttaagtccgttaggtagtacgaaggtacgtacgggtagggtagggggtacggtacggtagttaccggg

SEQ ID NO: 256873 - DNA, 659 bp, Homo sapiens
  misc_feature: GYAE6OF02FU7GT.14.55.E11.1.454.CMB.1.raw
  modified_base (292)..(292): a, c, t, g, unknown or other
  misc_feature (292)..(292): n is a, c, g, or t
  modified_base (357)..(357): a, c, t, g, unknown or other
  misc_feature (357)..(357): n is a, c, g, or t
  modified_base (557)..(557): a, c, t, g, unknown or other
  misc_feature (557)..(557): n is a, c, g, or t
tcagcgtctagtaccacgaccggtgctcgatttagcactcgcacgttgggctcgtgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagccgtgggacgtccctgaccactctcctgtcgcacgtctggattcagtcttcgaagttagttatggcntgccacgtcgggtcccgcgaggcctccgaggtcgaaggggctgggacgtgggtagctaggtttgnggttggtagtcggaacggtaagtaagtaaaggtaaagttatcggacccgtacggccggtaagggaacgggccgtattaccgacctatccgtacgaaggtacgaaaccaacgtttacccaaactaaacgtagttaggtttacgtattcgtagaacctaaagtcgtaaagtacgacttaggacgacgtaccggaaggaccgngggtccttcggttagtacgtttaccgtaggttcggtaacgtacggtaaggttagggttacgggggtaggggggttacgtacgggttacgtccgggttaaggg

SEQ ID NO: 256874 - DNA, 817 bp, Homo sapiens
  misc_feature: GYAE6OF02JTJ67.14.55.E11.1.454.CMB.1.raw
  modified_base (268)..(268): a, c, t, g, unknown or other
  misc_feature (268)..(268): n is a, c, g, or t
  modified_base (277)..(277): a, c, t, g, unknown or other
  misc_feature (277)..(277): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagtcttgggtttttcctcgttgcttcttttaaaggaggttgtccaggtgtcgaggtgcaggtcgtggtggagtacggtgggggagtcggtggtccaggtccgtgggacgtcctagactctctctgngactacgtntggtacttcgagtcttacgagttagttagtcggactgtcggtaccgtaccgggttcggggtccccgacggtacggtcctacccgggaaggggtaccggtaaacgggggtccgttaaggggaacggggtttgggggtacggtaaccgttgggttttacgggtacggttagggttaaaggtaccggtaaagggggttaaaagtaaaggtttaaaagggtaaaacggtttacgtaaccgggggtaaacccccgggtaaggtacccggggtaacgggtaaacgggggttaccccgttaaccgtttaaccccgaaaccgttaccggttaaccccgtaccgaaagggtaacctaaaacggttaaccttaaaccccgaaacgtaaccgttacgtttacggttacgtacttacgtacgtaacgtaaagttacgacgtacgtacgtagacgtacgaccggtacgacgtacgtagttacgtagttagtcgttaggtacgtacgaggtaggtacgggttgggaagggttcgtacggacgttccggtaaggg

SEQ ID NO: 256875 - DNA, 744 bp, Homo sapiens
  misc_feature: GYAE6OF02IIME4.14.55.E11.1.454.CMB.1.raw
  modified_base (321)..(321): a, c, t, g, unknown or other
  misc_feature (321)..(321): n is a, c, g, or t
  modified_base (409)..(409): a, c, t, g, unknown or other
  misc_feature (409)..(409): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagaggttgtccagtgtcaggtgcagctggtggagtcgtgggggagcgtggtccaggcccgtggggacgtcccctgaccactctcctgtcgcaacgtctggattcgagtcttacagttaagttatggactagtcgctacgttcggggtcccnccgaggcctccgaaggccgaaggggctgggaggtgggtcgcgttaggttggtgtaggtactgggaacggtaataaagtacggaaagtntcggacccgtaacggtccggtaagggaaccgggtaccctagttaccgaacctacgtacccgtaccgaaggtaaccgtaacctaaacgttacccaaaacgtaaacgtacgtttacgttacgttaagttacccgtaggtaaacctaaagttaaccggtaaagttaccgggtaccgttaacggaagggtaacccgggtaacccggaaagggaacccgtaccgggtaccgttagggttacgtttacgtttaaccggttcggtacggttaaccggaaggtacgggttaggtacgggggggttaacgggggttcggtaacggtaccgttacgggttaaggg

SEQ ID NO: 256876 - DNA, 681 bp, Homo sapiens
  misc_feature: GYAE6OF02HCITK.14.55.E11.1.454.CMB.1.raw
  modified_base (172)..(172): a, c, t, g, unknown or other
  misc_feature (172)..(172): n is a, c, g, or t
  modified_base (317)..(317): a, c, t, g, unknown or other
  misc_feature (317)..(317): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctgggtggagtcgtgggggagtcgtggtccagccgtggggacgtccctgacactctcctgtgacaacgtctggattcgagtcttacagttagttagtggcatcggactacgttcggggtacccnccgagggccctaccgagggtccgaagggggtctaggggaggtcggggtggccgtaggtttggtggttgggtatggaacgggaaagttaagaaggtaaagttcgtacggccggtaccggaccggtagggaacggggtccgacgttaccaccgtactccgtaccgagaacgaactaaacttacccaaactaacgtagttacggtttagttacgttacgtacgaactaaagttacgtaactacggggggtacctaggacgtacgaccggacggacgacggtcgtaggttagttacgttacgtacgttagtacgtaggtaggtacggtagggggtagggggttagggtacggtacgttacggtacggg

SEQ ID NO: 256877 - DNA, 716 bp, Homo sapiens
  misc_feature: GYAE6OF02IAJZD.14.55.E11.1.454.CMB.1.raw
  modified_base (157)..(157): a, c, t, g, unknown or other
  misc_feature (157)..(157): n is a, c, g, or t
  modified_base (175)..(175): a, c, t, g, unknown or other
  misc_feature (175)..(175): n is a, c, g, or t
  modified_base (637)..(637): a, c, t, g, unknown or other
  misc_feature (637)..(637): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttccncgttgccttcttttaagnggtgtccagtgtcaggtgcagctggtggagtcgtgggggagcgtggtccacgccgtgggcgtccctagacctacttctcccgtgtcgacctaacgtcgtaggaatttccacggtctttaccaaggttacgtttagtcggtctagtcggtacctaccggttcggggtccccgaccggaggtcccgtcccgaagggaccggaacggggggtcgtggggaaggggtttgggggtacggtccggtaaggtttcgggtaggttagggtatagggaacggtaaagtaaacgtaaggaaaaggttgtacggacccggaacgtccgggtaaggaacggggtcctagttaccgacctactccgaccaaggtacactaaacgttaccaaactaccgtaagttacggttatacgtactagaactaagtacgaaagtcgtaccgtagaacgcggaaccggaggaccgacgggtnttaggtacgtttaacgttacgtgtacgtaggaacgtaggtagggtagggggtaggggttggtactaccggtacgtaagg

SEQ ID NO: 256878 - DNA, 739 bp, Homo sapiens
  misc_feature: GYAE6OF02F3H0Q.14.55.E11.1.454.CMB.1.raw
  modified_base (194)..(194): a, c, t, g, unknown or other
  misc_feature (194)..(194): n is a, c, g, or t
  modified_base (228)..(228): a, c, t, g, unknown or other
  misc_feature (228)..(228): n is a, c, g, or t
tcagcgtctagtaccacgaccggtgctcgatttagcactcgcacgttgggtttggggagtctcagtcaggacacagcatggacatggagggtccccgctcagctcctggggctcctgctactctggctccgaggtgccagatgtgacatccagatgacccagtctccatccctccctgtctgcatctgtagganacagagtcaccatcacttcggccggacagtcagngcaattaagaacttaatttaaatggtatacaacaagaaaccgaggaaacgccctgacctctgactctagtcgctacgactacgttcgtagtttacgacgtacgtacgggttccggggtacccgtaggtaacgggttccgtaaggtcggctaggtggtacgtacggtagggtacctaggtacctttacgaacgttccctaacgtacccgtacgtaccgtagtaccgttcgtacgaccgtaaacttacgggtaaacgtttacgtttacgtaccttaaaccgttccttaaccggttcttaaaccgaacgttaaacggtaaccgtttaacccctaacccggttaccccccgttaacgtttacccggttaccggggtaaccgggaacccgggtaaaccggttaaacgggcggtaaaccggttactaccggaaacgggtaacgtaaacccggttcgggtccggtactaccggactaacccggttacgttccgtaccgtttaccgttacgttaccccc

SEQ ID NO: 256879 - DNA, 760 bp, Homo sapiens
  misc_feature: GYAE6OF02J0IIQ.14.55.E11.1.454.CMB.1.raw
  modified_base (240)..(240): a, c, t, g, unknown or other
  misc_feature (240)..(240): n is a, c, g, or t
  modified_base (244)..(244): a, c, t, g, unknown or other
  misc_feature (244)..(244): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttccctcgttgcttcttttaagaggtgtccagtgtcaggtgcagcgtggtgagtcgtgggggacgcgtggccagccgtgggacgtccngacncgtctctggtcgacgtacgtctggattcagtcttcgagttagttagtggtcagtcgtaccgacgtcgggtcccgacgtacggacctccgacggacggaacggggtcgttagggaggttcgggtcggacgttaggtttacggtaggtaggtaacgtggtaacgggtaaagtaagttaaacggtaaagtcgtacggtaacccggtacggtaccggtaacgggaacgggtcctaacgtttacccaccgttacgtccgtaccgagtaaccggaaaccttaacgtacccgaaactaacgttagtttacggttacgtaacgttccgtaactaccgtaaacgttaacggaaccttaacgggtaaccgttagggaaccggtaaccggtacccgggaaaggtaacccggttacgttacgttacgggttacgttttaacggttaaccggttcgttacggaacgtagggtacgggttagggttacgggggttaacgggttaggtaccttaccgggtacggttaaggg

SEQ ID NO: 256880 - DNA, 696 bp, Homo sapiens
  misc_feature: GYAE6OF02H6AAV.14.55.E11.1.454.CMB.1.raw
  modified_base (181)..(181): a, c, t, g, unknown or other
  misc_feature (181)..(181): n is a, c, g, or t
  modified_base (444)..(444): a, c, t, g, unknown or other
  misc_feature (444)..(444): n is a, c, g, or t
tcagcgtctagtaccacgaccggtgctcgatttagcactcgcacgttgggtttggggtacgatttgatgttacctgatgcttagaggcttttcctggaagcagggcatttgttgcttcagcaccgtagtgcctcgtcatcacgcctcagccttgattttccggatttgcctaggaaaaccngcctacacgcttaaaccgggacaaccgtcgcccggccaaacatagccttctcccgtcccccttcgcagtaacaccaagtacaggaatattaacctgttcccatcgactacgcctttcggcctcgccttaggggtcactcacctgccccgattaacggtgacaggaacccttggtcttccggcgagcgggcttttcgattcccgcttttatcgtttaacttagtagtcagctatcgctactttctagactaccctcgagcatcncctcacacgcactaccttacaacgtacggaccttaacaacggtaaccgtccctacccccgttaacccaaaaccaaccgtaccaaagttaacgccggtccgaccttccgggacccgaccgtaacggtccgtttccgggtacgaccgtaaggttcgggtttttaaccgcccccggtttttacccaaccgttttcccgtttaccccccggaccgttaaccgtttaccgtacggttaaccggttaccgttaaacgg

SEQ ID NO: 256881 - DNA, 660 bp, Homo sapiens
  misc_feature: GYAE6OF02GYTG1.14.55.E11.1.454.CMB.1.raw
  modified_base (265)..(265): a, c, t, g, unknown or other
  misc_feature (265)..(265): n is a, c, g, or t
  modified_base (272)..(272): a, c, t, g, unknown or other
  misc_feature (272)..(272): n is a, c, g, or t
  modified_base (297)..(297): a, c, t, g, unknown or other
  misc_feature (297)..(297): n is a, c, g, or t
  modified_base (323)..(323): a, c, t, g, unknown or other
  misc_feature (323)..(323): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctgttgtcttcgttttaaagaggttgttaccaggttgtacaggtgcagctgggtggagtcgtgggggagcgtggtccagccgtaggggacgtccctgacctctctctgcncacgtcnggattcagtcttacgagttagttancggtcagtgactacggtcgggtcccncgtaggcctaccggaggcgaggggctagggagtgggtagcgtagttggtaggtaggtacgtaggaacggtaagtaagtaaggaacgttgtccggaccggtacggtaccggtagggaaccgggtcctacgtaccacgtactccgtacgtaacgacgtaaacctaacttaacccgaaactaacgtagtttgttacgtactcgtagaaacttaagtagtaacgtacgtagtaggacgacggaccggaagacgtaccggtagttacgttagttacgttcgtaggtcgtaacgaggtaggtagggttagggggtagggttaggtacgtacggttacgtaggg

SEQ ID NO: 256882 - DNA, 661 bp, Homo sapiens
  misc_feature: GYAE6OF02JMWF2.14.55.E11.1.454.CMB.1.raw
  modified_base (327)..(327): a, c, t, g, unknown or other
  misc_feature (327)..(327): n is a, c, g, or t
tcagcgtctagtaccacgaccggtgctcgatttagcactcgcacgtttgggtttgggggagctctgggagaggagcccagcactagaagtcggcggtgtttccattcggtgatcagcactgaacacagaggactcaccatggagtttgggctgagctgggtttcctcgtgctctttaagaggtgtccagtgtcaggtgcagcgtggtggagtctgggggagcgtggtccaggccgtgggacggtcccgtggaggcttcgtcctgtcgcgcggtcctcgtggacttccaaccttcagttacctagtcgctaagtcgcacgtcggtccncgtggcctcgacgggcggacggggtctgggacggttcggggtgccgtaagtttactacgtcactagtcgagtagaaactaagtcgacgtctaagtccgacgtaccgtacggacggaacggtccgacgtaccgacgtactcgtaccgacgtaacgaacctaaacgtttaaccgaaacgtaacctaaccggactaagttacgacctagtaaccgtaaagacgtaaacaccggtacctaacggagtacggtacgaccggtaacggtaaccgacggtacggttcgtaacgttaacggttcgtacgggtagggtaaggtacggtacggtacgggtacgg

SEQ ID NO: 256883 - DNA, 785 bp, Homo sapiens
  misc_feature: GYAE6OF02HL1NE.14.55.E11.1.454.CMB.1.raw
  modified_base (297)..(297): a, c, t, g, unknown or other
  misc_feature (297)..(297): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctggagcttgggtttttcctcgttgcttacttttaagaggtgtccagtgtcaggtgcagcgtggtggagtcggtgggggagcgtggtccaggtccgtggggacgtccctgacctactctccgtgtcgaccaacgtcgtggtacttcacgtccgtttanaacggtttagttacgtggcctagttacggcctaccgggttccgggttaccccgaccgacgggtcccttccggaacgggcggtaaggggccggttggggaacgggttgggggtcggcgttagggtttggttaggttacggttagtacgggaaacggtaaaggttaaaagtaaggtaaaacggttgccgggtacccggaaccggtccgggtaagggaaccggggtccggtaacgttacccgtaccgtaaccgttacccgtaccgtaacggaacgtaaacctaaccgttaaacccgaaaccgtaaacgttaacgtttacgttacgttacttacgtacgtaacgtaaacgtagtaaacgtacggtaccgtaacggaacgtaccggtaccggaacggtaccgtacgtagtacgtacgtttacgttacgttcgtaggtaccgtaaggtaggtagggtacggggtagggttacgggtacggtacgtaccgtaggg

SEQ ID NO: 256884 - DNA, 864 bp, Homo sapiens
  misc_feature: GYAE6OF02FHE1N.14.55.E11.1.454.CMB.1.raw
  modified_base (171)..(171): a, c, t, g, unknown or other
  misc_feature (171)..(171): n is a, c, g, or t
  modified_base (251)..(251): a, c, t, g, unknown or other
  misc_feature (251)..(251): n is a, c, g, or t
  modified_base (307)..(307): a, c, t, g, unknown or other
  misc_feature (307)..(307): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcccgttgctcttttaagnggtgtccagtgtcaggtgcagctggtggagtcgtgggggagcgtggtccagcctgggacggtccctgacactctcctgtncaacgtcaggattcagcttcgagtagttatggcagttcgcgtaccgtggggtcccnccgtaagggtcctaccgagggtaccgaacgggggccttaggggaggttcgggggtcggctaagggttttcggtaggttagggttaacgttgggaaccgggttaaaagttaagtaaacgggtaaaaggttactaacggggccccggtaaccggtccccggggttaagggaaaccggggggtccccgttaaagtttcccgaacccgttaacgttccccggttaacccgaagggtaaaccgtaaacccttaaaactttaccccgaaaaaccgttaaaccgtaaacgtttacggtttttacggtaaaccgtttaccgttacggtaaaccgtaaaaaactttacgggtaaaacgtttaaccggtaaccgttaacggtaaacgggtaaccgggtaccccgggaaacgggtaaaccgtacccggggtacgtttacgggttaacggttaacggttttttaaccggtacgggttacgtttaaccgggaaggttaacgggttaacggttacgggggggtaaacgggggggtttggttaacggtaccggtttacccgggttaaagggg

SEQ ID NO: 256885 - DNA, 659 bp, Homo sapiens
  misc_feature: GYAE6OF02JW4HS.14.55.E11.1.454.CMB.1.raw
  modified_base (181)..(181): a, c, t, g, unknown or other
  misc_feature (181)..(181): n is a, c, g, or t
  modified_base (318)..(318): a, c, t, g, unknown or other
  misc_feature (318)..(318): n is a, c, g, or t
  modified_base (342)..(342): a, c, t, g, unknown or other
  misc_feature (342)..(342): n is a, c, g, or t
  modified_base (372)..(372): a, c, t, g, unknown or other
  misc_feature (372)..(372): n is a, c, g, or t
  modified_base (512)..(512): a, c, t, g, unknown or other
  misc_feature (512)..(512): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcggtttgccttagtttttaaaggnggttcgtccaggttcggtcagggtgcagctgggtgagtcgtgggggagcgtggtccagccgtggggacgttccctgaccacgttcctccgtggtcaccaacgttctggtacttcgagtccttacgagttacgttaanggactgcgtcgacgtcgggtcccncgtagcctcggacggcggacggtcgtgggngtgggtgcgttaggtggtgttaggagttcggaaacggtaagtaagtaacggaaaggttcgaacgtccggacggtcggtaggacggttccgtatccgacgtactcgacgagacgaactaactacaactacgtattgttacngtacgtacgactaatagtacacgtacgtacggaagaccggtaccgaaggtaccgaccggttgtacggttcgttaacgttacggtcggttacggaacgttagtaacggtagggtcggggtaaggggtcggttacgagttaccgtaggg

SEQ ID NO: 256886 - DNA, 747 bp, Homo sapiens
  misc_feature: GYAE6OF02GWS7I.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagaggttgtccagtgtcaggtgcagctggtggagtcgtgggggaggcgtggtccagcctgggaggtccctgaccactctcctgtgcaacgtctggattcagtcttacagttagttagtggctagtgcctacgtggggtcccgccgagggcctaccgacgggaccgaaacggggggtcttagggggacggttggggtggacgtaggtttggtggttagggtagtagggaacgggaaaggtttaaagtaacggtaaaaggttacgtacgggaccccggtaaccggggtaccggttaggggaaacggggtacccgtaagtttacccgaacccgtaacgttcccgtacccgaacggtacgtaacctaaacgttacccaaaccaaacgttaagttcggtttacgttactaccgtgtaactaaaacgttacgaaagttaacgtacccgtaggaacggacggaccggaaggtaacccgacgggtccgttggttacgtttaacgtttacgttacggttacgtacgtaacggtaaggtaagggttcggggtaaggggggttggtacggtaccggtaccggtaaggg

SEQ ID NO: 256887 - DNA, 622 bp, Homo sapiens
  misc_feature: GYAE6OF02F63PM.14.55.E11.1.454.CMB.1.raw
  modified_base (194)..(194): a, c, t, g, unknown or other
  misc_feature (194)..(194): n is a, c, g, or t
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (255)..(255): a, c, t, g, unknown or other
  misc_feature (255)..(255): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (412)..(412): a, c, t, g, unknown or other
  misc_feature (412)..(412): n is a, c, g, or t
  modified_base (500)..(500): a, c, t, g, unknown or other
  misc_feature (500)..(500): n is a, c, g, or t
  modified_base (512)..(512): a, c, t, g, unknown or other
  misc_feature (512)..(512): n is a, c, g, or t
  modified_base (560)..(560): a, c, t, g, unknown or other
  misc_feature (560)..(560): n is a, c, g, or t
  modified_base (588)..(588): a, c, t, g, unknown or other
  misc_feature (588)..(588): n is a, c, g, or t
tcagcgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagcggtggtttccgcgttaggcgtctttaagtaggtgtccagtgtanaggtgcagtctggtgacgtcgtggggagcgtgtcagccgtggagtcccngacnctctctgngacgtatcgtggtattcgagtcttacgtagtagttanggtacngttcgctacgtcgggtccgacgtacggctccggagacgtaaggggctagggtagtgggtacggctaaggttgtggtaggtacgtaggagggtaaaattagaaaggaaacgttanggtaccccgacggtaccgtaagggacggaccgtacttacgacctaggtcctaccgaagcgaactaacgacctaactatcgttggttanaacttcggtaanaacgtaagtacgaagtcgtacgtagacgacgtacggaactcgtacgtntgtagtacgttgtaggtacgtcgaaggnggtacggtgggtagggtagtacgagttagtacgg

SEQ ID NO: 256888 - DNA, 642 bp, Homo sapiens
  misc_feature: GYAE6OF02IK33J.14.55.E11.1.454.CMB.1.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (327)..(327): a, c, t, g, unknown or other
  misc_feature (327)..(327): n is a, c, g, or t
  modified_base (344)..(344): a, c, t, g, unknown or other
  misc_feature (344)..(344): n is a, c, g, or t
  modified_base (389)..(389): a, c, t, g, unknown or other
  misc_feature (389)..(389): n is a, c, g, or t
  modified_base (505)..(505): a, c, t, g, unknown or other
  misc_feature (505)..(505): n is a, c, g, or t
  modified_base (533)..(533): a, c, t, g, unknown or other
  misc_feature (533)..(533): n is a, c, g, or t
  modified_base (541)..(541): a, c, t, g, unknown or other
  misc_feature (541)..(541): n is a, c, g, or t
tcagcgtctagtaccacgaccggtgctcgatttagcactcgcacgttgggctctgggagaggagcccagcactagaagtcggcggtgtttccattcggtgatcagcactgaacacagagactcaccatggagtttgggctgagcgtgggttttcctcgttgcttcgttttaagaggttgtccagtgtcaggtgcagcgtggtcggagtcgtgggggagcgtcgtcacgcgtgggaggtcccngaccnctcgttcctgtcgcaacgtctggattcagtctttcgagttagtttacgtggacacttaggcgtccgtacgggggttcccncgtacggccttaccggnggacggacgggcgttggacggtgggtcggcgtaggttgttacggnggttactacggacgggtaaatttaacgagaaacgtgtcgacccggagcccggttagacgggtcacttcgaactctcgacgacgtacgactaccgttacaaactaactgtacttagntaccgttaggaacctaagtacgtaacgngttaccgngttacgaacggtcgaagggtacgacgtaccgtgttcgtttaacgcgtttagtacggtactagggtaagtcggtaggtacgggttagggacctagtcggtag

SEQ ID NO: 256889 - DNA, 802 bp, Homo sapiens
  misc_feature: GYAE6OF02JKKBU.14.55.E11.1.454.CMB.1.raw
  modified_base (761)..(761): a, c, t, g, unknown or other
  misc_feature (761)..(761): n is a, c, g, or t
  modified_base (771)..(771): a, c, t, g, unknown or other
  misc_feature (771)..(771): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgaccctagtctccatcctccctgtctgcatctgtaggagacagacgtcacctatctacgttcggaccggacaagtcagagactattaagaacttaatttaaagttagtatacgaaacgaacgaaaccgaagggtaaaccgccccttacgacctccgtacgtactacgtagtcgtctacggactactaccgtagtttcgactacgtacgggttccggggtcccgtaacggtaacggttacgaacggttcgggacgtaagggttacggtacgttacggtacggggtaaacttacgttacgttttacccgaaaccgtttcccgtacccgtaacccggttacgacgtaccgtaccgttacggtaccgaacccggtaaccgttagtaaacggtttacggtttaaccgaacctttaaacccgtttacttaaccgttcggtaaaccttaaaccggtacgttaaaccggttacccgttaaccccggttaaccccccgtttacggttaacccggtttacccggggaacgggtaaacccggggtaaccggtaaaccgggtacggtaacgtccgtaaacggcggtaaacccggtacgttacgggtacgtacggtaccnccgttaaccncgttacggtttacttcccgttaccgttaccg

SEQ ID NO: 256890 - DNA, 646 bp, Homo sapiens
  misc_feature: GYAE6OF02GMQ2U.14.55.E11.1.454.CMB.1.raw
  modified_base (174)..(174): a, c, t, g, unknown or other
  misc_feature (174)..(174): n is a, c, g, or t
  modified_base (194)..(194): a, c, t, g, unknown or other
  misc_feature (194)..(194): n is a, c, g, or t
  modified_base (312)..(312): a, c, t, g, unknown or other
  misc_feature (312)..(312): n is a, c, g, or t
  modified_base (541)..(541): a, c, t, g, unknown or other
  misc_feature (541)..(541): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgcttcttttaagnggtcgtccagtgtcgaggtncagtcgtgggtaggaggtcgtgggggagcgtcggtccagccgtgggacgtccctagacctactcctccgtgtcgaccaacggttctggattccgaagtcttcgtaaggttagttacgnggacagttgacctacggttcggggtcccgccgtaggcctaccgaagggccgaaggggtctggggtaggtgggtcggacgtaggttcggtggtaggtatacggaacggtaagtaagtaaggtaaagtacgtcggaccggtacggtccggtagaacgggtccgtacgtacgtaccgtactaccgtacgaagacgaactaactaaccaactaacgtatagttagtactactnaactaagtagaatacgactagacgacgacgagacgagtcgtagtagtacgttcgtagtacgtagtacgtaggaggtagggtaggggtagtacggtagtacgtagg

SEQ ID NO: 256891 - DNA, 920 bp, Homo sapiens
  misc_feature: GYAE6OF02JC75Z.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccagtggagtttgggctgagtcgttgggttttcctcggtttgcttcgttttaagaggtgtccaggtgttcgaggttgacaggtcgtgggtggaggttcggtggggggacggcggtgggtccaggtccggtggggacggtccctgacctactccgtccgtggtcgaccgtaacgtcgttacggtacgttacgacggtcgttaccgtaacggttaaggtttaacgttggtaccgtagtcggaccgttaccggttacggggtcccggtaccggtacggaccgtttttacccggacgggtacgggtaacgggggtacgggtacggggtacgggttagggggtacggggtaccggttaggggttttacgggttgggttacggggttaacggttaacggggtaaacggggtaaaagggtttaaaacggttaaaacgggtaaaagggttaacggtaacgggtacccgggtaaacccgggtaccggggtacggggtaacgggtaccggttaccggttaccgtaacccgtaacgtacccgtaccggtaacggtaaaccggtaaaccgtaaccgtaacccgtaaaccgtaacgttaacgttacggtttaacgtaccgttacgtacgtacgttaaaggtaagttaacgtacggaccgtaacggtaacggaccggtaaccggaacggaaccgtacgggtacgttaggttacgttaacggttacggttacggttacggttacggtaaggtagggtaacgggttacggggtacgggggttagggtacgggttaccggtagggttaacgg

SEQ ID NO: 256892 - DNA, 810 bp, Homo sapiens
  misc_feature: GYAE6OF02FZ8KR.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagtcgttgggttttcctcgttgcttacttttaaggaggttgtcctagtgtcaggtgcagcgtggtggagtcgtgggggagtcggtggtccagccgtggggacgtcccctgactactcgtccgtgtcgactaacggttctggtacttccgagtcctttcgagttagttagtggctagtgcctacggttcgggtccgccgacgggtcctaccggaagggacggaacggggtcgtaggggtacgggttgggtacggtagttaggttttggtcggttaaggttagtacgggaaaacgggttaaagttaaacgtaaaggtaaacgtacggtaccgggacccggtacggtccggtaacgggacccgggtacccgtacgttacccgtaccgtactcccgtacgaagtaaacgtaacctaaacctaacccgtaaaaccgtaaacgttacgttacgtttaacgtaaccttcgttaaacgtaaaccttaaaacggtaacgtaaacgttaaccgtacccggtaaggtaaaccgggtaaccggtacccggaaacggtaaccgtaaccgggtcgtttaggttacgtttaacgtttaaccggttggttaccggttaggtaacggtaagggttagggttaggggggtaccggggttaggtaccggtaccgttacggttaaggg

SEQ ID NO: 256893 - DNA, 743 bp, Homo sapiens
  misc_feature: GYAE6OF02IE80G.14.55.E11.1.454.CMB.1.raw
  modified_base (173)..(173): a, c, t, g, unknown or other
  misc_feature (173)..(173): n is a, c, g, or t
  modified_base (326)..(326): a, c, t, g, unknown or other
  misc_feature (326)..(326): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagnggtgtccagtgtcgaggtgacagcgtggtggagtcggtaggggggcgtcgtggtaccagccgtgggacggtcctgactacttctccgtggtgcaggtcgtcgtggacttcacggtcttacgagttagttagcggcagtgacacggttcggccncgagtcctaccgaaggcggaacgggtgttagggagggtcggggtcggcttagggttggtagggttacggtagttacgggaaacggttaagtaaaaggtaacgtaaaaggttggaccggaaccgggtaccgggtaccggtacggggaacggggacccgtaacgttaccgaaaccgtccgttaccgtacgtaaggaacggtaactaacgtaacccgaaagtaaccttagttagttacctagtaccgtacaagtaaacgtacgtaacgtaaccgtacgaaggaacgtaaccggggtaccggaacgtacggttacccggttacgttagttaccgggttaaagtttccgttagtacggttaaccgtagggtaacggttagggttacggggtaacggggttagtaccgggtacgttaaccggg

SEQ ID NO: 256894 - DNA, 640 bp, Homo sapiens
  misc_feature: GYAE6OF02F9UIE.14.55.E11.1.454.CMB.1.raw
  modified_base (423)..(423): a, c, t, g, unknown or other
  misc_feature (423)..(423): n is a, c, g, or t
  modified_base (474)..(474): a, c, t, g, unknown or other
  misc_feature (474)..(474): n is a, c, g, or t
  modified_base (490)..(490): a, c, t, g, unknown or other
  misc_feature (490)..(490): n is a, c, g, or t
tcagcgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacggtccctgacactctcctgtcgcaacgtctggattccagcttacagttagttatggctagtgcctacggtcggggtccgcccgaggccctccgagggtaccgaaggggtctgggagggttcgggggtggacgtaggttggttggttagggtagttcggaagggtaaagtaagtaagtaaagtntcggaccggacgtccggtaggacgggcgtatccgactactacctacgaganaacgtaactacccaanaacattgtagttacgtctagtactaagtagaatcgtaccgtaggtaacgacggcgtaagggaaccgtcgggtacctaggttagttaacttacgttacggtcgttacgaaggtaggtaggtacggggtaggggtcggttagtcgtaacggg

SEQ ID NO: 256895 - DNA, 794 bp, Homo sapiens
  misc_feature: GYAE6OF02JW07F.14.55.E11.1.454.CMB.1.raw
  modified_base (164)..(164): a, c, t, g, unknown or other
  misc_feature (164)..(164): n is a, c, g, or t
  modified_base (727)..(727): a, c, t, g, unknown or other
  misc_feature (727)..(727): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggaggtttgggctgagcgttgggttttcctcgttncttacgtttttaaaggaggtcgttccagtgtcaggtgcagctggtggagtcggtgggggagtcggtggtaccgacggccgttggggacggtccctggaacctcttccgtcgttaggtgacctaaccggttcttacgggacttccgagtcctttagaaggttagtttacgtcggacaaggtcgtaccgacgtttcggggacccctcgaaggtcccttaccggaacggtaccggtaacgggggtccgtacggggtagggtggggttccggagttaacggtttggttaccggttagggttaacttcggggaaaccggggtaaaatttaacgggtaaaacggtaaaccggttagcgggaacccggtaaccgggtaaccggggtaggaacggggtccccgtaacgttacggacccgtaaagttcccggtaacgaaggttaaccggtacttaaaccgtaccgaaacgttaacgtaaatttacggtttaactacgtcgtaagaacttaaacgttacgaaacgttcgtaccgaggtacgaacggtaccgaaagggccgtacgtcgttagtnttacgttggttatccggtaacgtaagcggaggttcgggtgggtaactacggttaccgtaggtaacgg

SEQ ID NO: 256896 - DNA, 621 bp, Homo sapiens
  misc_feature: GYAE6OF02GSEGJ.14.55.E11.1.454.CMB.1.raw
  modified_base (176)..(176): a, c, t, g, unknown or other
  misc_feature (176)..(176): n is a, c, g, or t
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (315)..(315): a, c, t, g, unknown or other
  misc_feature (315)..(315): n is a, c, g, or t
  modified_base (334)..(334): a, c, t, g, unknown or other
  misc_feature (334)..(334): n is a, c, g, or t
  modified_base (392)..(392): a, c, t, g, unknown or other
  misc_feature (392)..(392): n is a, c, g, or t
  modified_base (574)..(574): a, c, t, g, unknown or other
  misc_feature (574)..(574): n is a, c, g, or t
tcagcgtctagtaccacgaccggtgctcgatttagcactcgcacgttgggctctgggagaggagcccagcactagaagtcggcggtgtttccattcggtgatcagcactgaaacacagaggactcaccatggagtttgggctgagcggtggtttcgcgtaggctctttaagaggtntcagtgtcaggtgcagctgggtggagttcgagggggagcggtggtccagcctgggaggtccctgaacactcctctgtagccaacgtctggattcgagtcttanagtagtttaanggacatcggctacgtgggcccacgngcctccgaggcgaaggggntgggaggtcggtggataggttgtgtggtactgaacggtaaagtaagtaagtaacgtancgtcgaggtcgtaggaacgggtcgacttccactactccgtccgaagaacgtaactaacgttaacccaaactaacgttaacgttgttaagtacttcggataaccgtaaataggtaacgtacgacgttaggaccgtacggaccgaaggaaccgtggtactggttaacgttcgtaagttcggtanagtaggtaagtaggtaggggttgggtacggtagtaccgtaggtaagg

SEQ ID NO: 256897 - DNA, 726 bp, Homo sapiens
  misc_feature: GYAE6OF02HBBHR.14.55.E11.1.454.CMB.1.raw
  modified_base (296)..(296): a, c, t, g, unknown or other
  misc_feature (296)..(296): n is a, c, g, or t
  modified_base (321)..(321): a, c, t, g, unknown or other
  misc_feature (321)..(321): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcgttgggttttcctcgttgcttcttttaagaggtgtccagttgtcgaggtgcagctggtggagtcgtgggggagcgtggtccaggccgtgggacgtcccgtgaccacgtcctccgtgtcgcaacgtctggacttcagtcttacgagttagtncggctagtcgcacggtcgggtcccncgacggcctaccgagggtacgaacggggtctgggaggttcgggtggacgtaggttcgtggtggtagagggtaacgtaaaggtaaataaacgggaaagttcgtacggacccggaacggtaccggtagggaaaccggtccgtacgtaccgtacccgtaacgtaccgtacccgaaggtaaacgtaccgtaaacttaacccaaacgtaaaccgtacgtttagtttacgttaacggttactaacgtaacgtaaagttaacgtaacgtaaccgtcgtaacggtaacggacggtaaccgggacgaacccggtacgtacggttagttaacgttagttaccggttggtacggtaacgtaaggtaaggtaggggtaggggttaggggtacggtaggttaccggtacggttaaggg

SEQ ID NO: 256898 - DNA, 796 bp, Homo sapiens
  misc_feature: GYAE6OF02GVE0H.14.55.E11.1.454.CMB.1.raw
  modified_base (284)..(284): a, c, t, g, unknown or other
  misc_feature (284)..(284): n is a, c, g, or t
tcagcgtctagtaccacgaccggtgctcgatttagcactcgcacgttgggctcgtgggagaggagcccagcactagaagtcggcggtgtttccattcggtgatcagcactgaacacagaggactcaccagtggtagtttgggctgagtcgttgggttttcctcgttgtcttacgttttaagtaggtgtccgtagttgtcgtaggtggcacgtcgttggtgggtacggttcggtgggggaacgggtcgtcgggtccgacgtccgggtcggggtacggttccccgngtaccgtaccttcccgtccgtggtacgccgtaaccggttccttgggtaacttcgtaggtacctttaccgaaggtttacgtttacgccggtactagttaccggtaccgtacggttccgggttccccgtaccgacggccgttacccgaaggacgggtacgggtcggtacgggtaggttcgggtcggcgttaggttggttggtagggttacgtaaggaggtaacggtaaagtaacggaaaggtcctgggaccgtaccgggaacttcgggaacggtacgtacgtacgtaacgtacgtaccgtaccgagtaacgaccgttaacgtaccaaacgtaacgtaagttgttactacgttctacgtactaaagtaacgtaatacggtacgacgtaacgacggtaacccggtaaggaaccgtacgggtacgttacggtgttaacggtttacgtacggttacgtaacggtagtaccgggtaggttacgggtaggggtacgggtacggttacggacggttaacgg

SEQ ID NO: 256899 - DNA, 780 bp, Homo sapiens
  misc_feature: GYAE6OF02G103R.14.55.E11.1.454.CMB.1.raw
  modified_base (355)..(355): a, c, t, g, unknown or other
  misc_feature (355)..(355): n is a, c, g, or t
  modified_base (391)..(391): a, c, t, g, unknown or other
  misc_feature (391)..(391): n is a, c, g, or t
  modified_base (397)..(397): a, c, t, g, unknown or other
  misc_feature (397)..(397): n is a, c, g, or t
  modified_base (602)..(602): a, c, t, g, unknown or other
  misc_feature (602)..(602): n is a, c, g, or t
  modified_base (611)..(611): a, c, t, g, unknown or other
  misc_feature (611)..(611): n is a, c, g, or t
tcagcgtctagtaccacgaccggtgctcgatttagcactcgcacgttgggtttgggggagctctgggagaggagcccagcacgtagaagtcggcggtgtttccagttcggtgatcagcactgaacacagaggactcaccagtggagtttgggactaggagcgttgggtttttcctgttgtacttaccgtttttaaggaggttcgtcctaggttgtcgtaagggtgacgacggtccttgggtggtacgttccggttagggggggacggtccggttacgggtaccacgggcccggttagggaacgggttccccctaggaacctacccgttcgtacccgtggtctacccgaacggttnacgggatttccacgtcttcgaagttagttagtcggntaacgnggtcctaggttcgggaccctccgacggtcctacggagccgggaagggctgggtaggtgggcggtagtaggttggtcgtaggtaccgtaagggtaacggttaaagaactaagggtaaaacgtgtaccggcggtaaccggtaccggtagggtaacggccgtacgttccgaccgtaacgtcgtaaccgagaaccgaacgtaaccgtanaaaaccgtntagttagtcgttatcgtacgtaacgtaagttagacgttcgacgttagacggttaccgaccgggaagtaacccggaggttacgttacggttaacggtaacgtttcgtaggtaaacggtcgttaaggggtaccggttagggttacggggtacggggttctaggttaacggg

SEQ ID NO: 256900 - DNA, 763 bp, Homo sapiens
  misc_feature: GYAE6OF02JZHGA.14.55.E11.1.454.CMB.1.raw
  modified_base (397)..(397): a, c, t, g, unknown or other
  misc_feature (397)..(397): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccaggcccgtggggacgtcccgtggacctacgttcctccgttagtcgctaaccggttcgtaggtacttccacggtcttaccgaagttaggtttagcgggtacctaggtcgtaccgaccggttcggggtaccccgcgacgggtacccgttaccggaacggggtcggaaaccgggggtntacggggtgggttcggggtaggccgttagggttgtggtaggttagttacgggtaacggtaaaaggttaacgtaaggtaaaagttcggtcgggaacccgacggtcccgggaagggtaacccgggcgtacgtaccgaaccgtacttccgaacggacgtaaacgaccttaaaccgtacaaccgtaaacgacgtttacggttaggtacttacgtacggtaaactaagtacgtaaacgtacggtaccgtaggaacggtaaaccggaccggtaaagacccggtaacgtccgtaggttaaccgttaacgttgttacggacgttcgaaggtaaggtagggtgggtaccgggtaggtacggtacgtacgtaaggg

SEQ ID NO: 256901 - DNA, 646 bp, Homo sapiens
  misc_feature: GYAE6OF02HN7HK.14.55.E11.1.454.CMB.1.raw
  modified_base (165)..(165): a, c, t, g, unknown or other
  misc_feature (165)..(165): n is a, c, g, or t
  modified_base (186)..(186): a, c, t, g, unknown or other
  misc_feature (186)..(186): n is a, c, g, or t
  modified_base (266)..(266): a, c, t, g, unknown or other
  misc_feature (266)..(266): n is a, c, g, or t
  modified_base (339)..(339): a, c, t, g, unknown or other
  misc_feature (339)..(339): n is a, c, g, or t
  modified_base (370)..(370): a, c, t, g, unknown or other
  misc_feature (370)..(370): n is a, c, g, or t
  modified_base (562)..(562): a, c, t, g, unknown or other
  misc_feature (562)..(562): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttggctgagcttgggttttccncgttgcttcttttaagaggtntccagtgtcaggtgcagctggtgagtcgtgggggagcgtggtccagccgtggggacggtccctaggagacctctccgtgngcctagccctgtggaatttccgaccttcacgtacctagtgtctatcgactcggtacggtccgccctaggtccnccgagggcggacggggtctgggtaggtgggngtacgtattagactcagagtagtagtacggtaacttaaagacggacgtcctagccgaccgtacgtaccggtgggaaacgggtcctacttaccactacctaccgtaccgaaagtaccgtaaactaaccgttaacccaaaggaaacccacggacctaacgtacgtaccagtaacgaaatacgaaacgcgtaacnggaactggaccgtagaacggtacccgtacggttctttagttaacctggttacgggtagggagtaaggtagtacgggaggttacg

SEQ ID NO: 256902 - DNA, 725 bp, Homo sapiens
  misc_feature: GYAE6OF02F9MAT.14.55.E11.1.454.CMB.1.raw
  modified_base (172)..(172): a, c, t, g, unknown or other
  misc_feature (172)..(172): n is a, c, g, or t
  modified_base (242)..(242): a, c, t, g, unknown or other
  misc_feature (242)..(242): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccagccgtgggacgtccctgacnctctcgtgtgcaacgtctggacttcagtcctttacaggtttagttactggcctagtcgcctacggttcggggtcccacgaggccctaccggagggccgaagggggtctaggggaggtgggtggctaggtttcgtaggtacggtatacgggaaacgggtaagttaaacgaaaggtaaaggttcgccgggtacccgaaccgggtacccgggttagggaaacggggttcccgtacgttaccgtaacctacgttaccgtaccgtaacgaacgtaaccgtaaacttaacccgaaacctaaacgtaagttacgttacgttacttacgtacgtaactaagtaacgtaaagttaccggtaccgttaggaacggacgaaccgggacggtaaccgacggtcgttagttcgttaacgttaacgttcggtagttaccgaaggtacggtagggttacggggtagggggttacggtacggtaccgtacggttaaggg

SEQ ID NO: 256903 - DNA, 871 bp, Homo sapiens
  misc_feature: GYAE6OF02IW6N8.14.55.E11.1.454.CMB.1.raw
  modified_base (183)..(183): a, c, t, g, unknown or other
  misc_feature (183)..(183): n is a, c, g, or t
  modified_base (410)..(410): a, c, t, g, unknown or other
  misc_feature (410)..(410): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagcttgggttttcctcgttgcttcttttaagnggttgtccagtgtcgaggtgcagcgtgggtggagttcggtggggggacggcggtcggtcccgaggccgtgggggacggttcccctggaacctaccgttccttccgtggtcgacctaacggtcgtaggtacttcgacgtcttacgtaggttagtttagtcggctacgtgaccgtacggtcggggtccccgccgacggcctaccggagggccgtaaggggtcgtagggnggggtgggtggtcgtaggttggtcggttggtacggtaggtaaacggtaaagtaagtaaaggtaaacgtagacgggtacccggtacggtacccgggtaggggaacccgggtaccgtaaccgttacccgtaacccgtacgttacccgtaccgaaacgggtaaaccgtaaacccgttaaaccgtaaccccaaaaccgttaaacccgttaaggtttaccggttttaacgttaccgttaccggttaacgttaaacccgttaaaagtaaggtaaaccgtaaccggttacccgttaagggaaaccgggtaaaccggaacccgggtaaaccgggtaacccggtaacgggttccggttttacggtaaacggttttaaccgttacgggtttaacggttaaccggttaaggaacgggttaaggtaaggggttacggggggttaggggggtttaacgggtacgttaaaccggg

SEQ ID NO: 256904 - DNA, 695 bp, Homo sapiens
  misc_feature: GYAE6OF02HOFZZ.14.55.E11.1.454.CMB.1.raw
  modified_base (401)..(401): a, c, t, g, unknown or other
  misc_feature (401)..(401): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgtagctgggtggagtcgtgggggaggcgtggtccaggccgtggggagtccctgacactctcctgtgcaacgtctggattcagcttcgagttagttatggactatcgctacgtcgggtcccgccgaggcctaccgaggcgaagggggctagggagtggggtgcgtaggttcgtggtggtagtggaaacggtaagttaagtaaggaaagttanacgggtacccggacggtacccgggttaggggaaacggggtcccgtaacgtttccgaacccgtacgttaccgtaaccgtaacggtaaccgaaccgttaaacttaccccaaaacgtaaaccgtaagtttacggtttaagttacttaccgtacgaacgtaaagtacgtaaacgtacgtaccgtaaggacggtacgacccggaggaaccgacggttcgtggttacgttagtttacggttggttacgtacgtagtaggtaggtggggtagggggtgtaggtacggtccggtaggttacg

SEQ ID NO: 256905 - DNA, 867 bp, Homo sapiens
  misc_feature: GYAE6OF02G163D.14.55.E11.1.454.CMB.1.raw
  modified_base (180)..(180): a, c, t, g, unknown or other
  misc_feature (180)..(180): n is a, c, g, or t
  modified_base (199)..(199): a, c, t, g, unknown or other
  misc_feature (199)..(199): n is a, c, g, or t
tcagcgtctagtaccacgaccggtgctcgatttagcactcgcacgttgggctcgtgggagaggagcccagcactagaagtcggcggtgtttccattcggtgatcagcactgaacacagaggactcaccagtggagtttgggctggagtcgttgggttttcctcgttgcttcgttttaagnggtgtccagtgtcgaggtncgagcgtggtaggagtcgtgggggagtcgtggtccagccgtaggggtacgtccctagacctcgtccgtcctagtcgactacgtcgtaggacttcgagtccttgaaggttacgttagcggactagtcgaccgtacggtccggggtcccgaccgtaggtcccctaccgggagggtaccggaaaggggtccgttagggggacgggttcgggggtcggtaaccgtttaggggtttcggttagggttaccgggttaaggtacggggtaaaaccggtttaaaaggtttaaactaaaacggggtaaaacggtttacgacccggggttaaccccggaaccgggttccccgggggtaaaagggtaaacccggggttacccttaaacgttaccccgtaaacccggttaacgtaacccgtaacggtaaacggtaacgtaaaacccttaaccgtaaaccccgaaaacttaacgttaacgttacggttttaactacgttacgtaaaccgaaacgttaaagtaccggtaaagtaccgggttaacgtacgtacggaaccgtaaccgggtaaacggaccgtacgtaggtttacgttagtttaaccgtacggttaggttacgtaacggtacggtaaggtacggggttaggggtaccggggttacgtagggtaacgtcggttaagg

SEQ ID NO: 256906 - DNA, 698 bp, Homo sapiens
  misc_feature: GYAE6OF02IFKCR.14.55.E11.1.454.CMB.1.raw
  modified_base (156)..(156): a, c, t, g, unknown or other
  misc_feature (156)..(156): n is a, c, g, or t
  modified_base (238)..(238): a, c, t, g, unknown or other
  misc_feature (238)..(238): n is a, c, g, or t
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcacaatggagtttgggctgagctgggttttccncgttgcttcttttaagaggtctccagtgtcaggtgcagctggtggagtcgtgggggagcgtggtccagccgtgggacgtccngacgactctccgtgcncgagccttcgnggtacttccaccgtttcaacgtaccttagcgtctatcgacctcggttaccggggtcccaccgagggccctaccggagggccgggacgggggtcttaggggacggtcggggtggaaccgttatttaacgactccaagtagtaggtaacgtacggtaaaaactaagtcgggtaccgtcgttacgtaccggacccgtaccgttaccggtacgggaacgggtcccgtaacttaccgaacctactaccgaaccaacggtacgtaaacctaaaccgttaacccaaaagtaaccgaccgtacgttaagaccttacgtacgaaactaaacgtacgaacgtacgaccgtagacgtacgacgaggacgccggtaaggtcgtaacgttagttaccgttagtggttaccgagtaacggaggtagggttagggggtagggttacgg

SEQ ID NO: 256907 - DNA, 768 bp, Homo sapiens
  misc_feature: GYAE6OF02FM6X6.14.55.E11.1.454.CMB.1.raw
  modified_base (161)..(161): a, c, t, g, unknown or other
  misc_feature (161)..(161): n is a, c, g, or t
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (334)..(334): a, c, t, g, unknown or other
  misc_feature (334)..(334): n is a, c, g, or t
  modified_base (369)..(369): a, c, t, g, unknown or other
  misc_feature (369)..(369): n is a, c, g, or t
  modified_base (390)..(390): a, c, t, g, unknown or other
  misc_feature (390)..(390): n is a, c, g, or t
  modified_base (701)..(701): a, c, t, g, unknown or other
  misc_feature (701)..(701): n is a, c, g, or t
tcagcgtctagtaccacgaccggtgctcgatttagcactcgcacgttgggctctgggagaggagcccagcactagaacgtcggcggtgtttccattcggtgatcagcactgaccacagaggactcaccagtggagtttcgggctgagcgttgggttttccncggttgccttcttttaaggaggtcgtccagtgtcaggttgcagtctgggtaggagtcgtgggggagcgttggtccagccgtgggacgttcccnggaccncgtctcctgtgcgtaacgtcgaggtacttcacgtcttactaggttatacgnggacntcgacacggtcgggtccncgacggcctacggacggtacgacgggtcgtacggnggtggacggcgttaggtggtnttacgggagttacggaaggtaacgtaacgaacggtaagtcgtaccgggtacccgtccggtacggtaccgggacgggttaccgttacgtaccccgtaaacccggtacgtttacccgtaacccggaaggtaacctaaacccgttaaacccggtttacccgaaacttaccggtttaaggtttacgtttaaccggttagtaccgttaacggtaaacctaaggggttactaaaccggttacctaacggaggtaaccgttgggaacccgtagggaaccccgtaggtacctttagtaccggttacttggggttacccngggttaaccgaagggtacgtggggtttaccggggagggttcgaacccgtttaggtaccgttaagggg

SEQ ID NO: 256908 - DNA, 786 bp, Homo sapiens
  misc_feature: GYAE6OF02G32L5.14.55.E11.1.454.CMB.1.raw
  modified_base (246)..(246): a, c, t, g, unknown or other
  misc_feature (246)..(246): n is a, c, g, or t
  modified_base (263)..(263): a, c, t, g, unknown or other
  misc_feature (263)..(263): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccagtggagtttgggctgagctgggttttcctcgttgctcttttaagaggtgtccagtgtcaggtgcagcgtggtggagtcgtgggggagcgtggtccagccgtgggacggtccctgaccnctctcctgcgcaacgtntggtattcagtcttcaagttagttatggctatcgaccgtcgtcggtcccgaccaggtcctccgaggaccggaggggtcgtaggggacggttggggtacggacggtaggtttcggtaggttcgggtaacgtagggtaaacggtaaaaggttaaacgtaaacgggtaaagttacgtcggacccggtacggtcccggtagggaaacggggtccctaacgtttacccgaaccgttacgtaccgtaaccaaagggtacgaaacccttaactaacccgaaaaccgtaacttaaggtttccgtttaagtaacgtttaccgttaacggaaacttaaaacggtcgtaaaacgttaccggtaccgtaagggaaaccgtaccgggaacccggggaaacgtacccggtacgggttacgttacggtttacgtttaacccgtttaggtaccggttacggtaacggtaacgggtaacgggttaggggttagggggggttacggggttcgggtaacggtttccggtacggttaaggggg

SEQ ID NO: 256909 - DNA, 531 bp, Homo sapiens
  misc_feature: GYAE6OF02GYJ3H.14.55.E11.1.454.CMB.1.raw
  modified_base (362)..(362): a, c, t, g, unknown or other
  misc_feature (362)..(362): n is a, c, g, or t
  modified_base (426)..(427): a, c, t, g, unknown or other
  misc_feature (426)..(427): n is a, c, g, or t
  modified_base (465)..(465): a, c, t, g, unknown or other
  misc_feature (465)..(465): n is a, c, g, or t
  modified_base (506)..(506): a, c, t, g, unknown or other
  misc_feature (506)..(506): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgacactctcctgtgcaacgtctggattcagcttcagtagttatggcatgcacgtcgggtccgcaggctccaggcaggggctgggagtgggtgcaggttgtgtggtatggacggtaagtatagaagtntggccgcgccgtgaacgggcgtatcaccatctcagacgacaattccaacactatcgttgtactnnactaaatgaatagctaggacgagaccgaggacacggtntgtagtacttaacgtggttacgtcgagtaggacgtaggggnggggttaggtggacgttacggaggg

SEQ ID NO: 256910 - DNA, 778 bp, Homo sapiens
  misc_feature: GYAE6OF02GMJSC.14.55.E11.1.454.CMB.1.raw
  modified_base (344)..(344): a, c, t, g, unknown or other
  misc_feature (344)..(344): n is a, c, g, or t
  modified_base (546)..(546): a, c, t, g, unknown or other
  misc_feature (546)..(546): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctcggagtgccagatgtgacatccagatcgacccagtcctccacttcctcccgtgtcctagctatcgtaggtacggacgacaggacgtccaaccagttcctacggttcggcccggggaactaaacggttcgacggagtacctaagttaaacgaactttaagttttaaaagttcggtaactaacaaacgtaaacgaaaacccggtaacgggggtaaaccnccccctaacggtcccttacccgtagtacgttaccttaacgtcgacgttcgactaacgttccgtagtttcgacgtacggtacgggttccggtaccgtacgttaacgtcgtagggtcgtcggtaacgtcggtagtcggtaggaaactgtttactccgacttaccgtctaccgtatcggacttgtacgacgacttaacgaagttnttacttacgcctttaacgtttactacgttactaaccgaaacgttacgtaacgttacccgtaccccgtttacccgtacgttaaccggggttcccgggaaccggggtaacgaaaccggttacgggacccgggtaaatccggttaaccggtaacggtaaccggtaaccggttccggttaaggacctttaccccgggaacttccgtaccgttactttaccggtcctacctaacccg

SEQ ID NO: 256911 - DNA, 570 bp, Homo sapiens
  misc_feature: GYAE6OF02JUPIE.14.55.E11.1.454.CMB.1.raw
  modified_base (238)..(238): a, c, t, g, unknown or other
  misc_feature (238)..(238): n is a, c, g, or t
  modified_base (260)..(260): a, c, t, g, unknown or other
  misc_feature (260)..(260): n is a, c, g, or t
  modified_base (282)..(282): a, c, t, g, unknown or other
  misc_feature (282)..(282): n is a, c, g, or t
  modified_base (303)..(303): a, c, t, g, unknown or other
  misc_feature (303)..(303): n is a, c, g, or t
  modified_base (382)..(382): a, c, t, g, unknown or other
  misc_feature (382)..(382): n is a, c, g, or t
  modified_base (406)..(406): a, c, t, g, unknown or other
  misc_feature (406)..(406): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggagtcccngacactctctgtcgcaacgtcnggattcagcttcagttagttanggcagtcgcacgtcgggtccncgaggctcggaggcggaaggggtctgggaggtgggtggctaggttgtggtaggtatggaaggtaagtaataaggaagtngaccgacgcgagacggcatcaacntcgacagacaactaactaccaactacagttgttcgtactgtagaactaatagatacggctacgacgtacgccgaacggtactacgggtactaggtacgtattaacggttgtgtacgtaaggtcggtaaggtgggggacgggttgacggttacgtacggttaagg

SEQ ID NO: 256912 - DNA, 636 bp, Homo sapiens
  misc_feature: GYAE6OF02HV155.14.55.E11.1.454.CMB.1.raw
  modified_base (173)..(173): a, c, t, g, unknown or other
  misc_feature (173)..(173): n is a, c, g, or t
  modified_base (287)..(287): a, c, t, g, unknown or other
  misc_feature (287)..(287): n is a, c, g, or t
  modified_base (393)..(393): a, c, t, g, unknown or other
  misc_feature (393)..(393): n is a, c, g, or t
  modified_base (505)..(505): a, c, t, g, unknown or other
  misc_feature (505)..(505): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgcttcttttaagnggttgtccagtgtcaggtgcagctggtggagtcgtgggggagcgtggtccagccgtgggacgtccctgacactctccgtgtcgcaacgtctggattcagtcttcagttagttanggctatcgctacgtcgggtccgccaggcctcgagggcgaaggggctgggaggtgggtcgactggttggtgtgggtaatgggaacggaagttaaataggaaaagttntacgccgtaacggccggtaggaacgggtcccgtattacaacctatccgtacaagaagtaacctaaacttacccaaactaactaagttagtttagtactcgtacgaataaagntaaagtcgtacgtaggacgtacgaccggaacgaacgtacggtacgtgttaagttaacgttacgttaggttgtaaccgagggtaacgtagggtacgggggtaggggttggtacggtacggtaccggttaagg

SEQ ID NO: 256913 - DNA, 640 bp, Homo sapiens
  misc_feature: GYAE6OF02IOVJ2.14.55.E11.1.454.CMB.1.raw
  modified_base (176)..(176): a, c, t, g, unknown or other
  misc_feature (176)..(176): n is a, c, g, or t
  modified_base (180)..(180): a, c, t, g, unknown or other
  misc_feature (180)..(180): n is a, c, g, or t
  modified_base (196)..(196): a, c, t, g, unknown or other
  misc_feature (196)..(196): n is a, c, g, or t
  modified_base (260)..(260): a, c, t, g, unknown or other
  misc_feature (260)..(260): n is a, c, g, or t
  modified_base (298)..(298): a, c, t, g, unknown or other
  misc_feature (298)..(298): n is a, c, g, or t
  modified_base (360)..(360): a, c, t, g, unknown or other
  misc_feature (360)..(360): n is a, c, g, or t
  modified_base (383)..(383): a, c, t, g, unknown or other
  misc_feature (383)..(383): n is a, c, g, or t
  modified_base (414)..(414): a, c, t, g, unknown or other
  misc_feature (414)..(414): n is a, c, g, or t
  modified_base (427)..(427): a, c, t, g, unknown or other
  misc_feature (427)..(427): n is a, c, g, or t
  modified_base (590)..(590): a, c, t, g, unknown or other
  misc_feature (590)..(590): n is a, c, g, or t
tcagcgtctagtaccacgaccggtgctcgatttagcactcgcacgttgggctttgggagaggagcccagcactagaagtcggcgtgtttccattcggtgatcagcactgaacacagaggactcaccatggagtttgggctgagcgttgggttttcctcgttgcttcgttttaaggnggtntccagtcgtcagggtncgtagcgtaggtggagtcggtaggggagtcgtcggtcagtccgtgggcgtcctgactactctcngtgctacgtcgtgtactacacgcttacagttagttagnggctaagtcgctacggttcgggtccacgtcggcctacggagtaccgggtagggccttagggngggtcggaggtcgtacggtttgnggtacgtaaggtggaaacggttaacgttaanaagggtaacggtntaccggtcgacggtacggtaggaccggcttacgtaccgctaacgtcaacgacgaacgactaactaccgaaatacgttagttacgttagtactagtacgtacctaatacgtataacgtcgagacgacgtcgaacggtacgtaccgtgttatcgttagtacggtntcgaagtagaggttagggtggtagggttcgtagtacgtccggtagtacgg

SEQ ID NO: 256914 - DNA, 710 bp, Homo sapiens
  misc_feature: GYAE6OF02I2LOV.14.55.E11.1.454.CMB.1.raw
  modified_base (199)..(199): a, c, t, g, unknown or other
  misc_feature (199)..(199): n is a, c, g, or t
  modified_base (222)..(222): a, c, t, g, unknown or other
  misc_feature (222)..(222): n is a, c, g, or t
  modified_base (227)..(227): a, c, t, g, unknown or other
  misc_feature (227)..(227): n is a, c, g, or t
  modified_base (433)..(433): a, c, t, g, unknown or other
  misc_feature (433)..(433): n is a, c, g, or t
  modified_base (498)..(498): a, c, t, g, unknown or other
  misc_feature (498)..(498): n is a, c, g, or t
  modified_base (506)..(506): a, c, t, g, unknown or other
  misc_feature (506)..(506): n is a, c, g, or t
  modified_base (524)..(524): a, c, t, g, unknown or other
  misc_feature (524)..(524): n is a, c, g, or t
  modified_base (564)..(564): a, c, t, g, unknown or other
  misc_feature (564)..(564): n is a, c, g, or t
  modified_base (700)..(700): a, c, t, g, unknown or other
  misc_feature (700)..(700): n is a, c, g, or t
tcagcgtctagtaccacgaccggtgctcgatttagcactcgcacgttgggctctgggagaggagcccagcactagaagtcggcggtgtttccattcggtgatcagcactgaaccacagagtacctcacctagtggagtttcgggacctggacgtcgtttcggggtttttccctcgttcggtcctttacgttttaaaggnggttggtccctaggttgtaccgnggtcncgagtcgtggtggtacgtcggtgggggacgtcggtcggttaccgaggtccgtacggggtaaccgttccccgtggacctaccgttccgtaccgtggtacgacctacgttcgtaggtacttcgaacgttccgtactaggttaacgttgtgaccgtgtcgtaccgcgttcgggtcccaacgtacgccgttcgaacggtccgaacgggtntagggtcgtagggttccgagttgggttacgtggtaacgtgtaggaacgtaagtaactagaacgtnccgtacgngaccgtagagcctatacnctagtcgaactcgtaacgacacgtactacgtactagttanacgtatacgactagtaatacgtagacgtgtacggtagacggtacgaccggtagacgtggttaccgagttagtcggtacctaggtaccgaaccggttagggtacggtaggggttacgttacgggtaccgttaccggnggtttaacgg

SEQ ID NO: 256915 - DNA, 704 bp, Homo sapiens
  misc_feature: GYAE6OF02H7ISZ.14.55.E11.1.454.CMB.1.raw
  modified_base (178)..(178): a, c, t, g, unknown or other
  misc_feature (178)..(178): n is a, c, g, or t
  modified_base (310)..(310): a, c, t, g, unknown or other
  misc_feature (310)..(310): n is a, c, g, or t
  modified_base (319)..(319): a, c, t, g, unknown or other
  misc_feature (319)..(319): n is a, c, g, or t
tcagcgtctagtaccacgaccggtgctcgatttagcactcgcacgttggggtttgggggctctgggagaggagcccagcactagaagtcggcggtgtttccattcggtgatcagcactgaacacagagactcacatggagtttggctgagcttgggtttcctcgttgctcttttaagnggtgtccaggtgtcaggtgcagcttgggtggacgttggtgggggagcgttgggcccaaggccgtaggggacgtccctaggaactctcgtctagcggcctaacgtctggattcgagtaccttgagttaattgnggtcaagtnctaggtcggtcccgacgcgtccacgaggtaccgaaggggtcgttagggaggttgggcggatagggttgtgggttgtaacggaggtaaacggttaaagtaacgtaaagtaaacggtatacgggaccgacgggacgtagggaaccggggtacgtaccgttacgaaacctacgtacgccgaaacgtaagaaccgtaaacgtaccctaaaactaaccgtaagttagttacgtaattacgtaccggaaactaaacggttaagaattaaccggaccgttaagacgtaacgaccgggtaagaccgtaccggtacttggtaacgttacttaaggttctaggtaacgtaggaacggtggtaagggggttcggggtaggtacggtagttaacggg

SEQ ID NO: 256916 - DNA, 726 bp, Homo sapiens
  misc_feature: GYAE6OF02HPHNQ.14.55.E11.1.454.CMB.1.raw
  modified_base (164)..(164): a, c, t, g, unknown or other
  misc_feature (164)..(164): n is a, c, g, or t
  modified_base (181)..(181): a, c, t, g, unknown or other
  misc_feature (181)..(181): n is a, c, g, or t
  modified_base (265)..(265): a, c, t, g, unknown or other
  misc_feature (265)..(265): n is a, c, g, or t
  modified_base (323)..(323): a, c, t, g, unknown or other
  misc_feature (323)..(323): n is a, c, g, or t
  modified_base (354)..(354): a, c, t, g, unknown or other
  misc_feature (354)..(354): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagctgggtttccncgttgcttcttttaagnggtgtccagtgtcaggtgcagctgggtggagtcgtgggggagcgtggtccagccgtggggacgtccctgaccacgtctcctgtncaacgtctggacttcgagtcttacgagttagttagtggacatgccacgttcgggtccnccgaggcctccgaggacgaaggggctagggngtggggtgcgtaggttggtgtagggttacgagggtaacggtaaagtaaagtaaggaaaagttgtacggcccggaacggtccggtaggaacgggccctaagttccaaccgtacttcccgtaccgaacggaacgtaaacctaacgttacccaaaactaaacgttacgtttacggttagttactaccgttacggaacttaaaacggttgtaaaaccgttacggtacccttagggaaacgtaccggggacccgtaagggacccggtacgggtctttacggttaacggtaacgttttaacggtcgggttaagtacccggtaagggacgggttacgggtttacgggggggtaaggggggttacggttaggtaacccgg

SEQ ID NO: 256917 - DNA, 662 bp, Homo sapiens
  misc_feature: GYAE6OF02JOM3B.14.55.E11.1.454.CMB.1.raw
  modified_base (208)..(208): a, c, t, g, unknown or other
  misc_feature (208)..(208): n is a, c, g, or t
  modified_base (313)..(313): a, c, t, g, unknown or other
  misc_feature (313)..(313): n is a, c, g, or t
  modified_base (564)..(564): a, c, t, g, unknown or other
  misc_feature (564)..(564): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagcgttgggttttcctcgttgtcttcgttttaagaggttgtccagtgtcaggtgcagcgtggtggngtcggtagggggtaggcggtggtccagccgtgggacgtcccgtgaccactctccgtggtcgctaacgtctggtacttcgacgtcttacgagttagtagtggctancggctacggtcgggccgtaccgaggtcctaccggacggcggaacggggtcgtagggtacgggtggggtcggacgtagggttggtggtaggttagtaggaaacggtaaaggtaagtaagtagtaggtcgaccggacggtaccgtagggacggtaccgtactacgacgtactacgtacgagtaaccgactaactaaccgtaaacgtactagttacgttctactacgtacgtaactaagtagtactacgtacgngacgtaccggacggaagaccgtacgtacgtagttacgtagttacgtaggtcgtaggacgtaggtaggtgggtacggggtgtcggtacgtaggtaacgg

SEQ ID NO: 256918 - DNA, 923 bp, Homo sapiens
  misc_feature: GYAE6OF02GPJNJ.14.55.E11.1.454.CMB.1.raw
  modified_base (419)..(419): a, c, t, g, unknown or other
  misc_feature (419)..(419): n is a, c, g, or t
  modified_base (907)..(907): a, c, t, g, unknown or other
  misc_feature (907)..(907): n is a, c, g, or t
tcagcgtctagtaccacgaccggtgctcgatttagcactcgcacgttgggctctgggagaggagcccagcactagaagtcggcggtgtttccattcggtgatcgagcactgaacacagaggactcaccagtggtagtttgggctagagtcgttcgggtttttcctcggttcgtacctttacgtttttaaggacggttcgtaccaggttgtccgaggtcgacagtcggttggtcggtagtcgggtagggggagtcggttcggtaccacggtccggttggggtaccgtcccgtaggaaccttaccgttccgtaccgttgtcgaccgtaacgttccgtaggtacttacggtcgtccgtttacgaaggttaacgttacgtgggtacctaggtccgtaccggtaaccggttccggggtaccccnccggtaaggtcccgttaccggaacgggtaccgggttaacgggggtccgttgggggtacgggtttacggggttaccggggtaccgtttaaggggttttcggtaccggggttttagggttaaaacccggtaggggtaaaaccggggttaaaagtttacggttaaaaaacggggaacgtttacggtacccgggaacccggggtttaacccggtaccggggttaaccggggacggttacccgtaactttacccgaaccctttcggtaaacccgtacgtaaacggtaaccgtttaaacctaaccgttaacccaaacggttacgttaacggtttcgttaagtccgttaacgtaacgtaacgtaacggttacgtaagtaccgtaccggtaagtacggaccgggtaaccgtcgaaacgggtcgttacgttacgggtactttaccggtacggtacgtccgttaaggacggttaaggtcgggagggttggttacggtntaacggtcggtaaggg

SEQ ID NO: 256919 - DNA, 707 bp, Homo sapiens
  misc_feature: GYAE6OF02JHDKT.14.55.E11.1.454.CMB.1.raw
  modified_base (648)..(648): a, c, t, g, unknown or other
  misc_feature (648)..(648): n is a, c, g, or t
  modified_base (663)..(663): a, c, t, g, unknown or other
  misc_feature (663)..(663): n is a, c, g, or t
tcagcgtctagtaccacgaccggtgctcgatttagcactcgcacgttgggtttggggagtctcagtcaggacacagcatggacatgagggtccccgctcagctcctggggctcctgctactctcggctccggaggtcgccagatgtgacatccagatcgacccagtcctccatcccctccctgtcctgcacttctagtaggagaacagtacgtaccacactctacgttcggcccggaacaacgtcagacgctaatttaaacgaacttaaattttaagttacggttaataccaaaacgaacgaaaaccgaggaaaccgtacccctagtaaccccgtcctagagttacctagtcgtactcgtacaacttccgttagtttcgaacgtacgtacggggttccggttacccggtacggtaacggttaacgtacggtacgggtcgtaacgggttacggtaacgttcgtacggggtacaaggttacctttacctaccttcctaaccgtaccgctacgtacgacgtttccgaacgtactaaaccgtaagttacttaagttccgttacttaccttacttactataccgtaatacggtacttacccgacccttaccctacccgttggttaccggacggacggtaacgacgtagactanaaccgagtaacccgntacggacgtcgtacacaccttacgtcgttacgttaccttctacc

SEQ ID NO: 256920 - DNA, 653 bp, Homo sapiens
  misc_feature: GYAE6OF02FOALN.14.55.E11.1.454.CMB.1.raw
  modified_base (180)..(180): a, c, t, g, unknown or other
  misc_feature (180)..(180): n is a, c, g, or t
tcagcgtctagtaccacgaccggtgctcgatttagcactcgcacgttgggtttggggagctctgggagaggagcccagcactagaagtcggcggtgtttccattcggtgatcagcactgaacacagaggactcaccatggagtttggctgagctgggttttcctcgttgctcttttaagnggtgtccagtgtcaggtgcagctggtggagtcgtgggggagcgtggtccagccgtgggacgtccctgacactctcctgtgcaacggtctggatttcagccttcagtagttatggccagtgcgacgtcgggtccgcctacgggctccgaggcgaaggggtctgggtacggtggggtggcaggttggtggttggtagtggaacggtaaagtaaagtaaggtaaaagttagtcggaccggaaccggtccggtaggaacgggtccgagttaccaccgaacttcaccgacgagactaaacgttaccgaaaccaactacttaggttcgttaatccgtagtaactaaacgtagtaaagtaacgtcgtacggtaacgacgaccggaaggaccgacggtcgtaggttacgttaacgtttaccgttaggttacgtagaacggtaggtaacggtagggggtaggggggttagggtaggtaacgg

SEQ ID NO: 256921 - DNA, 920 bp, Homo sapiens
  misc_feature: GYAE6OF02FSYJV.14.55.E11.1.454.CMB.1.raw
  modified_base (732)..(732): a, c, t, g, unknown or other
  misc_feature (732)..(732): n is a, c, g, or t
  modified_base (892)..(892): a, c, t, g, unknown or other
  misc_feature (892)..(892): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccagtggagtttgggctggagtcgtgggtttttccctcgtttgaccttctttttaaaggcggttgtaccaaggtttcgtcctaagggttgccgtaggtccgttaggggtacggtaggtccggttagggggggggacgtccgtttcggggacccctaaggtcccggttagggggggaacgttccccctagggaaccttaccgtccgttcccttgggtacgggacctaacggttccgtaggggtacttaccgaggtaccgtttaccaaggtttagttagtcggtcgtacgtgtaccgtaacggtttcgggccccgtacgaaccgggttccgacccggtacggtaccggaagggtccgtacggggacggttaggggtacggtcgttaggtttgggtggttacgggtaagtacgggtaaccggtaaaagtaagtaaacggtaaaggttacgtaccggtaccggttaaccgggccgggttaaggaacggggttacccgtaacggttaccgtacccgtaacgtttccgttaacccggaacggttaacgaacgtttaacccgtaacccgtaaaccgtacggtaaacgttacggtttaacgtacgtaccggttanaaaccgttaacgtaacggttaactaggtacccgttagggaaacggttacgaaccgggaggtaacccgttaccgggtacctttgggtaaccgtttacgtttaactacggttacggtaacccgttaggaaccgggtaagggttacccggggggttaaggggngttaaccgggtaccgttaccgtaagggg

SEQ ID NO: 256922 - DNA, 893 bp, Homo sapiens
  misc_feature: GYAE6OF02ILERN.14.55.E11.1.454.CMB.1.raw
  modified_base (174)..(174): a, c, t, g, unknown or other
  misc_feature (174)..(174): n is a, c, g, or t
  modified_base (283)..(283): a, c, t, g, unknown or other
  misc_feature (283)..(283): n is a, c, g, or t
tcagcgtctagtaccacgaccggtgctcgatttagcactcgcacgttgggctctgggagaggagcccagcactagaagtcggcggtgtttccattcggtgatcagcactgaaacacagaggactcaccatggagtttggctgagcttgggttttcctcgttgcttcttttaagnggttgtccagtgtcaggtgcagcgtgggtggagtcggtgggggaggcgttcggtccaggtcccgtggggacggtccctggaaccacgttctccgtgtcgccaacgttcnggtatcagtccttacgaggttagttagtcggactagtcggtacctaccggttaccgggtccccgaccggacggtaccgtcccggagggtaaccggtaacgggggtcccgttagggggtaacgggtcgggggtacggtacgttaagggtttggtggtttaacggggtacggtaacgggggtaaaacgggtaaaggtttaaaaggttaaaacgggtaaaaggttaccgtaccgggaaccccgggttaaacccgggcccggggttaaaagggaacccgggggtacccgttaaacgtttacccgaaacccggttaaccgtttaccgaacccgaaaggtaaaccggtaaacctaaacctttaaacccgaaaaccgtaaaccgttaagttttacgggtttaacgtaccgttcgttaacgtaaccgttaaaacgtaacggttaaacgtaagtacccggtaggaaaccgggaccggacccgggtaaaaggacccgggttaaccgggtactttacgggttaaccgtttacggtttaaacgtcggttaaccgggtaacgtaagggtacggttaagggtacggggttaggggttacggtaggtaccggttacggtaacggg

SEQ ID NO: 256923 - DNA, 745 bp, Homo sapiens
  misc_feature: GYAE6OF02JHI0W.14.55.E11.1.454.CMB.1.raw
  modified_base (170)..(170): a, c, t, g, unknown or other
  misc_feature (170)..(170): n is a, c, g, or t
  modified_base (188)..(188): a, c, t, g, unknown or other
  misc_feature (188)..(188): n is a, c, g, or t
tcagcgtctagtaccacgaccggtgctcgatttagcactcgcacgttgggctctgggagaggagcccagcactagaagtcggcggtgtttccattcggtgatcagcactgaacacagaggctcaccatggagtttgggctgagcttgggtttcctgttgcttctttaagnggtgtccagtgtcaggtncagtcgtgggtagacggtcgtgggggagtcgtggtccgagcgtagggacggtccctgacctcgtctccgtgtcgactacgtcgtgacttcagtacttcacggttaacgtatcgggtcctacgtcggtctacggttcggggaccctcccggtacggtaccgttccggaacgggaccggtaacgggggtctacggggtacggttaccggggttcggtaacgtagggttcggtgggtaacgttacgtaaggggaaccgttaaaaggtataaagggtaaaccgtcggtaacgtacccggaacgtccggagggaaccggtccgtacgtccgaacctaccgtaccgactacgtacgtactaactaaccgtaacaacgttagtacgttacgtacgttcgacgtaaccgtagtaacgtaaagtaccgacggtacggtaccggtaacgcccggaaggtaacccgtcggtaacggttacgttacggtacttaacggttacggtacgtaacggtaacggtcggtaagggtaccggggtagggtcggttaggtaccgttacggtaacgg

SEQ ID NO: 256924 - DNA, 842 bp, Homo sapiens
  misc_feature: GYAE6OF02F6Z05.14.55.E11.1.454.CMB.1.raw
  modified_base (261)..(261): a, c, t, g, unknown or other
  misc_feature (261)..(261): n is a, c, g, or t
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggttgtccagtgtcaggtgcagctggtggagtcgtgggggagcgtggtccagccgtgggacgtccctgacactctcctgtcgcaacgtntggattcagtcttcagttagttagtggactagtcgcgtaccgttcggggtccccgaccgagggtccctacccggaaggggtaccgaaacggggggtcttagggggagggttgggggtacgggcctagggttttgtgggttacgggttagaacggaacggggtaaaagttaaacgtaaggaaaaggttacgtcgggaccccggtaacggtccgggttaagggaaacgggggtccctaacgtttacccgaacccgtacttacccgtacccgaaaggtaaaccggtaaacccttaaaaccgtttaccccgaaaaaccgtaacccgttaaagtttacgggtttaagttaaacgttccgttaacgtaacgtaaaacgttaaggtaaaacgttaacccgtaccgttaagggaaccgggtaaccgggaacccgggtaaacggggtaacccgtacccggggttaccgtttagggtttaaggtttaaccggtttaacgtttacgggttaccggttaacggaacgggttaacgggtagggttacggggggtaacggggggtttaggttacggtaccgttaccggttaaggg

SEQ ID NO: 256925 - DNA, 712 bp, Homo sapiens
  misc_feature: GYAE6OF02FOBG5.14.55.E11.1.454.CMB.1.raw
  modified_base (143)..(143): a, c, t, g, unknown or other
  misc_feature (143)..(143): n is a, c, g, or t
  modified_base (262)..(262): a, c, t, g, unknown or other
  misc_feature (262)..(262): n is a, c, g, or t
  modified_base (604)..(604): a, c, t, g, unknown or other
  misc_feature (604)..(604): n is a, c, g, or t
tcagcgtctagtaccacgaccggtgctcgatttagcactcgcacgttgggctcgtgggagaggagcccagcactagaagtcggcggtgtttccattcggtgatcagcactgaacacagagactcacagtggagtttgggctgngcttgggttttcctcgttgcttcgttttaagaggttgtccagttgtccaggtcgcaggtcgtgggtggagtcggtgggggaggtcgtggtccaggccgtagggacgtcccgtagaaccnccgttccaccgtgtcgaccgtaaccgttcgtagtacttcgacgtcttacgtaagttacgttagtcggactagtcaccggtacggtccggtaccgccgtacggtccgtaccgaaacgggcggtaacgggtcgttgggaggttcgggtgcgttaggttggtacgtaggtaacgtacggaaggtaaaagttaagtaaggtaaaacgtcgttccgggaacgtaccgggacgtaacgggtacggtccgtaaccgtaccgacctagtcccgaacgtaagaaccgtaacgtaactaaccaacctaagttactaggttactagttacagtaagaaactaggtactaccgngtaacgagtaaccggcggtaaaccggacgtacgtacgtggttaactacgttgtagtacggtgacggtagtacggtggggtaaccgggtaggttacgtacgtcgtaagg

SEQ ID NO: 256926 - DNA, 696 bp, Homo sapiens
  misc_feature: GYAE6OF02FPAGQ.14.55.E11.1.454.CMB.1.raw
tcagcgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctgttgctcttttaagaggtgtccagtgtcaggtgcagctgggtggagtcgtgggggagtcgtggtccagccgtgggacgtccctgacactctcctgtcgacgaacgtctggtacttcgagtcttactacggttagttagtggctagtggcctacgtcgggtcccgtccgagggtcctacccggagggacggaaggggcgtagggagggttgggtggcgtaggttcggtggtaggtagtaggtaacggtaaaggttaacgtaaggtaaagtacgtacggtaccggtacggtacccggtagggtaacggtccgtaagttaccgaaccgtacgtaccctacgtaacgtaacgtaacgtaaaccttacccgaaactaacgttattacggttagtacttcgtacgtaacctaagtacgtaagtacgtacgtacgacggtaacgaccggtacggaaccgtacggtccgttagttcgttaacgttgtacggttacgtagaacggtacggtaggtacggggtaggggtaggtggtacggtacgtaaggg

SEQ ID NO: 256927 - DNA, 734 bp, Homo sapiens
  misc_feature: GYAE6OF02JX8UH.14.55.E11.1.454.CMB.1.raw
  modified_base (381)..(381): a, c, t, g, unknown or other
  misc_feature (381)..(381): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagtagttgtgacactccagatcgaccctagtcctccacttccctccgttgtctgactactcttaggtaaggacaagagtactccaacctattaccgtaacgttccgggaccgggactaaggtaccaaggtacgtaacgtaaattaacgttaaactttaagtttaaacgttggtaactaaccaacgaaacgtaaaccggaagggaaccgtacccgtacgtaacccgtccgttagtaacttacgtnttacgtacctagcctacgtaccgtaagttcgacgtacggtacgggtcggttaccgtacggttacggtacgtaaggtcgtaggtgtaggtacgtcggtaggaacgtagtctacgtaccgtactaccgtcgtacgtacgacgtacggtctagtacctacgtacgtagttacttaccgtacttacgttactaacgacgtaactacgtacgtacttaaccgttacccgtacccgtacgttaccggtaccggtacgggaacgaaccggtacggtacgtacacgtacggtaacgtaaccggtacgttacgcggtaccgtactacgttaccgtacttcgtaccggttatcccgttaaccg

SEQ ID NO: 256928 - DNA, 858 bp, Homo sapiens
  misc_feature: GYAE6OF02GQ17F.14.55.E11.1.454.CMB.1.raw
  modified_base (191)..(191): a, c, t, g, unknown or other
  misc_feature (191)..(191): n is a, c, g, or t
tcagcgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacttcgccgggacaagtcagacgctaattaaacgaacttaattttaaagttggtaactaccaaacgtaacgaaaaacccgaagggaaaaccgtccccctagaccccttcctaggaacttccgtaagttcgactggaccaacttaccgtaggtttaccaccgtaacgtacggggttaccggggttaccccgtacggtaaacgggtttcgaagggttacgggtacctaagggttcggtaacgttcggtaacggggaaactaggttaacttttccgaccgttccgtaaccgtacccgttacgtacggtaccgttacggtccttacggaacccttaaacggtaacggttaaacgtttacgttttaccgtaaccgtttaaaccgtttaacctttaaccgttaacgttaaacccgtaaacgtaacggttaaaccgtttaacccggtaccccgtttaaccccccgttacgttaaccggtttacccggggtaaccgggtaaaccggggaaaccggtaaacgggtaccgggtaacgtaccgtaaccgtaaccgggtaaaccggttaaaccggttcggggttaaccggtaccgtttaccggtaaccccgtaaccggttaccgtttacccggtttaccggttttaccgtacccgtttaacccgg

SEQ ID NO: 256929 - DNA, 953 bp, Homo sapiens
  misc_feature: GYAE6OF02JVWIG.14.55.E11.1.454.CMB.1.raw
tcagcgtctagtaccacgaccggtgctcgatttagcactcgcacgttgggtttggggagtctcagtcaggacacagcatggacatgaggtcccgctcagctcctggggctcctgctactctggctccgaggtgccagatcgtgacatccagatcgaccctagtcctccatcccgtccctgtcgtcgacacttctggtaggacgacagggacttccaaccgattccgaacgtttcggaccggggcctaaacggttccaaggacgtacctaatttaaaaacggacctttaaactttttaaaaggttcggttaattaccaaaaccgaacggtaaaacccgaaacgggaaaaccgtcccccgtagtaaccccgttaccgtacggtaacttccttaagtacgtccgttaaggcctaacgttaccctaggttttccgacgttacccgaagggtttccggggggttccccttacggtaaacgggtttccaagggttcggaccgtaacggttgggttaactccggtaggggtaaccctaaggttaccgttttcctaaaccctccgtttaacccgtaacccgcgttaaccggtcctaacgggttccctttggacccctaaaacggtttcggtaaaaggtttaccttttaccggtaaccttaaaccttttaacccgggttactttaaccgtacccgaaaaggggttactttaaccgggtttaaaccccttacccgttaaaccccccgtaccgttttaccgggtttcccggggaaccgggtttaaccgggggtaaaacccgaacggggttaccccggaaaaggggttccgtttaaacgggaaaacccgggttaaccccggtttaaggtaccgggttttaccgggacttttcccccgggaaggttaaccccccgttaaacggttttacccctttcggttttaacccgggttaccctttaccccgg

SEQ ID NO: 256930 - DNA, 586 bp, Homo sapiens
  misc_feature: GYAE6OF01EDKL3.25.66.F11.1.454.CMB.1.raw
  modified_base (269)..(269): a, c, t, g, unknown or other
  misc_feature (269)..(269): n is a, c, g, or t
  modified_base (295)..(295): a, c, t, g, unknown or other
  misc_feature (295)..(295): n is a, c, g, or t
tcagactgtacagtcacgaccggtgctcgatttagtcacgcgagaaggggggagaggagccccagccttgggattcccaagtgttttcattcagtgatcaggactgaacacagaggactcaccatggagtttgggctgagctggattttccttgcagctattttaaaaggtgtccactgtgaggtgcagctggtggagtcgtgggggaggcttgggtgaaaccgtgggggatccctcagactctcctgtgcagcctctaggttcccttnaagaacgcctggatgagttgggtccnccaggctccgagggaagggctgggaggtggggttggccgtataagacaagtagtagaaggtggacaagagactacgctgcatccgagaaagacagacttcaccatctacaagggatagattacaaagaccaagtctgtaatctgcagatagaacagcctaggaaggtcgaaggacaccgtagtaccgtttatacctagtaccctacgtttagaaactcgtaaaccggtcggggaactacggtacggggaccaaccggggtaccctcggtaccgtaccggtcctccgtaccg

SEQ ID NO: 256931 - DNA, 617 bp, Homo sapiens
  misc_feature: GYAE6OF01D2OJD.25.66.F11.1.454.CMB.1.raw
  modified_base (456)..(456): a, c, t, g, unknown or other
  misc_feature (456)..(456): n is a, c, g, or t
tcagactgtacagtcacgaccggtgctcgatttagtcacgcgagaagggggggagaggagccccagccttgggattcccaagtgttttcattcagtgatcaggactgaacacagaggactcaccatggagtttgggctgagctggattttccttgcagctattttaaaaggtgtccactgtgaggtgcagctggtggagtctgggggaggcttggtgaaacctgggggatccctcagactctcctgtgcagcctctaggttccctttcaagaacgcctggatgagttgggtccgccaggctccgagggaaggggctgggagtggggttggccgtattaagaccaatagtgaaggtgggacaagagactacgctgcatccgtagaaagacagattcaaccatctacaagggatgaattacaaaagacccacgtctagtaactctagcagatagaacngcctaggaacggtcgaaggaacacgacgtaccgttttaataccgttcgttaacccttcgtttagaaacgtccgtaaaccggttcgggggaaccttacggtcgggggaccccaaacggggtaaccccttcgggtacccgtacccggtccgtcccgtacccgg

SEQ ID NO: 256932 - DNA, 560 bp, Homo sapiens
  misc_feature: GYAE6OF01EXJOD.25.66.F11.1.454.CMB.1.raw
  modified_base (278)..(278): a, c, t, g, unknown or other
  misc_feature (278)..(278): n is a, c, g, or t
  modified_base (335)..(335): a, c, t, g, unknown or other
  misc_feature (335)..(335): n is a, c, g, or t
  modified_base (342)..(342): a, c, t, g, unknown or other
  misc_feature (342)..(342): n is a, c, g, or t
  modified_base (418)..(418): a, c, t, g, unknown or other
  misc_feature (418)..(418): n is a, c, g, or t
  modified_base (429)..(429): a, c, t, g, unknown or other
  misc_feature (429)..(429): n is a, c, g, or t
  modified_base (441)..(441): a, c, t, g, unknown or other
  misc_feature (441)..(441): n is a, c, g, or t
tcagactgtacagtcacgaccggtgctcgatttagtcacgcgagaagggggggagaggagccccagccttgggattcccaagtgttttcattcagtgatcaggactgaacacagaggactcaccatggagtttgggctgagctggattttccttgcagcttattttaaaaggtgtccactgtgaggtgcagctggtggagtcgtggggggaggcttgggtacagccagggcccggtccctgaccactctcctgcacagcttccggactcacctttggnagcatgctatgacctgggtccgccaggcctccgaggggacggtctgggagtgggtcnagttcgngagtagtagtagtacttataaatctacgcagagtcaggtggagggccattcacttatctccagagacaacacaagnctattttgtcngacaaatgaacngcctagagacgccggaggactaccggcttagtagtattagttcgtagacgtaagactaaagtaaggaagacgtagggtcggacgttagggacctttaggacccgttagggtaccggggg

SEQ ID NO: 256933 - DNA, 777 bp, Homo sapiens
  misc_feature: GYAE6OF01DCHCV.25.66.F11.1.454.CMB.1.raw
  modified_base (240)..(240): a, c, t, g, unknown or other
  misc_feature (240)..(240): n is a, c, g, or t
tcagactgtacagtcacgaccggtgctcgatttagtcacgcgagaaggggggagaggagccccagccttgggattcccaagtgttttcattcagtgatcaggactgaacacagaggactcaccatggagtttgggctgagctggattttccttgcagctattttaaaaggtgtccactgtgaggtgcagcgtggtggagtcgtgggggagtcgttggtagaaaccgtggggactcccgtnagactctccgtgtgcacgccttcgttaccggtttccctttacgaacgtaaccgtccgtggatggtacggttcgggtccgaccgacggcctaccggaggggaacgggtcgtgggtaggtgggttcggaccgtaagttaacgaacgtaagtaggtaggaaggtagggaacaaggacgtaacgtacgctgactacgtccgtaagaaacgacagtacttaccacctactcgtaacgaagggtatacggtaacttaacgaaacgtacccgacgtacgttagtactcgtcggacgtaagtacgaaccgtacggtaccgtaaagggtaaccggttacgggaaacggtaccctaaacggttacggtttacccgtttttaattaacccggttacgttaccccgtttaacgtttaagggaaaaccctacgggttaacccgggttacgggggtaacccttacgggggtacccgggggaccccgtaaacggggtacccccgttcgggtaaccccgtacccggtttcccttaccgcccgttaaaccccgg

SEQ ID NO: 256934 - DNA, 627 bp, Homo sapiens
  misc_feature: GYAE6OF01CU464.25.66.F11.1.454.CMB.1.raw
tcagactgtacagtcacgaccggtgctcgatttagtcacgcgagaaggggggagaggagccccagccttgggattcccaagtgttttcattcagtgatcaggactgaacacagaggactcaccatggagtttgggctgagctggattttccttgcagctattttaaaaaggtgtccactgtgaggtgcagctggtggagtctgggggaggcttggtgaaacctgggggatccctcagactctcctgtgcagcctctaggttccctttcgaacgaacgcctggaattggaagttggggtccgccaaggctccgagggaagggggctgggagttggggttcggccggttattaagacctaaatagtgaaggtagggacaaggagactacgctgcatccgtagaaagacagattcaccatctacaagggatggattacgaaacgtaccaacgactagtaagtctagaccagatagaacagcctaggaagtcgaaggacacgacgtaccgtttaatacgttacgttacccttccgttacgtaaacgccgtaaacggtcgggggtaaccttacgggtaccggggaccgtaacgggaacccgttacggtacctaacccggtctcccgtacccg

SEQ ID NO: 256935 - DNA, 539 bp, Homo sapiens
  misc_feature: GYAE6OF01A5EM9.25.66.F11.1.454.CMB.1.raw
  modified_base (295)..(295): a, c, t, g, unknown or other
  misc_feature (295)..(295): n is a, c, g, or t
  modified_base (488)..(488): a, c, t, g, unknown or other
  misc_feature (488)..(488): n is a, c, g, or t
  modified_base (507)..(507): a, c, t, g, unknown or other
  misc_feature (507)..(507): n is a, c, g, or t
tcagactgtacagtcacgaccggtgctcgatttagtcacgcgagaagggggggagaggagccccagccttgggattcccaagtgttttcattcagtgatcaggactgaacacagaggactcaccatggagtttgggcttaactgtcttttccttgttgctgttttaaaaggtgtccaatgtgaggtgcaactggtggagtcgtgggggaggcttggtacagccaggccggtccctgacactctcctgcacagcttccggactcacctttggtgagcatgctatgacctgggtccncaggctccgaggggaggtctggagtggcttgggtcagttagagcgaagcctagtgggtgggacaaacgacaagtacgccgcgtactaggtaaaaggcaagtattcgacgtcctctacaagagatagaacttaccaaaagcaactcgacctatctgacacatgagcagcctagagaagcgagactcgagccgtntacttctgttcttattacncgtgagtagtagttagttattatactatatac

SEQ ID NO: 256936 - DNA, 576 bp, Homo sapiens
  misc_feature: GYAE6OF01AJT8D.25.66.F11.1.454.CMB.1.raw
  modified_base (270)..(270): a, c, t, g, unknown or other
  misc_feature (270)..(270): n is a, c, g, or t
  modified_base (454)..(454): a, c, t, g, unknown or other
  misc_feature (454)..(454): n is a, c, g, or t
tcagactgtacagtcacgaccggtgctcgatttagtcacgcgagaagggggggagaggagccccagccttgggattcccaagtgttttcattcagtgatcaggactgaacacagaggactcaccatggagtttgggctgagctggattttccttgcagctattttaaaaggtgtccactgtgaggtgcagctggtggagtctgggggaggcttgggtgaaaaccgtgggggatccctcagactctcctgtgcagcctctaggttcccttnaagaacgcctggatgagttgggtccgccaggctccgaggggagggctggagtgggttggccgtataagaccaatagtgaaggtgggacaagagactacgctgcatccgtagaaagacagtattcacctatctacgaagggatagattacaaagacccacgctagtactctagccagatcgaacngacctggaacggtcgaaggacacgagtccgtttatacgtgttacctcttagaaacgtcgtaacgtcggggactacggtcggggaccacgggtaacccgtggtaccacccgtctcccgtaccg

SEQ ID NO: 256937 - DNA, 569 bp, Homo sapiens
  misc_feature: GYAE6OF01BNCOV.25.66.F11.1.454.CMB.1.raw
tcagactgtacagtcacgaccggtgctcgatttagtcacgcgagaagggggggagaggagccccagccttgggattcccaagtgttttcattcagtgatcaggactgaacacagaggactcaccatggagtttgggctgagctggattttccttgcagctattttaaaaggtgtccactgtgaggtgcagctggtggagtctgggggagcttggtgaaacctgggggatccctcagactctcctgtgcagcctctaggttccctttcaagaacgcctggatggagttgggtccgcagggcctccgaggggaaggggctgggagtggggttggccgtattaaggaccaatagtgaaggtgggacaagagactacgctgcatccgtagaaagacagattcaccatctcaagggatgattacaaagacccacgctgtatctgcagatgaacagcaggaaggtacgaggacacgacgtccgtttaatacgtcgtacctctttagaaacgtcgtaacgtcggggactacggcgggccgaacgggtaccctcggtaccacccggtctccgtaccg

SEQ ID NO: 256938 - DNA, 671 bp, Homo sapiens
  misc_feature: GYAE6OF01B5WKP.25.66.F11.1.454.CMB.1.raw
  modified_base (236)..(236): a, c, t, g, unknown or other
  misc_feature (236)..(236): n is a, c, g, or t
  modified_base (488)..(488): a, c, t, g, unknown or other
  misc_feature (488)..(488): n is a, c, g, or t
tcagactgtacagtcacgaccggtgctcgatttagtcacgcgagaaggggggagaggagccccagccttgggattcccaagtgttttcattcagtgatcaggactgaacacagaggactcaccatggagtttgggctgagctggattttccttgcagctattttaaaaggtgtccactgtgaggtgcagctggtggagtcgtgggggaggcttggtgaaaccgtgggggatccctnagactctcctgtgcagcctctacggttccctttacaagtaacgccgtggatggtacggttcgggtccgccgaggcctccggaggggaaggggcgtgggaggttgggttcggccgttaagttaacgacctaagtagtagaaggtggaacaaggagactacgctgcatccgagaaagacagtacttacacctatctacgaagggataggacttacgaaacgacccacgtctagtatctgacaagtatagaaacngtaccgtagaacggtacgaacggacaaccgtacgttacccgttttacgttaccgtacgttacccttaccgtttaacggaaaacgtccgtaaacgggttaccgggggaaacttacccgggtacggggacccgtaaccggggtaacccgtacgggtaccctacccgttcccgtacccgtacccgg

SEQ ID NO: 256939 - DNA, 423 bp, Homo sapiens
  misc_feature: GYAE6OF01B3QEV.25.66.F11.1.454.CMB.1.raw
  modified_base (410)..(410): a, c, t, g, unknown or other
  misc_feature (410)..(410): n is a, c, g, or t
  modified_base (415)..(423): a, c, t, g, unknown or other
  misc_feature (415)..(423): n is a, c, g, or t
tcagactgtacagtcacgaccggtgctcgatttagtcacgcgagagggccaccgtcaactgcaagtccagccagagtcttttatacagtgccgacaataagaactacttagcttggtatcagcagaagccaggacagcctcctaagctgctcatttcctgggcatctacccgggaatccggggtccctgaccgattcagtggcagcgggtctgggacagatttcactctcatcatcagcgctgcaactgacgatgtgcgtttattactgtcagcaacactatcttactccgtcggacgttcggcctaaagggaccaaggtagtaattcgaagcgaactgcggctgcacatctgtcttcatccttcccgctatctacgactgtaccagtctgacggcggctggacaggctnatagnnnnnnnnn

SEQ ID NO: 256940 - DNA, 681 bp, Homo sapiens
  misc_feature: GYAE6OF01CUOT2.25.66.F11.1.454.CMB.1.raw
  modified_base (238)..(238): a, c, t, g, unknown or other
  misc_feature (238)..(238): n is a, c, g, or t
  modified_base (434)..(434): a, c, t, g, unknown or other
  misc_feature (434)..(434): n is a, c, g, or t
tcagactgtacagtcacgaccggtgctcgatttagtcacgcgagaagggggggagaggagccccagccttgggattcccaagtgttttcattcagtgatcaggactgaacacagaggactcaccatggagtttgggctgagctggattttccttgcagctattttaaaaggtgtccactgtgaggtgcagctggtggagtcgtgggggaggcttggtgaaaccgtgggggactccctnagactctcctgtgcagcctctacggttccctttacaacgaaccgtccgtggatggaggttcgggtccgccgaggctccgaggggaaggggctgggagtgggtggaccgtagttaagactaagtagtagaacggtggacaaggacgacgtacgctgacactccgtagaaagacagtattcgacatctacgaagggtntagaacttaacgaaacgtaccaacgtctagtactctagcctagaactagtaaacacgaccgttaggaaacggtcggaacggaaccgtacgtacggttaacccgtttttaactaccgttacgttaacccgtttaccgttaaggaaaccgtaccgtaaaccggggtcggggtaaccttaccggggaccggggtacccgaacgggtaccccgtaacggttcccgaaccccggttcgttacccgtacccgg

SEQ ID NO: 256941 - DNA, 445 bp, Homo sapiens
  misc_feature: GYAE6OF01BO71K.25.66.F11.1.454.CMB.1.raw
  modified_base (323)..(323): a, c, t, g, unknown or other
  misc_feature (323)..(323): n is a, c, g, or t
  modified_base (390)..(390): a, c, t, g, unknown or other
  misc_feature (390)..(390): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (428)..(445): a, c, t, g, unknown or other
  misc_feature (428)..(445): n is a, c, g, or t
tcagactgtacagtcacgaccggtgctcgatttagtcacgcgagagggccaccgtcaactgcaagtccagccagagtcttttatacagtgccgacaataagaactacttagcttggtatcagcagaagccaggacagcctcctaagctgctcatttcctgggcatcgtacccggggaatccggggtccctgaccgattcaggtggcaggcgggtctgggacagattcactctcatcatcagcgctgcaactgacgatgtggtcgtttatactgtcagcaactactatctactcctcggacgttcggaccaaggaccaaggtanaattcaagcgtaactgcggctgcacatctcgttctcacttcctccgctatcgtatactgaactgtcnggacggtcggactagggactaacggcacgatcgncnannnnnnnnnnnnnnnnnn

SEQ ID NO: 256942 - DNA, 729 bp, Homo sapiens
  misc_feature: GYAE6OF01D1ZAU.25.66.F11.1.454.CMB.1.raw
tcagactgtacagtcacgaccggtgctcgatttagtcacgcgagaagggggggagaggagccccagccttgggattcccaagtgttttcattcagtgatcaggactgaacacagaggactcaccatggagtttgggctgagctggattttccttgcagctattttaaaaggtgtccactgtgaggtgcagcgtggtggagtcgtgggggaggtcgttgggtcgaaaccgtgggggactcccgtcacgtactctcctgtcgcacgtcctctacggttccctttacaacgtaaccgccgtaggactaggtaggttcgggtcccgaccgacgggtccgtcccggaagggggaacggggtccggtggggtagggttgggggttcggtacccgttaagttaaacggacctaaagtacggtaggaaggtagggaaccaaggaacgtaacgtacgtacgtagaccgtactaccggtaagaaacgaacgtaagtacttaccgaacgtataccgtacgaaagggattagtaacttaacgaaacgaccgtacgtactagtacttcgtggaacgtatacgaacgtacgtaccgtagtaacgggtcgaagggtaaccaacgggtacgttaccgtttacttaactccgttacctacgtttaacgaaacgtacgaccggtacggggtactacgggtcgggaccgacgggtacccgtggtacccaccgttcctccgctaccccg

SEQ ID NO: 256943 - DNA, 1096 bp, Homo sapiens
  misc_feature: GYAE6OF01EUHZ3.25.66.F11.1.454.CMB.1.raw
tcagactgtacagtcacgaccggtgctcgatttagtcacgcgagaaggggggggagaggagccccagccttgggattcccaagtgtttttcattcagtgatcaggactgaacacagaggactcaccatggagtttgggctgagctggattttccttgcagcttattttaaaaggtgtccactgtgaggtgcagcgtggtggagtcgtgggggaggcgttgggtacggaaaccgtggggggacttcccgtacgacgtaccttccgtccgttggtcgtcgacggtcccttaccgttacggtttcccctttacgaaacggtaacccggtacccgtagggtaacttgggtacgggtttccggggtaccccggacccggtaacgggtccgtaccccgggaagggggggaaccgggggtcgttaggggtaacgggggtttcggggggttacgggtacccgggttaaagtttaaaccggaacccgtaaaagttaaggggttacgggtaaaacggggtttacgggggaaaacctaaaacgggtaaacgtaacccggttaaaccggtccgttaacgggtacccgtaacgtttaaccccgggtaaagggtaaaaaccggtaaccgtaaacgggtaacgtttaaccccgaaacccgttaaacgttaccccggttaaccgggtaaaacggggttaacgtttaacggtaaccgtttaaaacccgaaaaaccgggtaaccccccgtaaccgggtacccgtttaaacgttaacggttacccgttacggtaaacccgtaaggtaaacggtaaccggaaaaccgtacgggtacccggtaaggggtaaaccgggttaaccgggaacgggtaaacctaaccggtaacggtttaaccccgttttaaaccgttacccgtttaccggtttaaacccccgttttaccgttttaaaagggaaaacccggttacccggggtaaacccggggggttaaccgttaacccggggttaacccggggggtaaccccgggttaaacccgggtaaccccgggtttaacccgggttaccccgggtaacccgtttcccccggttacccggacccccggttaaaccccggg

SEQ ID NO: 256944 - DNA, 622 bp, Homo sapiens
  misc_feature: GYAE6OF01BCXIG.25.66.F11.1.454.CMB.1.raw
  modified_base (590)..(590): a, c, t, g, unknown or other
  misc_feature (590)..(590): n is a, c, g, or t
  modified_base (592)..(595): a, c, t, g, unknown or other
  misc_feature (592)..(595): n is a, c, g, or t
  modified_base (597)..(622): a, c, t, g, unknown or other
  misc_feature (597)..(622): n is a, c, g, or t
tcagactgtacagtcacgaccggtgctcgatttagtcacgcgagagggccaccgtcaactgcaagtccagccagagtcttttatacagtgccgacaataagaactacttagcttggtatcagcagaagccaggacagcctcctaagctgctcatttcctgggcatctacccgggaatccggggtccctgaccgattcagtggcaggcgggtctgggacagatttcactctcatcatcagcggctgcaacctgacgatggtggtcggtttatacgtgtcagccaaactacttactctttacctccgtcgggtaaccgttccgggaaccgtaaacggggacccgtaaagggttacgtaaactttaccgaaaggtaccgtaaacggttcgggtacggggtaccttcgggaacccctaacccgtaactttccgtttacggttcctttacccgtaacttttccccgtttaccccccggccttaaacgtttcccgtaacgggtaaaccctttagggttaaccctaggtttcccggtagggaacgggtcccggggtacgtacggggtaccgaacggggcctacgaacggttaggcangnnnngnnnnnnnnnnnnnnnnnnnnnnnnnn

SEQ ID NO: 256945 - DNA, 638 bp, Homo sapiens
  misc_feature: GYAE6OF01E1F93.25.66.F11.1.454.CMB.1.raw
  modified_base (553)..(553): a, c, t, g, unknown or other
  misc_feature (553)..(553): n is a, c, g, or t
  modified_base (557)..(557): a, c, t, g, unknown or other
  misc_feature (557)..(557): n is a, c, g, or t
  modified_base (568)..(568): a, c, t, g, unknown or other
  misc_feature (568)..(568): n is a, c, g, or t
  modified_base (571)..(571): a, c, t, g, unknown or other
  misc_feature (571)..(571): n is a, c, g, or t
  modified_base (576)..(576): a, c, t, g, unknown or other
  misc_feature (576)..(576): n is a, c, g, or t
  modified_base (587)..(587): a, c, t, g, unknown or other
  misc_feature (587)..(587): n is a, c, g, or t
  modified_base (593)..(593): a, c, t, g, unknown or other
  misc_feature (593)..(593): n is a, c, g, or t
tcagactgtacagtcacgaccggtgctcgatttagtcacgcgagagggccgaccgtcaactgcaagtccagccagagtcttttatacagtgccgacaataagaactacttagcttggtatcagcagaagccaggacagcctcctaagcttctcatttcctgggcatcctaccgggaatccggggtcctgaccgattcagtggcagcggtctgggacagtatttcaactctacatcatcagcggcctagccaacctgaccgtagtgtcggtccggtttacttacgtcgtacagacctaactactattccttaaccttccgtacggtaccggttccggaccgtaaacgggaacccgtaaaggtacgtaactttacgaagtaccgtaactcggtggtcctacggtcccaaactacgttccgttagtaacctttccgtaacttcccgtttaccccgccgtaacttcccgagtaaccgttacgttaccgagtttcgtacgtaccgggtaacggggtcctagggtaaccgtacgggtaccgaccgtagttaacggctangtanaccggatacgngancgtantcagctatcgntacganacgtgcgtactacgtcgactacgacgtacgtacgtacactctctc

SEQ ID NO: 256946 - DNA, 873 bp, Homo sapiens
  misc_feature: GYAE6OF01A5NJM.25.66.F11.1.454.CMB.1.raw
  modified_base (174)..(174): a, c, t, g, unknown or other
  misc_feature (174)..(174): n is a, c, g, or t
tcagactgtacagtcacgaccggtgctcgatttagtcacgcgagaagggggggagaggagccccagccttgggattcccaagtgttttcattcagtgatcaggactgaacacagagactcaccatggagtttgggctgagctggtattttccttgcagcttattttaaaaggtntccatgtgaggtgcagctggtggtaggtcggtgggggaggtctttagggtaggaaaccgtggggactccccgtagagtacctctccgtgtcgcctagccttcgtacggttcccttagaacgtaacgcctaggatggtaggttcgggtccgacgtacggtccgtaccgggaagggggacggggtcgtaggggtacgggttcggggttacggtaccggttaagttaaacggacctaaagttaggtagggtaacgggtagggaacaaacggtacgaacgtacgtctgggacaacgttaccggtaaggaaactaccgtaagtaacgttaaccgaaccctaacgtttacgaacggtaagggtactaacggttaacttaaccgaaaacgtaaccgaaccgtacgttaacgttaaccgttacgtacggtaaccgaaacgtaacttacgggaaaccgtaacgtaccggtaacgggaacggttaccgggaacggaaccgtaaccggtttaccggttaaacccgttttaacgttaaccgtttacgttaaccccgttttaaaccggtttaacgtaaaaccgggttaacccggtaaccggggttaacccgggggttaacgttacccggggaaccgggggtaaccccgtaaccgggggttaccccggtttaccggtaccccgtaacccgttacccggttccctaaccccggg

SEQ ID NO: 256947 - DNA, 937 bp, Homo sapiens
  misc_feature: GYAE6OF01AFNWL.25.66.F11.1.454.CMB.1.raw
tcagactgtacagtcacgaccggtgctcgatttagtcacgcgagaagggggggagaggagccccagccttgggattcccaagtgttttcattcagtgatcaggactgaacacagaggactcaccatggagtttggctgagcttggtattttccgtgctagtacttaagttttaaaaaggtcgttaccacttggtaggtaggttgcgaggtcgtgggtggtaggttccgggtggggggtacggtcggttagggtacggaaacccgggttgggggtaaccttcccgtcgaacggtaccttcctccgtgtcgcgtacggtccgttccgttaccggtttccccgtttacaaaccggtaccgtaccgtaggtacgtacggtaccggtttccgggcccgaccgtacgggtccgtaccgggtaaggggggtacgggtccggtaggggtacgggttcggggttaccggtaacggtttaaggtaaacgaaccggttaaaggtagggtagggtaaacggggtgggaaacgaaaggtaccggtaaacgtccggtacgtcgaaccgtaacggttaccggtaaacgtaaacgacgtaacgtaacctttacccgaacgttactaacccgtaagggtaacggtatacggtaactaacggaaacccgtacgaccgttcgttaagttacgctacggactacgagtaacccgtatacggaacccgttagggtaaacggtcggaccgaacgttaaccgggttaacgtttacgtttttaacctaccggttaacggttacccctttaacgggtaaaacgtaacccggggttaacggtttaaaccgggggtacccggttaacccggtccgggggttaaacccggggtaacccccaccggggtttaacccggttaccggtacccccgttaccggttacccgttcccccgtaaacccgggg

SEQ ID NO: 256948 - DNA, 587 bp, Homo sapiens
  misc_feature: GYAE6OF01BIC7O.25.66.F11.1.454.CMB.1.raw
  modified_base (158)..(158): a, c, t, g, unknown or other
  misc_feature (158)..(158): n is a, c, g, or t
  modified_base (551)..(551): a, c, t, g, unknown or other
  misc_feature (551)..(551): n is a, c, g, or t
  modified_base (555)..(556): a, c, t, g, unknown or other
  misc_feature (555)..(556): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (563)..(563): a, c, t, g, unknown or other
  misc_feature (563)..(563): n is a, c, g, or t
  modified_base (565)..(565): a, c, t, g, unknown or other
  misc_feature (565)..(565): n is a, c, g, or t
  modified_base (567)..(569): a, c, t, g, unknown or other
  misc_feature (567)..(569): n is a, c, g, or t
  modified_base (571)..(572): a, c, t, g, unknown or other
  misc_feature (571)..(572): n is a, c, g, or t
  modified_base (574)..(579): a, c, t, g, unknown or other
  misc_feature (574)..(579): n is a, c, g, or t
  modified_base (581)..(587): a, c, t, g, unknown or other
  misc_feature (581)..(587): n is a, c, g, or t
tcagactgtacagtcacgaccggtgctcgatttagtcacgcgagagggccaccgtcaactgcaagtccagccagagtcttttatacagtgccgacaataagaactacttagcttggtatcagcagaagccaggacagcctctaagctgctcatttccngggcatcgtacccgggatccggggtcctgaccgattcagtggcagcgggtctgggacagtatttcactctacatcatcagccggctagaccaacctggacgtatggtacggtacgttttattacgtgtcagaccaactacttactcttacctcccgtaccggaccgtttccggaaccgtaacgggtactaacggtagaaacttcgaaaggtaccgaacgttggtacggctacgaccgaacctacgtttacgtcgtacctttaccaacctttcccgtaccccgtcgtactaccgttagaaccgttcgttaaccgtagttccgttacgggcgggtaccccgggtaggtaccggaacgacggggtccgttaagaaccgttgtaccagctcacgacncacnntncntanancnnncnngnnnnnncnnnnnnn

SEQ ID NO: 256949 - DNA, 639 bp, Homo sapiens
  misc_feature: GYAE6OF01DUKG8.25.66.F11.1.454.CMB.1.raw
  modified_base (157)..(157): a, c, t, g, unknown or other
  misc_feature (157)..(157): n is a, c, g, or t
  modified_base (166)..(166): a, c, t, g, unknown or other
  misc_feature (166)..(166): n is a, c, g, or t
  modified_base (256)..(256): a, c, t, g, unknown or other
  misc_feature (256)..(256): n is a, c, g, or t
  modified_base (591)..(591): a, c, t, g, unknown or other
  misc_feature (591)..(591): n is a, c, g, or t
  modified_base (595)..(595): a, c, t, g, unknown or other
  misc_feature (595)..(595): n is a, c, g, or t
  modified_base (602)..(602): a, c, t, g, unknown or other
  misc_feature (602)..(602): n is a, c, g, or t
  modified_base (609)..(609): a, c, t, g, unknown or other
  misc_feature (609)..(609): n is a, c, g, or t
  modified_base (613)..(613): a, c, t, g, unknown or other
  misc_feature (613)..(613): n is a, c, g, or t
  modified_base (615)..(616): a, c, t, g, unknown or other
  misc_feature (615)..(616): n is a, c, g, or t
  modified_base (618)..(619): a, c, t, g, unknown or other
  misc_feature (618)..(619): n is a, c, g, or t
  modified_base (621)..(621): a, c, t, g, unknown or other
  misc_feature (621)..(621): n is a, c, g, or t
  modified_base (625)..(625): a, c, t, g, unknown or other
  misc_feature (625)..(625): n is a, c, g, or t
  modified_base (627)..(629): a, c, t, g, unknown or other
  misc_feature (627)..(629): n is a, c, g, or t
  modified_base (631)..(633): a, c, t, g, unknown or other
  misc_feature (631)..(633): n is a, c, g, or t
  modified_base (635)..(639): a, c, t, g, unknown or other
  misc_feature (635)..(639): n is a, c, g, or t
tcagactgtacagtcacgaccggtgctcgatttagtcacgcgagagggccaccgtcaactgcaagtccagccagagttctttttatacagtgccgaacaataagaactacttagcttggtatcagcagaacgccaggacagcctacctaagctgctntatttccgngggcatccgtaacccgggacgtccggggtccctagaccgtattcgaggtcggcgaggtcgggtctagggactagtactttccactctacngttacagtccgaggtccgggcctacgacctaaccgtggaccgtagtggtacggtattaacgttttactacggtgtacgacgaacttaatttaactttatacgttacccgttacccgtacggtaacggttccggacgggaacgggaaccgtaaaggtaacgaacttaaaccgaacggtagtttggcggaccttacgacttacgcttacttcgttaccttcgtaccttcccgtaccctacgttacaccggtttaacgaactttacgtaccgtaggttaccgacgggttacggaccggggtataacggggaccgtaacgggccttaaggtcgtaaacngcgngctactnagctgcncatngnnanntntgcnannnannncnnnnn

SEQ ID NO: 256950 - DNA, 845 bp, Homo sapiens
  misc_feature: GYAE6OF01BA9FM.25.66.F11.1.454.CMB.1.raw
tcagactgtacagtcacgaccggtgctcgatttagtcacgcgagaagggggggagaggagccccagccttgggattcccaagtgttttcattcagtgatcaggactgaacacagaggactcaccatggagtttgggctgagctggtattttccttgcagtcttaattttaaaaggtgtccactgtgaggtgcagcgtggtggagtcgtgggggaggtcgttgggtacgaaaccggtgggggactcccgtcgagtacctcctccgtgtcgcacggtcctcgttacggtttccctttacaacggtaaccgtccgttaggaacgttggtaacggtttccggggacccgaccgtacgggtccgtacccgggaagggggtaacgggggtccgtaggggtagggttggggttacgggtaccgttaaaggttaacgaaccgtaaagtaggtagggaagggtaggaacgaaaggacgaactacgcgtgactacgtccgaagaaagacagtacttaccactagtcctaagaggtatacggtaactaacgaaactacccgagtacgttacgtacttacgcgtaacgaaggtaactaacggaaaccgtacggtacccggttaagggaaaccgggtcgggaaaaccgtaaacctaacccggtttaacggttaacccgttttttaatacccggtttaaccggtaaaccccttttacggttaaacgggttaaaaccgacccgggtttaaaccgggaacccggggttacctaaccggggggtttacccgggaaccccgggtaaaaccgggttccccgttaaccggtacccgtcccggttcccccgttacggtaacccccg

SEQ ID NO: 256951 - DNA, 715 bp, Homo sapiens
  misc_feature: GYAE6OF01BNIZ4.25.66.F11.1.454.CMB.1.raw
  modified_base (708)..(708): a, c, t, g, unknown or other
  misc_feature (708)..(708): n is a, c, g, or t
tcagactgtacagtcacgaccggtgctcgatttagtcacgcgagaaggggggagaggagccccagccttgggattcccaagtgttttcattcagtgatcaggactgaacacagaggactcaccatggagtttgggctgagctggtattttccttgcagtcttattttaaaaggtgtaccactgtgtaggtgcagcgtggtggagtcgtgggggtacgtgttggtacgaaaccggtgggggactcccgtacgacgtaccttcctccgtgtcgctacggtcctacgttaccgtttcccttacaacggtaaccgcgttggagttcggtagtttcgggcccgccgtaggtccgtccggaggggacgggtcgtgggtacggttgggtacggtacgtaagttaacgacctaaagttacggtaggaaggttacgggaacgaaggtacgtaacgttcgactacggccgagttcccggagtaaacgacgtacgacgttaacactacgtctaacgagggtactacgtaattacgaaaccgaaacgtacggtacttcgtacgtcgttacgacgtaaccgtataacccggacgtacgtcgtaagggagttacgacggtacctacgtacgttcgtttaactccgttatcccgttagtaacaaggtaccgtacggtacgggtacgaggtccgggccgaaccgtcgttacgacccgtctcccncgtaccg

SEQ ID NO: 256952 - DNA, 849 bp, Homo sapiens
  misc_feature: GYAE6OF01EHI47.25.66.F11.1.454.CMB.1.raw
tcagactgtacagtcacgaccggtgctcgatttagtcacgcgagaaggggggagaggacgccccagccttgggattcccaagtgttttcattcagtgatcaggactgaacacagaggactcaccatggagttggctgagctggtattttccttgcagtcttaatttaaaaggtgtccactgtgaggtgcagtcgtggtggagtcggtggggagtcgttggtacggaaaccggtggggtactcccgtacgacgtaccttccgtccgtgtcgacctacgtcccgttaccgttaccggtttccctttaacgaaacgtaaccgtccgtaggaagtggttaacggttcggggtacccgaccgtaacgggtccgttaacccgggaagggggtaacgggggtccggttaggggtaacggggtttcgggggttacggtaaccccggtttaaagtttaaaccggtaacccgttaaagggtttacgggttaaggggtaaacggggttaacgggaaacccggtaaaggtaaccggtaaccgttaccggtacgttacggaccgttaacgtacccgggtaaagaaaacggtacctaaggtaccttaccgaaccgttacgttacgtaacggaaaggtacttacggtaaaccttaaccgaaaacgtacccctacgtacgtagttaactcgtacgtacgagtaacgtacgaactacggtccgtaaggaacggtaacgacgaactacgttacgttacgttacgttacctacgttaccctagtaacgaaccggtaccgtaaccgggtcggaacttccgggacgggacccgtaaccgggtcctacggaccctccggtctcccgtaccg

SEQ ID NO: 256953 - DNA, 710 bp, Homo sapiens
  misc_feature: GYAE6OF01AWQ5A.25.66.F11.1.454.CMB.1.raw
  modified_base (427)..(427): a, c, t, g, unknown or other
  misc_feature (427)..(427): n is a, c, g, or t
  modified_base (688)..(688): a, c, t, g, unknown or other
  misc_feature (688)..(688): n is a, c, g, or t
tcagactgtacagtcacgaccggtgctcgatttagtcacgcgagaaggggggagaggagccccagccttgggattcccaagtgttttcattcagtgatcaggactgaacacagaggactcaccatggagtttggctgagctggattttccttgcagctattttaaaaggtgtccactgtgaggtgcagctggtggagtcgtgggggaggtcgttggtgtaaaaccgtgggggtatccctcagcctctcctgtgcacgcctcgtacggttccctttacaagaaccgccgtggatgtaggttcgggtcccgcacggctcccgtaggggaaggggcgtaggagtgggttggccgttataaggaccaagtaggagaagggtcggaagagagaactacgctgactctaccgtagaagacagattacacctanctcaagggtctagaacttacaaacgaacccgtaccgacgttagtaactaccttggtaccgaacgtactaccggaaacgtacgacccggttaacggaaacgggttaccgtaaggggaacctaaccggttaacggttaacccttttaacgtttacccgttacgttaacccttaccgttttaacgaaaacgtacgtaacccgggtaggggaacccgttagggtaccccggggtaccgacgggttaaaccccgtgggttaacccnccccggttaccgtccccgtacg

SEQ ID NO: 256954 - DNA, 857 bp, Homo sapiens
  misc_feature: GYAE6OF01ATQW9.25.66.F11.1.454.CMB.1.raw
tcagactgtacagtcacgaccggtgctcgatttagtcacgcgagaaggggggagaggagccccagccttgggattcccaagttgttttcattcagtgatcaggactgaacacagaggactcaccatggagtttgggctgagctggatttttccttgcagcttaattttaaaaggtgtccactgtgaggtgcagcgtggtggagtcgtgggggagtcgttggtacgaaaccgtggggactccctcagactctcctgtgcacgtccttcttacggtttccctttacgaaacggaaccgtccgtaggtagttcggtacggtttccgggtcccgtaccgtacggcccgttacccgggaagggggaacgggggtcgtaggggtagggttggggttcggtaccgttaaagttaacgaaccgtaaagtacggtagggaaacgggtcgggaaacgtaaacggaacgaacgttaccggctacgaccgtaacgtacccggtaaagaaacgtaactacgtaaccgttaccaaccctactaccgttaacggaaacgggtattaacgtaacttaaccgaaaccggtacccacggtcttaaggtactcgtacgacgtagtacgtacgaaacctacggtaccgtaaggaacgggtaaccggacgtaaacccgtaccggttaacggtttacccgttttaaacgttacccgtttaccgggttaaccctttaaccgggttaaacgaaaacccggttacccggtaaaccggggttaacggggtaccccgttaacggggttacccggggaaccccgttaaaccgggggtaccccttaccgggttacccgtccccggttaaccccgtccggtaccccg

SEQ ID NO: 256955 - DNA, 739 bp, Homo sapiens
  misc_feature: GYAE6OF01E15NA.25.66.F11.1.454.CMB.1.raw
  modified_base (723)..(723): a, c, t, g, unknown or other
  misc_feature (723)..(723): n is a, c, g, or t
  modified_base (730)..(730): a, c, t, g, unknown or other
  misc_feature (730)..(730): n is a, c, g, or t
tcagactgtacagtcacgaccggtgctcgatttagtcacgcgagaaggggggagaggagcccagccttgggattcccaagtgttttcattcagtgatcaggactgaacacagaggactcaccatggagtttgggctgagctggattttccttgcagctattttaaaaggtgtccactgtgaggtgcagctggtggagtctggggagcgttggtgaaaccgtgggggactcccgtcagactctccgtgtgcacgtcctcttacggttccctttcgaaacgtaaccgcctaggatcggtaaggtttcggggtcccgaccgacgggtccgttacccgaagggggaaacgggggtccgtggtaacgggttcgggggttagggtacccggttaaatttaaacggaacccgtaaaagttaggtaggtaaacggggtgggaaccaaaggacgtaacgtaacgtcctaggactaagtacccgtaaggaaaacgtacgtaaacgtagtttaccaaccgtacttacgtaccgaaaggggcttaagaacgtttacgaaaacggaccctaaccgggtcttaggtactcgtacgctaagaactcgaaacgcgaccgtaggaacggtcgaaacggtacctaacgtacgttaccgtttactaacgttcggtacccttacgttagaaacgtcgaacggttaggggactacggcgggaccgaacggtacccttggacccnccgttcncccgtaacg

SEQ ID NO: 256956 - DNA, 536 bp, Homo sapiens
  misc_feature: GYAE6OF02I9CJD.25.66.F11.1.454.CMB.1.raw
tcagactgtacagtcacgaccggtgctcgatttagtcacgcgagaaggggggagaggagccccagccttgggattcccaagtgttttcattcagtgatcaggactgaacacagaggactcaccatggagtttgggctgagctggattttccttgcagctattttaaaaggtgtccactgtgaggtgcagctggtggagtctgggggaggcttggtgaaacctgggggatccctcagactctcctgtgcagcctctaggttccctttcaagaacgcctggatgagttgggtccgccaggctccagggaagggctggagtgggttggccgtattaagaccaatgtgaaggtggacaagagactacgctgcatccgtagaaagacagattcaccatctcgaagggatgattacaaagaccacgctgtatctgcagatgaacagcctgaggtcgaggacacagtccgtttatactgtacctccttagaagtcgaacgtcgggactacgtgggaccacggaccctgtcaccggtctcctcg

SEQ ID NO: 256957 - DNA, 541 bp, Homo sapiens
  misc_feature: GYAE6OF02IA6O9.25.66.F11.1.454.CMB.1.raw
tcagactgtacagtcacgaccggtgctcgatttagtcacgcgagaaggggggagaggagccccagccttgggattcccaagtgttttcattcagtgatcaggactgaacacagaggactcaccatggagtttgggctgagctggatttttccttgcagctattttaaaaggtgtccactgtgaggtgcagctggtggagtctgggggaggcttggtgaaacctgggggatccctcagactctcctgtgcagcctctaggttccctttcaagaacgcctggatgagttgggtccgccaggctccagggaaggggctggagtgggtggccgtattaagaccaatagtgaaggtgggacaagagactacgctgcatccgtagaaagcagattcaccatctacaagggatgattcaaagacacgctagtatctgcagatgaacagcctgaaggtcgaggacacagccgtttatactgtacctctttagaagcgaacgtcggggactacgtcgggaccagggaaccctggtccaccgtcctcctcg

SEQ ID NO: 256958 - DNA, 531 bp, Homo sapiens
  misc_feature: GYAE6OF02F5S2E.25.66.F11.1.454.CMB.1.raw
  modified_base (293)..(293): a, c, t, g, unknown or other
  misc_feature (293)..(293): n is a, c, g, or t
  modified_base (478)..(478): a, c, t, g, unknown or other
  misc_feature (478)..(478): n is a, c, g, or t
tcagactgtacagtcacgaccggtgctcgatttagtcacgcgagaaggggggagaggagccccagccttgggattcccaagtgttttcattcagtgatcaggactgaacacagaggactcaccatggagtttgggctgagctggattttccttgcagctattttaaaaggtgtccagtgtgaggtgcagttggaggagtctgggggaggcttggtccagccaggggggtccctgagactctcctgtgcagcctctggattcagttttagcagattttggatgagctgggtccnccaggccccaggggaaggggctgggtgtgggtagccaacatacacgaagatggagtgagaaatactatgcgactctgtgaagggccattcacatctcagggacaactccaacaactcaagtatatctgacaaatgaatggtctgaagagccgaggacacggctggtgttatttcgtggtgcgagngtcgccccgaatcccaatacgaccctatcgtcttttagattagtggtacgggg

SEQ ID NO: 256959 - DNA, 431 bp, Homo sapiens
  misc_feature: GYAE6OF02G4QUC.25.66.F11.1.454.CMB.1.raw
  modified_base (335)..(335): a, c, t, g, unknown or other
  misc_feature (335)..(335): n is a, c, g, or t
  modified_base (395)..(395): a, c, t, g, unknown or other
  misc_feature (395)..(395): n is a, c, g, or t
  modified_base (423)..(431): a, c, t, g, unknown or other
  misc_feature (423)..(431): n is a, c, g, or t
tcagactgtacagtcacgaccggtgctcgatttagtcacgcgagaaatggaaaggggctggtgtgggtctcacgtatttctaaagatggcaatgccagatactacgcggactccgtgaagggccgattcaccatctccagagacaacggcaagaacacggtggatctgcaaatgaacagtctgagagccgaggacacggcggtgtattattgtgtaagaggctgtgatggggactgccacggtgttgactactggggccagggaaccctggtcaccgtctcctcagcctccaccaagggcccatcggtcttccccctggccgccctgctccaggngcacctccgagacgcacagccggccctgggctgcctggtcaaggactactccactgtacngtctgagcgggctggcaaggcgcatagnnnnnnnnn

SEQ ID NO: 256960 - DNA, 552 bp, Homo sapiens
  misc_feature: GYAE6OF02FYX6Z.25.66.F11.1.454.CMB.1.raw
  modified_base (294)..(294): a, c, t, g, unknown or other
  misc_feature (294)..(294): n is a, c, g, or t
tcagactgtacagtcacgaccggtgctcgatttagtcacgcgagaagggggggagaggagccccagccttgggattcccaagtgttttcattcagtgatcaggactgaacacagaggactcaccatggagtttgggctgagctggattttccttgcagctattttaaaaggtgtccactgtgaggtgcagctggtggagtctgggggaggcttggtgaaacctgggggatccctcagactctcctgtgcagcctctaggttccctttcaagaacgcctggatgagttgggtccncaggctccgagggaaggggctggagtgggttggccgtattaagaccaatagtgaaggtggacaagagactacgctgcatccgtagaaagacagattcaccatctcaagggatgattacaaagaccacgctagtatctgcagatgaacagacctgaaggtcgaggacacgagtccgtttattactgtacccttcttagaacgtcgtaacgtcggggactacgtcgggaccacgggaccctggtaccaccgtcctcctcg

SEQ ID NO: 256961 - DNA, 786 bp, Homo sapiens
  misc_feature: GYAE6OF02H2BS3.25.66.F11.1.454.CMB.1.raw
  modified_base (614)..(614): a, c, t, g, unknown or other
  misc_feature (614)..(614): n is a, c, g, or t
tcagactgtacagtcacgaccggtgctcgatttagtcacgcgagaagggggggtaggaggagccccagccttgggattcccaagtgttttcattcagtgatcaggactgaacacagaggacttcaccatggagtttgggctgagcgtcggatttccttggccagctagtttaaaggtgtaccactgtggaggtgccagctggtggagtccttgggggaacgtcgttggtcgtaaaccgtgggggactccctcgacgtactcctcgtcgtcgcacgcctcctaggttccctttcgaacgaccggcctggacctggagttcgggtccgcgaggctccgagggaagggtctgggtaggtcggggttgggccgtaagttaacgtaccctaaacgttacgtaggaaagggtcgggaactaacggagacgtaacggctacggaccaagtaccggtagaaacgacgagtaacttccgtaaccactttcgttacgaaaggggtacttcggaactttaacgaaaaccggtaccgaccgtaccttagtttaactcgttacggacgtaaggtaacttacgtaaaccaggtaccctagggtaacgggtccgggacgggtaaacccncgtacgttacccgttttaagtaccgttacgttacccttccgttttaacggaaccggtcccgttaaaccggtacccgggggtaaccttaccgggttaccggggtccccggtaaaccggggttaccccgttccgggttaccccgtaacccggttcccgttacccgtaaccccgg

SEQ ID NO: 256962 - DNA, 584 bp, Homo sapiens
  misc_feature: GYAE6OF02HPHEA.25.66.F11.1.454.CMB.1.raw
  modified_base (356)..(356): a, c, t, g, unknown or other
  misc_feature (356)..(356): n is a, c, g, or t
tcagactgtacagtcacgaccggtgctcgatttagtcacgcgagaagggggggagaggagccccagccttgggattcccaagtgttttcattcagtgatcaggactgaacacagaggactcaccatggagtttgggctgagctggattttccttgcagctattttaaaaggtgtccactgtgaggtgcagctgggtggagtctggggggaggcttgggtgaaaccgtgggggactccctcagactctcctgtgcagcctctacggttccctttcaagaacgcctggatgaggttgggtccgccgaggctccgaggggaaggggctggaggtgggttggccgtataagaccaatagngaaggtgggaacaagagactacgctgcatcgtagaaagacagattcaccatctacgaaggatgattacaaagaccacgctagtatctgcagatagaacagcctagaaggtcgaggacacgtacgtccgtttaattactcgttaccttctttagaaacgtccgaacggtccggggaactaccggtcgggaccgacgggaaccctggtaccaccggttcctcccgtaccg

SEQ ID NO: 256963 - DNA, 547 bp, Homo sapiens
  misc_feature: GYAE6OF02FIC42.25.66.F11.1.454.CMB.1.raw
  modified_base (405)..(405): a, c, t, g, unknown or other
  misc_feature (405)..(405): n is a, c, g, or t
tcagactgtacagtcacgaccggtgctcgatttagtcacgcgagaaggggggagaggagccccagccttgggattcccaagtgttttcattcagtgatcaggactgaacacagaggactcaccatggagtttgggctgagctggattttccttgcagctattttaaaaggtgtccactgtgaggtgcagctggtggagtctgggggaggcttggtgaaacctggggatccctcagactctcctgtgcagcctctaggttccctttcaagaacgcctggatgagttgggtccgccagggcctccaggggaaggggctgggagttgggtgccggtattaagaccaatagtgaaggtgggacaaggagactacgctgcatccgtgaaagcagattcacatctcaaggntgtatcaaagaccacgctgtatctgcagatgaacagcctgaaggtcgaggacacgagtccgtttatactgtacctcgttagaacgtcgaaacgtcgggactacgtgggaccagggacccttggaccacccggtctaccctcg

SEQ ID NO: 256964 - DNA, 629 bp, Homo sapiens
  misc_feature: GYAE6OF02HY11E.25.66.F11.1.454.CMB.1.raw
  modified_base (359)..(359): a, c, t, g, unknown or other
  misc_feature (359)..(359): n is a, c, g, or t
tcagactgtacagtcacgaccggtgctcgatttagtcacgcgagaagggggggagaggagccccagccttgggattcccaagtgttttcattcagtgatcaggactgaacacagaggactcaccatggagtttgggctgagctggatttttccttgcagctattttaaaaaggtgtccactgtgaggtgcagctggtggagtctgggggaggcttggtgaaacctgggggatccctcagactctcctgtgcagcctctaggttccctttcaagaacgcctggatgagttggccgccaggctccgagggagggctgggagtgggtggccgtataacgaccaatagtgaaggtggacaagngactacgctgcatccgtagaaacgacagacttcacctatctacaagggatgacttacaaacgaccaacgctgtactctgacagatacgaaacacgaccgtaggaacggtacgaaggaccaacgacgtacccgtttttaataccgttacgttacccttacgtttacgaaacgtaccgtaaaccggttccgggggtaacttaaccgggtcggggaacccgtaacggggtaaccccgttgggtacccctacccggttcccgttaccctaccgg

SEQ ID NO: 256965 - DNA, 647 bp, Homo sapiens
  misc_feature: GYAE6OF02HITWI.25.66.F11.1.454.CMB.1.raw
tcagactgtacagtcacgaccggtgctcgatttagtcacgcgagaagggggggagaggagccccagccttgggattcccaagtgttttcattcagtgatcaggactgaacacagaggactcaccatggagtttgggctgagctggattttccttgcagctattttaaaaggtgtccactgtgaggtgcagctggtggagtctgggggaggcttggtgaaacctgggggatccctcagactctcctgtgcagcctctacggttccctttcaagaaccgcctggatggagttgggtcccgccgaggcctccgaggggaaggggcgtggaggtgggttggccgtagttaacgacctaaagtaggtgaagggtgggacaaaggagactacgctgcatccgtagaaagacagtacttcaaccatctacgaagggtactggaattacaaaagacccaaacgtccttagtaacttccgtagacgaagaactaggaaacacggtcctaggaaacgggtccgaaggacaacgtaggttacccttttaagttacttcgtaaccctttcgtttagaaacgtcctaacgggtccggggaacttacggtacggggacccgagggtaacccctggttaccgacccgttcctacccgtaccg

SEQ ID NO: 256966 - DNA, 659 bp, Homo sapiens
  misc_feature: GYAE6OF02F9J22.25.66.F11.1.454.CMB.1.raw
  modified_base (238)..(238): a, c, t, g, unknown or other
  misc_feature (238)..(238): n is a, c, g, or t
  modified_base (470)..(470): a, c, t, g, unknown or other
  misc_feature (470)..(470): n is a, c, g, or t
tcagactgtacagtcacgaccggtgctcgatttagtcacgcgagaagggggggagaggagccccagccttgggattcccaagtgttttcattcagtgatcaggactgaacacagaggactcaccatggagtttgggctgagctggattttccttgcagctattttaaaaaggtgtccactgtgaggtgcagctggtggagtctgggggaggcgttggtgaaaccgtgggggatccctnagactctcctgtgcagcctctacggttccctttcaagaacgcctggatgagttgggccgcaggctccgaggggaagggctggagtgggttcggccgtaagttaacgacctaagtagtagaaggtggacaagagactacgctgcatccgtagaaagacagattccaactatcacgaagggatggtaattacgaaagacctaagcttagactctaggactagtagtacgaaacncgtaccgtaggaacggttaccggaacggaaccaacgtacggttacccttttaacgttaccgttacgttaacccttaccgtttaggaaaacggtaccgtaaaccgggttaccgggggaaccttaaccggtcgggggaaccctaacgggggtaccccttgggtaccctacccggttccctacccgtaccgg

SEQ ID NO: 256967 - DNA, 629 bp, Homo sapiens
  misc_feature: GYAE6OF02IME9G.25.66.F11.1.454.CMB.1.raw
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
  modified_base (411)..(411): a, c, t, g, unknown or other
  misc_feature (411)..(411): n is a, c, g, or t
tcagactgtacagtcacgaccggtgctcgatttagtcacgcgagaagggggggaggaggagccccagccttgggattcccaagtgttttcattcagtgatcaggactgaacacagaggactcaccatggagtttgggctgagctggattttccttgcagctattttaaaaaggtgtccactgtgaggtgcagctggtggagtctgggggaggcttgggtgaaaacctgggggatcccctcagactctcctgtgcagcctctaggttccctttcaagaacgcctggatgagttgggtccgcaggctccgaagggaggggctgggagtgggttggccgtattaagacaatagngaaggtggacaagngactacgctgcatccgtagaaagcaagattcaccatctacgaaggntacgaattcaaaacgaccaacgcctagtaactcgtagcaagatacgaacgacgacctaggaacggtacggaaggaccaacgtacgtaccgttttaataccgttacgttaccttaccgtttagaaacgtaccgaacggttaccgggggaaccttaccgggtacggggacccgtaacggggaaccccttggggtaccctaccggttcctacccgtacccg

SEQ ID NO: 256968 - DNA, 750 bp, Homo sapiens
  misc_feature: GYAE6OF02F4TW1.25.66.F11.1.454.CMB.1.raw
tcagactgtacagtcacgaccggtgctcgatttagtcacgcgagaaggggggagaggagccccagccttgggattcccaagtgttttcattcagtgatcaggactgaacacagaggactcaccatggagtttgggctgagctggattttccttgcagcttattttaaaaggtgtccactgtgaggtgcagctggtggagtcgtgggggaggtcgttgggtagaaaccgtgggggactcccgtcgagacctcctccgtgtgcacgtccctctacggttcccttacaagaaccgccgtggataggtaggttcgggtcccgccgacggccgtaccggaggggaacggggcgtagggaggttggggttacggccggttaagtaacgacctaagtaggtaggaagggtagggaacaagacgaacgtacgacgtagacgtacgtaccgtaagaaacgtacaagtaacttaccaacctaactacgtaacgaaaggtatacgtaacttaacgaaacgacccacgtcttagtactcgtagactagtactacgaacgacgtacgtaaggaacggtacggaacggtaaccaacggtacgtttaaccgttttaacttaccgttacccgttaaccttaccgtttaacgaaacggttacccggtaaaccgggttaccgggggtaaacccttacgggtaccggggaacccgtaacccgggtacccgttaccggtacccgtaccccggttccgtaccccgtacccg

SEQ ID NO: 256969 - DNA, 836 bp, Homo sapiens
  misc_feature: GYAE6OF02GCRFF.25.66.F11.1.454.CMB.1.raw
tcagactgtacagtcacgaccggtgctcgatttagtcacgcgagaagggggggagaggagccccagccttgggattcccaagtgttttcatacagtgatcaggactgaacacagaggactcaccatggagtttgggctgagctggattttccttgcagctattttaaaaggtgtccatgtgaggtgcaactggcggagtcgggggagcgtggtccaggccgggaagtcccctgagactctcctgtgcagtcgtccgcgtccaccttccgtcgttttggcctattcacgttcgggtccgccaggtcctccgaggccaagggactgggagtggggtcggcggtcagtagttgggtgggatcgggaagttaagtcggacttaattttagtgactaagaccgttaccggtaggaaacggggtcccaacgttaccgaacccgtaattcccgtacccgaaggaacgggtccgtaacggtacccgttaacccgaaaacggtaaacccctttaacccgtttttaaacgtacccgttacggtaaccttaaacgtttaacggtaaaaaaccccggttaggtaaaccgaaccgttaccggaaacccggtaaaccggtacccgggtacgttaccgtttaacccgtttaacgtttaaccggtccggttacccggggtaccggggtttaccgtaacgggtaaaaccggtaaccgggttaaccgggggttacccgggggtaccccggttaaccggttaccgggaccgttaacggttaccggggaacccgtcccgggttaccggggggaacccctaaacgggggtacccttacggttccgggtaacccccgg

SEQ ID NO: 256970 - DNA, 632 bp, Homo sapiens
  misc_feature: GYAE6OF02G5GFJ.25.66.F11.1.454.CMB.1.raw
  modified_base (426)..(426): a, c, t, g, unknown or other
  misc_feature (426)..(426): n is a, c, g, or t
  modified_base (441)..(441): a, c, t, g, unknown or other
  misc_feature (441)..(441): n is a, c, g, or t
tcagactgtacagtcacgaccggtgctcgatttagtcacgcgagaagggggggagaggagccccagccttgggattcccaagtgttttcattcagtgatcaggactgaacacagaggactcaccatggagtttgggctgagctggattttccttgcagctattttaaaaggtgtccactgtgaggtgcagctggtggagtctgggggaggcgttggtgaaacctgggggatccctcagactctcctgtgcagcctctacggttccctttcaagaaccgcctggatgagttgggtccgccaggctccgagggaagggctggagtgggtggcgtatagcaatgtgaaggtggacagagactacgctgcagtccgtagaaagacagattcacactctacgaaggatagattacgaaagaccagctagtntccgtgacgagatanaacgacgtcctaggaaggtacgaagggacctaagacggttaccgttttaacgttacgttaccgttaccgttaccgtttacgaaacggtacccgtaaacgggttaccgggggtaaccttaccgggtaccgggggaccctaacgggggtaaccccttccgggtaacccaccggtttccctacccgttacccgg

SEQ ID NO: 256971 - DNA, 772 bp, Homo sapiens
  misc_feature: GYAE6OF02HX0OK.25.66.F11.1.454.CMB.1.raw
  modified_base (269)..(269): a, c, t, g, unknown or other
  misc_feature (269)..(269): n is a, c, g, or t
tcagactgtacagtcacgaccggtgctcgatttagtcacgcgagaagggggggagaggagccccagccttgggattcccaagtgttttcattcagtgatcaggactgaacacagaggactcaccatggagtttgggctgagctggatttttccttgcagcttattttaaaaaggtgtccactgtgaggtgcagctggtggagtcgtgggggaggcgttgggtagaaaaccgtgggggaactcccgtacgagtacctccttcctgtcgcncgcctcttacggttcccttacaacgaccgccgtgagtgaggttcgggtcccgccgaggtcctaccggagggggaaggggtcgtagggtagggttgggttcgggaccgttaagttaaacggaacctaaagttaggtaaggaagggtagggaacaaagacgtaacgtacgcgtagactacgtacgtaaggaaagacgaagtaacttccaacccgtaataccgtaacgtaaaggggtatagttaaacgttaaccgaaaacgaaccctaacgtacgtacggttaactaccgtagaccaaggtaacgtaacgaaaccgtaggtacccgtaaggtaagggtaacccgaaacggaaccgtaaacgtacgttaacccgttttaattaaccgttccgttaacctaccgtttagaaccgtaccgtaaccggtacggggtaacctaccgggtaccgggacccgtaacggggtaaccctacgggtaacccgtacccgttccgtaccctaacccgg

SEQ ID NO: 256972 - DNA, 848 bp, Homo sapiens
  misc_feature: GYAE6OF02HYICZ.25.66.F11.1.454.CMB.1.raw
tcagactgtacagtcacgaccggtgctcgatttagtcacgcgagaagggggggagaggagcccagccttgggattcccaagtgttttcattcagtgatcaggactgaacacagaggactcaccatggagtttgggctgagctggtattttcctgcagtcttattttaaaaggtgtccactgtgaggtgcagctgggtggagtcgtgggggagcttgggtagaaaccgtggggactcccgtcagactctcctgtgcacgctcgtacggttccttacgaacgacgccgtggacttggtagttcgggtccgccgaggtcctacggaagggtaacggggcgtggggtacggttgggttcggacctttaagtaaacggaccgtaagttaggaggtaagggtacgggaaactaaagggacgtaaaccgtacgtacgtaggacgtacgttacccggtaagtaaaaacgactaacggtaaccttacctaaccgaagtttaccgtacgtaaagggtactacggtaaacttaacggtaaaacgacccgtaacgtacttacggttactacgtacgtacgtaagtaacgtacggtaaaccacggtaaccggtacggtaaacggggttacggaaacggaaccggttaaccgtaacggtttaacccgttttaagtttaaccgttaccggtttaaaccgttaccccgttttaaaggaaaccggttacccggtaaaaccgggtttccggggggtaacccttaaaccgggggtttaccggggaaaccccggttaaccggggttaaccccggttacccgggttaaaccccgggttacccgttacccgttaacccccggtaacccgg

SEQ ID NO: 256973 - DNA, 471 bp, Homo sapiens
  misc_feature: GYAE6OF02FY0RZ.25.66.F11.1.454.CMB.1.raw
  modified_base (325)..(325): a, c, t, g, unknown or other
  misc_feature (325)..(325): n is a, c, g, or t
  modified_base (446)..(471): a, c, t, g, unknown or other
  misc_feature (446)..(471): n is a, c, g, or t
tcagactgtacagtcacgaccggtgctcgatttagtcacgcgagagggccaccgtcaactgcaagtccagccagagtcttttatacagtgccgacaataagaactacttagcttggtatcagcagaagccaggacagcctcctaagctgctcatttcctgggcatctacccgggaatccggggtccctgaccgattcagtggcagcgggtctgggacagatttcactctcatcatcagcggcctgccaacctgacgatgtggcgtttattacctgtcagcaacactatcttactcctcggacgttcggccaagggaccaaggtanaattcaagtcgaactggtggactgcacgatcgtgtacttcacttcctccccgcctatctacgaacctgtaacacgtcttggaggcgggcctagggcaaagggccttcgaactagcagcacnnnnnnnnnnnnnnnnnnnnnnnnnn

SEQ ID NO: 256974 - DNA, 709 bp, Homo sapiens
  misc_feature: GYAE6OF02GVLM5.25.66.F11.1.454.CMB.1.raw
tcagactgtacagtcacgaccggtgctcgatttagtcacgcgagaagggggggagaggagccccagccttgggattcccaagtgttttcattcagtgatcaggactgaacacagaggactcaccatggagtttgggctgagctggattttccttgcagctattttaaaaggtgtccactgtgaggtgcagctggtggagtcgtgggggaggcgttgggtagaaaccgtgggggactcccgtcagactctccgtgtcgcacgtccttcgttacggtttcccctttacgaaacgtaaccgccgtaggtatcggtaggttcgggtcccgccgaggcctaccggaaggggacggggcgtagggaggtggggttcggacccggttaagttaacgaacccgtaaagtaggtaggaagggtggaacaaggacgaccgtacgctgactacgtaccgtaagaaacgacgagtacttaccacctataccgtacgaaacgggtatacgtaacgttaaccaaaacggtaccctaacggtaccgttacggtaacttaccggtacgacgtaaggtaactaacggaaccgtacgtaccggtaggtaacgggacggtaacggactaccggaacgtttccgtttaactaccgtacgttacctcgttagacgtcgaacggtcggactcggacgggacgtaccggaccgtgtaccgtccgctccaccg

SEQ ID NO: 256975 - DNA, 612 bp, Homo sapiens
  misc_feature: GYAE6OF02F7KOM.25.66.F11.1.454.CMB.1.raw
tcagactgtacagtcacgaccggtgctcgatttagtcacgcgagaaggggggagaggagccccagccttgggattcccaagtgttttcattcagtgatcaggactgaacacagaggactcaccatggagtttgggctgagctggattttccttgcagctattttaaaaggtgtccactgtgaggtgcagctggtggagtctgggggaggcttggtgaaacctgggggatccctcagactctcctgtgcagcctctaggttcccttcaagaacgcctggatgagttgggtccgcgaggctccgagggaagggctggagtgggtggccgtataagaccaatagtgaaggtggacaagagactacgctgcagtccgtgaaagacagattcactatctacgaagggataggaattacgaaagtacccgaagtacctaggtaatcgttaggactaacgagttacgaaacagtacccgtagaacgggtacgaggtacacgtacgtccgtttaataccgtcgttaccttcgttagaacgtacgtaaccggtccggggtaactacgggtcgggtaccgaacgggtacccgtagggaccctacccggttacctccgtaccg

SEQ ID NO: 256976 - DNA, 457 bp, Homo sapiens
  misc_feature: GYAE6OF02FHVCB.25.66.F11.1.454.CMB.1.raw
  modified_base (329)..(329): a, c, t, g, unknown or other
  misc_feature (329)..(329): n is a, c, g, or t
  modified_base (401)..(401): a, c, t, g, unknown or other
  misc_feature (401)..(401): n is a, c, g, or t
  modified_base (434)..(434): a, c, t, g, unknown or other
  misc_feature (434)..(434): n is a, c, g, or t
  modified_base (436)..(457): a, c, t, g, unknown or other
  misc_feature (436)..(457): n is a, c, g, or t
tcagactgtacagtcacgaccggtgctcgatttagtcacgcgagagggccaccgtcaactgcaagtccagccagagtcttttatacagtgccgacaataagaactacttagcttggtatcagcagaagccaggacagcctcctaagctgctcatttcctgggcatctacccgggaatcccggggtccctgaccgattcagtggcagcgggtctgggacagatttcactctcatcatcagcggcctgcaacctgacgatgtgggtcgtttattactgtcagcaacactattccttactcctcggacgttcgccaacgggaccaagggtanaattcaagcgaactgtggctgcaccatctgtcttcacttccttcccgacatctgaaaccttgtacagttcgnggagcgggctagggaccaagggccactatacgncnnnnnnnnnnnnnnnnnnnnnn

SEQ ID NO: 256977 - DNA, 796 bp, Homo sapiens
  misc_feature: GYAE6OF02IUY20.25.66.F11.1.454.CMB.1.raw
tcagactgtacagtcacgaccggtgctcgatttagtcacgcgagaaggggggagaggagcccagccttgggattcccaagtgttttcattcagtgatcaggactgaacacagaggactcaccatggagtttgggctgagctggattttccttgcagctattttaaaaggtgtaccactgtgaggtgcagcgtggtggaggtcgtgggggaggtcgttgggtagaaaccggtgggggtatccccgttacgacggactccgtccgtgtcgccaaggtccttaccgttacgggtttcccctttcgtaacggtaaccgtccgtggacttcggaagttcggggtccgccgtacggccgtccgaggggaggggcgtggaggtcgggttcggtcggtagttaacgaaccgtaagtaggtacgaagggtaggggacgaaaggtaagaaccgtacgtaccgtaggacgtacgtacccggtaagaaaacgtaacgaagttaaacgttaccgaaaccgtacgtaccgtaacgtaacggggaacttaacggtaacgtaaacgtaaaacggtaacccgaaacgtaccgttacggtacctacgggttacaaccgtaggtaagtaccgtaaacgtaccggtaccgtaaggaacgggttacgaagggaaccgtaacgtacgttaccgtttaacttaccgtacgttaaccgttccgttacgaacgttaccgaacggtaccggggtacttaaccggtaccggggtaccgaacgggtaccgtacggttacccggaccgttcccgtacttacccgg

SEQ ID NO: 256978 - DNA, 767 bp, Homo sapiens
  misc_feature: GYAE6OF02FGMVZ.25.66.F11.1.454.CMB.1.raw
  modified_base (458)..(458): a, c, t, g, unknown or other
  misc_feature (458)..(458): n is a, c, g, or t
  modified_base (570)..(570): a, c, t, g, unknown or other
  misc_feature (570)..(570): n is a, c, g, or t
tcagactgtacagtcacgaccggtgctcgatttagtcacgcgagaagggggggagaggagccccagccttgggattcccaagtgttttcacttcagtgatcaggactgaacacagaggactcacctatggtagtttgggctgagctggtacttttcctgcagacttaattttaaaggtcgtaccactgtggtaggtgcagtcgtgggtggtagtcggtggggaggtcgttggtacgtaaaccggtggggtacctcccgtacgacgtaccttccgtccgtggtacgctacgtccctccgttacggttcccttacgaacgtaaccgtccgtaggtacgtcggtacggttccgggtcccgaccgtacggtccgtaccggagggggtaacgggtcgtagggtaggttgggttacggtaccgttaagttaacgaacctaagtaggtaggtaagggtacggaanaacggacgaccgtacgtcgtagacgtacgtaccgtaagaaacgacgtaacgtactaccgaacctactcgtaacggaaggtatacgtactaaccgaaacgacccaacgtctanactacgtgacagagacgaacgtcgacgtaggaacgtacggaacgaccacgttacgtttaccgttaattccgtacgttaacccgttacgtttaacgaaccgtaccggtaaccgggtaccgggtaaccttaccgggtccgggtaacccgtaaccgggttacccttccgggtaccctacccggttaccctacccggtccg

SEQ ID NO: 256979 - DNA, 685 bp, Homo sapiens
  misc_feature: GYAE6OF02HF526.25.66.F11.1.454.CMB.1.raw
  modified_base (374)..(374): a, c, t, g, unknown or other
  misc_feature (374)..(374): n is a, c, g, or t
tcagactgtacagtcacgaccggtgctcgatttagtcacgcgagaaggggggagaggagccccagccttgggattcccaagtgttttcattcagtgatcaggactgaacacagaggactcaccatggagtttgggctgagctggattttccttgcagctattttaaaggtgtccactgtgaggtgcagctggtggtagtcgtgggggagcttggtagaaacccgtgggggactcccgtcagtactctcctgtgcagtcctctacggttcccttacgaagaacgcctggatgacggttcggtccgtcgaggctccgaggggaaggggctgggagtcgggttcggccgtagtaacgactaagtagagaaggtgganaagagacacgctgaccatccggtagaaacgtacgatacgttacaaccctactactacgtaaacggtataggtaaacttaacgaaagacccgtaacgacgttacgtaactcgtacgtacaggaacttgaacgtagtaccgtaggtaacggtacggaacgtacgaaccgtaacggtaccgttttaattaacccgttcgttaaccccgttacgtttacgaaaccgttaccggtaacggttaccgggtaacgttaccggtacgggggacctaaccgggtacccgtaggttacccgtacccggtactacccgtcgg

SEQ ID NO: 256980 - DNA, 805 bp, Homo sapiens
  misc_feature: GYAE6OF02H3MIR.25.66.F11.1.454.CMB.1.raw
tcagactgtacagtcacgaccggtgctcgatttagtcacgcgagaagggggggagaggagccccagccttgggattcccaagtgttttcattcagtgatcaggactgaacacagaggaatcaccatggagtttgggctgagctggattttccttgcagctattttaaaaggtgtccactgtgaggtgcagctggtggagtcgtgggggaggcttgggtagaaaccgtgggggatcccgtcagactctcctgtgcagcctcgtacggttccctttcaaagtaccgcctaggattggaggttcgggtcccgccgagggcctcccggaagggggacggggtctggggaggttggggttcgggaccgtttaaagttaacgggaaacctaaagttagggtacggaaggggtacggggaaccgaaaggacggtaaccgtaccggacttacggacacgttaccggtaagaaaacgacgtaagtactttaccgaacctactcgtaacggaaaggggactttacggaactttaacgaaaacgtacccaacggtccttaggtacttaccgttcgaacgtaagtaacgtacgaaaccgtacgacccggttaaggaaaccgggttcggaaacggtaccaaccggtaacggtttacccgttttaagtaaccctttaccggttaccttttaccgttaaggaaacgtccggtaaccggggttaccggggtaaccttaaccggggtaccggggtaaccccggtaaccggggttaccccgttacgggtaccccgtaccccggtttacgtcccccgtaacccg

SEQ ID NO: 256981 - DNA, 1083 bp, Homo sapiens
  misc_feature: GYAE6OF02HL1QZ.25.66.F11.1.454.CMB.1.raw
tcagactgtacagtcacgaccggtgctcgatttagtcacgcgagaaggggggagaggacgccccagccttgggattcccaagtgttttcattcagtgatcaggactgaacacagagactcaccatggagttggctgagctggtattttccttgctagtacttaattttaaaaggtcgtccacttgtggtaggtgcagtcgtggtggtagtcggtgggggacgtcgttaggtacgtaaaccggtgggggtactcccgtacgacgtacctcctccgtgtcgaccgtacgtccttacgttaccggtttcccctttaacgaacgtaaccggtaccgtaggtacgttacgggtacggtttccgggggtaccccgccggtaacgggtaccccgttaaccggggaacgggggggtaacggggggttaccggttacgggggtaaggggttcggggggttaccggtccgttttaaccggtttaaccgttccggtttaacgttaagttaacggttagggtaaacggttaaggggttaaaaagtttaacggttttaaaaaaccgttaaccccgttaaaccccggggaccccgtttaaaaccccgggtttacccggggtaaaacggggttaaaccccggggttacccggttaaccgttttcccccggggtaacccgtttaccccggtaacccggtaaacgtaacccgggtaaaacccttaacccggttaaaaaccccgtaaaacgggttaaaacccgggtttccgggttttaaccttttaccgaacgtaaaacccggttaaacggtaaccgggtaaaacccgggttccgtaaaagggtaacgggtaaaacctttcgggggtaaacccgggtaaccgggtaaacccgggttgttttaaaggttaaacccgtttcggttttaaccggttggttaccgggttcccgttacgtttttaacccgtttttccaccccggttttaccgtcccggtttacccgttaaccccggacccttttaccccttaaccgttaaacctttccgttcgttacccgttactaaccgttaccggtacccggttaccgggttacccggtccggg

SEQ ID NO: 256982 - DNA, 791 bp, Homo sapiens
  misc_feature: GYAE6OF02JIFAA.25.66.F11.1.454.CMB.1.raw
  modified_base (218)..(218): a, c, t, g, unknown or other
  misc_feature (218)..(218): n is a, c, g, or t
  modified_base (261)..(261): a, c, t, g, unknown or other
  misc_feature (261)..(261): n is a, c, g, or t
tcagactgtacagtcacgaccggtgctcgatttagtcacgcgagaaggggggagaggagccccagccttgggattcccaagtgttttcattcagtgatcaggactgaacacagaggactcaccatggagtttgggctgagctggtattttccttgcagctattttaaaaggtgtccactgtgaggtgcagcgtggtggagtcgtggggagtcgttggngtaaaccgtggggactcccgtcgacgactcgtccgtgtgccgngtcctcgtacgttccccttagacgtaacgccgtaggtatgtagttcggtaccgccgacgccgtaccggacggggaacggggtcggtacggtaggttcggggttcggaccgttaagttaacggaacccgtaaagtacggtaggtaaacgggtggggaaacgaaaggtacggtaaccgtacggtcgtacgccgtaacgtacccggtaaggaaacgacgtaagtaactacgaaccgtactccgtaacgaaggggtactcggtaaacttacaaacgtaacccgtacgacgttacgtactacggacaacgaatacggtaacgaacgtacgtaacggtacggtaacgtaacggaacgtaacgtaacgaaccggtttacctttaaacggtttaccgtccgtttaaacccgttacttacgtaaaccggaccgttaaccggggtaaccggttaacccgttccggggtaacggggtaacccccgtacggggttacccccgtagggttacccgtaaaccccggttccgtacccgtacccgg

SEQ ID NO: 256983 - DNA, 906 bp, Homo sapiens
  misc_feature: GYAE6OF02F8H2F.25.66.F11.1.454.CMB.1.raw
tcagactgtacagtcacgaccggtgctcgatttagtcacgcgagaaggggggagaggagccccagccttgggattcccaagtgttttcattcagtgatcaggactgaacacagaggactcaccatggagttggctgagctggtattttctgctagtctaagtttaaaaggtgtacctactgtgaggtgctagtcgtaggtggagtcgtggggagtcgttgggtacgtaaccggtcggggtactcccgtacgacgtaccgttcgtccgtggtcgacctacgtcccgttacgttaccggttccccgttacgaaccgtaccgtcgtaggtacgttcggttacggttccggtacccgaccggtacggtaccggtaaccggggtaacggggtaacgggtcggtacgggtacgggttcgggttaccggtaaccgttaaacgttaacggtaaccgtaaggttacgggttaacggtaacggggttacggtaaacgtaaacggtacgtaaccgtaccggtacgtacgtaccgttaaccggtaacggtaacggtaaacgtacgtaacggttacttaaccgtaccgtaacgtaccggtaaggtaacggttagtaccgtaaacgttaacccgaaacgtaccgtaaccgtaccgttaggttcccgtacgtacgtacgtaacgttacggtaaacgtaaccgtacgttaccgggtaacggttaacggtacggtaacgtaaccgttaaccgtaccggtttaaaccggtttacttacccggttaacgtttaacccgttacgtaacgggaaacccgttacggggtaacccggttaccggggttaacccgtaacgggttaacccggtaccgggttaacccgggttaccttaaccggtacggtaccccgttacccgacccgttcgg

SEQ ID NO: 256984 - DNA, 555 bp, Homo sapiens
  misc_feature: GYAE6OF02H9L4V.25.66.F11.1.454.CMB.1.raw
  modified_base (272)..(272): a, c, t, g, unknown or other
  misc_feature (272)..(272): n is a, c, g, or t
  modified_base (462)..(462): a, c, t, g, unknown or other
  misc_feature (462)..(462): n is a, c, g, or t
  modified_base (527)..(555): a, c, t, g, unknown or other
  misc_feature (527)..(555): n is a, c, g, or t
tcagactgtacagtcacgaccggtgctcgatttagtcacgcgagagggccaccgtcaactgcaagtccagccagagtcttttatacagtgccgacaataagaactacttagcttggtatcagcagaagccaggacagcctcctaagctgctcatttcctgggcatctacccgggaatccggggtcctgaccgattcagtggcagcggtctgggacaggtatttccacttccgtcatactatcgacgtccggccttcgccaaccgttggaacnttggtcggtcggtttttatactgtcacgacgaacacttatctttacctccgttaccgggtaccgttccggaccggtaacggggaaccgtaaagggttacgtaaatttccgaaaggtaccgtaaagttcggtacgggtcgttacgcccgaacctgttacctttaggttcttaccgtaccttccgttccccnctacttctacgtaacttgaactgtacgtgaacggtcgggtacctgggacgacggcgactgtacgnnnnnnnnnnnnnnnnnnnnnnnnnnnnn

SEQ ID NO: 256985 - DNA, 658 bp, Homo sapiens
  misc_feature: GYAE6OF02GHD5Q.25.66.F11.1.454.CMB.1.raw
  modified_base (294)..(294): a, c, t, g, unknown or other
  misc_feature (294)..(294): n is a, c, g, or t
  modified_base (588)..(588): a, c, t, g, unknown or other
  misc_feature (588)..(588): n is a, c, g, or t
  modified_base (593)..(593): a, c, t, g, unknown or other
  misc_feature (593)..(593): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
  modified_base (609)..(609): a, c, t, g, unknown or other
  misc_feature (609)..(609): n is a, c, g, or t
  modified_base (621)..(621): a, c, t, g, unknown or other
  misc_feature (621)..(621): n is a, c, g, or t
  modified_base (635)..(635): a, c, t, g, unknown or other
  misc_feature (635)..(635): n is a, c, g, or t
  modified_base (639)..(639): a, c, t, g, unknown or other
  misc_feature (639)..(639): n is a, c, g, or t
  modified_base (643)..(643): a, c, t, g, unknown or other
  misc_feature (643)..(643): n is a, c, g, or t
  modified_base (649)..(651): a, c, t, g, unknown or other
  misc_feature (649)..(651): n is a, c, g, or t
  modified_base (654)..(654): a, c, t, g, unknown or other
  misc_feature (654)..(654): n is a, c, g, or t
  modified_base (656)..(656): a, c, t, g, unknown or other
  misc_feature (656)..(656): n is a, c, g, or t
tcagactgtacagtcacgaccggtgctcgatttagtcacgcgagagggaccaccgtcaactgcaagtccagccagagtcttttatacagtgccgacaataagaactacttagcttggtatcagcagaagccaggacagcctcctaagctgctcatttcctgggcatctacccgggaatccggggtccctgaccgattcagtggcaggcgggtctgggacagtatttcactctcatcatcgagccggcctgaccaaccgtgacgtatggtaggtcggtttaattcgtcgtcgacncaacgtacttattccttactccgtcggtacgttccggacgaacggggtaacctaagggtaactaacgttacgaacggacggtaacttggtcgggtctcgggtacctaacccgtacgttccgtttcgttacgttactaaccgttccccgtttcccccgaccgttacgttacccgtaacgttaaccgttacggtaaaccttacgggtttccccgtgggaacccgggttccggggttacgtccgggggtaaaccgtaccggggtacccgttaggtaaaccggtttaggctaccgacngtacncgtangngtgcgtcgngatacgagacgngtgtagacgtagcngagngtanacgacnnnctntntc

SEQ ID NO: 256986 - DNA, 781 bp, Homo sapiens
  misc_feature: GYAE6OF02GUJZN.25.66.F11.1.454.CMB.1.raw
  modified_base (268)..(268): a, c, t, g, unknown or other
  misc_feature (268)..(268): n is a, c, g, or t
tcagactgtacagtcacgaccggtgctcgatttagtcacgcgagaaggggggggagaggagccccagccgtgagattcccaggagtctccacttggtgatcagcactgaacacagaccaccaaccatggagtttgggcttaactgttcttttccttgttgcttagttttaaaggtgtcaatgtgaggtgcaactgggtggagtcgtggggggaggtcgttggtacagccgacgggcccggtcccgtgaccgacctcctccgtgccacngtccttccggactcctaccgtttggtgacgcatcgacttacgtcgaccgttcgggtcccgccgacggtccgtacccggaagggggtacggtccggtagggtacggtcgggtcggtttacgggttcaagtttaacggaacggacggtaaacggccgttaaggttcggggtacgggggaacaaacgtaacgtaaacgtaccggccggtacggttacgtaaaggtaaaacgggtctacggtacttaccgaccgttccctactacgaaaggtacgtaacgtagtaaaccggttaaaccaaaacggtcctaacgttccgtaccttacgtcgtacgtacctacgtagtacgacgtacgacgtaccgtaaggaacgggacgtaccggaacggtacctacggtaacgtccgttacgtttaaccgtttcgtttacgttttaactttaaccgttaccttacgttaggtaagttacggttaacggtttacgtttaagttttaacctttacgttaactttaaccg

SEQ ID NO: 256987 - DNA, 754 bp, Homo sapiens
  misc_feature: GYAE6OF02JGF4G.25.66.F11.1.454.CMB.1.raw
  modified_base (257)..(257): a, c, t, g, unknown or other
  misc_feature (257)..(257): n is a, c, g, or t
  modified_base (560)..(560): a, c, t, g, unknown or other
  misc_feature (560)..(560): n is a, c, g, or t
tcagactgtacagtcacgaccggtgctcgatttagtcacgcgagaagggggggagaggagccccagccttgggattcccaagtgttttcattcagtgatcaggactgaacacagagactcaccatggagtttgggctgagctggattttcctgcagcttaattttaaaaggtgtcctactgtgaggtgcagctggtggagtcgtggggagtcgttggagaaaccgtgggggactcccgtcacgactcctcctgcgcngccctcttaccgttcccttagaacgtaaccgccgtgatggtaggttcggtcccgccgacggtccgtaccgaaggggacgggcgtggtagggtgggttacggtaccgtaagttaacgactaagtaggtacggtaagggtaggaacgaaaggtacgaacgtacggtaccgtagacctaacgttaccggaaggaaaacggtacgtaacgtaactacccgaaacctagttacgtaacggaaaggtctaagtaaccttaacgaaaaccgtccctaaaggccttaaggtacctccgtagacagttaacncgaaacgtcgacgtaaggaaggaccgaagaacctcgtaacgtttacctttaagtacccgttacgacccttttaacgtaggaaaccgtacccgggtaacggttaacccggggtaatttaccggggacccggggtaaccccgaaccgggggtttaaccctcgggtaccccctaaccccgttcgtaacccccgtccg

SEQ ID NO: 256988 - DNA, 701 bp, Homo sapiens
  misc_feature: GYAE6OF02HS4NQ.25.66.F11.1.454.CMB.1.raw
  modified_base (301)..(301): a, c, t, g, unknown or other
  misc_feature (301)..(301): n is a, c, g, or t
tcagactgtacagtcacgaccggtgctcgatttagtcacgcgagaaggggggagaggagcccagcctggattcccaagtgtttcattcagtgatcaggactgaacacagagactcaccatggagttgggctgagctggattttccttgcagctatttaaaggtgtccactgtagagtgcagtctggtggagtcgtgggggagtcgttgggtagaaaccgtgggggactcccgtgagacttcgccgtgtcgcacgtactctacggttcccttagaagactccgtaggatcgtagttcggccnccgaggcctacggagggagggtctgggtacgttgggtcgtaccgttaagttacgaaccgtaaagtcggtaggaacgggttggaacgaaggtacgtaactacgggctggaccaacggttccggaagtaaaaggcctaagtacttaccgacacttaccgtgaacggtatcgtaacttaagaacctaacgacgtctagtacctacgtacgacgtaagtactacgaactagggacctaagggttaacccggtaccggaacgggtaacccaacggtaacgttaccgtttaaacgtacgtaccgttaaccgttccgttaagaaccggtacgtaacggtaccggggtataaccgggtacggaccggaacggtaccgtacgggtacctaccggttcctacgtacccgg

SEQ ID NO: 256989 - DNA, 817 bp, Homo sapiens
  misc_feature: GYAE6OF02G64R2.25.66.F11.1.454.CMB.1.raw
tcagactgtacagtcacgaccggtgctcgatttagtcacgcgagaagggggggagaggagccccagccttgggattcccaagtgttttcattcagtgatcaggactgaacacagaggactcaccatggagtttggctgagctggtacttttcctgcacgtcttaagttttaaaaggtgtccacgtggtagtaggtgcagcgtggtggagtcgtgggggacgtgtggtacggaaaccgtggggtactcccgtacgacgtacctcctaccgtggcgtccaccgtcccttcgttaccggtttccccttacgaaacggtaccggtccggtaggtagttacggtacgggttccgggtaccgccggtacggccggtaccggggaaggggggtacggggtccggttaggggtacgggttcgggttaccggtaccgttaaggtaaaccggtaacgtaaggttagggaagggtaacgggtacgggaaacgtaagtaccgtacgtacgtctacgacctaacggacggtaagaaacgacgtacgtaccttacgaaccgtagtccgtaacgaacggtattacgtaacgtaaccgaaacgtacctaccggttagttaacgtacgttccgtagtaacggtatacgaacggtaccgtaacggtcgtacgggaacggtaaccgacgtaacgtaccgtaccggtttactttacgtaccgttaccgttacttaaccggtacgaccgttaccggaacgggttacccggtaacgtccgggttaacggtacccggaaccgggtcgtaccggtacccgtaccgttccgtccgtacccgg

SEQ ID NO: 256990 - DNA, 779 bp, Homo sapiens
  misc_feature: GYAE6OF02IFGV5.25.66.F11.1.454.CMB.1.raw
tcagactgtacagtcacgaccggtgctcgatttagtcacgcgagaagggggggagaggagccccagccttgggattcccaagtgttttcattcagtgatcaggactgaacacagaggactcaccatggagtttggctgagctggtattttccttgcagctattttaaaaggtgtccatgtgaggtgcagcgtggtggagtcgtgggggaggtcgttgggtagaaaccgtgggggactcccgtcgacgtaccttcctccgtgtcgcacgtcctacgttacggtttcccctttacgaaacggtaaccgtcccgtaggacgtggtaggttccgggtcccgaccgacggtccgtacccggaagggggaacggggtcgtaggggtagggtttcggggtcggtaccggttaagttaaacgaaccgtaaagttaggtacggtaagggtagggaaccgtaaggaacgtacgtaccgctacgactacgtacggtaagaaaacgtacgaacgtacttacccacctacgtacccgtaaggaaggtactagtaacgttaacgaaacgacctaacgtaccgtagtacttccgtagaccgtaagtacgtaacgaacgtacgtaccgtaagggtaacggaacggacgaacccgtacgtacggttaccgttttaactacgtactttacccgtactttaacgaacgttaccgtacggtaaccgggtacaaccgggttacggaacccggtaccggtaacccggtaccggtacccgtaaccgtcccgtaccgtaccgg

SEQ ID NO: 256991 - DNA, 784 bp, Homo sapiens
  misc_feature: GYAE6OF02JNY5Z.25.66.F11.1.454.CMB.1.raw
  modified_base (115)..(115): a, c, t, g, unknown or other
  misc_feature (115)..(115): n is a, c, g, or t
  modified_base (289)..(289): a, c, t, g, unknown or other
  misc_feature (289)..(289): n is a, c, g, or t
  modified_base (352)..(352): a, c, t, g, unknown or other
  misc_feature (352)..(352): n is a, c, g, or t
  modified_base (406)..(406): a, c, t, g, unknown or other
  misc_feature (406)..(406): n is a, c, g, or t
  modified_base (576)..(576): a, c, t, g, unknown or other
  misc_feature (576)..(576): n is a, c, g, or t
  modified_base (590)..(590): a, c, t, g, unknown or other
  misc_feature (590)..(590): n is a, c, g, or t
tcagactgtacagtcacgaccggtgctcgatttagtcacgcgagaagggggggagaggacgcccagccttgggattcccaagttgttttcattcagtgatcagactgaacacagngactcacatggagtttggctgagctggtacttttcgttgcagtacttaagtttaaaaggtcgtaccacgttgtggtaggttcggaccagtcgttggtcggtaggttccggtgggggacgtcgttacggaacgaaccggtgggactcccgtaacgcgtacgttcctcgtggtacncacgtccgtacgttccgttaccttacgaaacggtctccgtggttaactttggtccggtacccncgtacggtccggtacggacggggtaacggtcgtagggtcggttcgggttaccgngttaacctaaggaaccgtaaggtagtacggttagggaccggagtaaaggaccgtccgtaaccggttgaacggtataccgtaaggtaagaacgaggtacctaaggtcacgttcaacgtaacggtacgtagacgttacgtaacgaaccgtacgacggtatacgtattaccgngtaacctagggaanacctaacgacgtccgaggtacgtaacgacgtacgtaccctaggttacgtttaaacccgttagttaacgtcccgtttaagtaaaccggttccgtaaacggtccggttaaccggaccgtttcgggaacccggttacccggaaaccggttccgtacggaaccccgttttaccgggcccttcgtaacccccgtcccgg

SEQ ID NO: 256992 - DNA, 534 bp, Homo sapiens
  misc_feature: GYAE6OF01EAFWF.38.39.D06.1.454.CMB.1.raw
  modified_base (277)..(277): a, c, t, g, unknown or other
  misc_feature (277)..(277): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaatcataattangagtcactaaacggcctcaggagtttctaatcgcttctctggctccaagtctggcaacacggcctccctgaccatctctgggcctccaacctgacggacgagctcactattattgcagctcatatacaagcagctcacttgggtgttcggcggacggaccgtacctgaccgtcttaggtcacgcccgaagcctacggtccccctaggtcctaccgttccgtcgttccccgcccttccctactaccgtgaacgtccgg

SEQ ID NO: 256993 - DNA, 411 bp, Homo sapiens
  misc_feature: GYAE6OF01BM93H.38.39.D06.1.454.CMB.1.raw
  modified_base (299)..(299): a, c, t, g, unknown or other
  misc_feature (299)..(299): n is a, c, g, or t
  modified_base (400)..(400): a, c, t, g, unknown or other
  misc_feature (400)..(400): n is a, c, g, or t
  modified_base (406)..(411): a, c, t, g, unknown or other
  misc_feature (406)..(411): n is a, c, g, or t
tcagtcgatcacgtcacgaccggtgctcgatttagtgacatctcgcagttctttggggactttgcctgggtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaacctgaggacgaggctcactattattgcagctcatatacaagcagcgtcacttgggtnttcggcggaggaccgacctgaccgtctaggtcagcccaaggctgcccctggtcactctgttcccacctcctcacgtgatcgactgagcggctggcaaggcncatagnnnnnn

SEQ ID NO: 256994 - DNA, 507 bp, Homo sapiens
  misc_feature: GYAE6OF01A693Z.38.39.D06.1.454.CMB.1.raw
  modified_base (479)..(479): a, c, t, g, unknown or other
  misc_feature (479)..(479): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataattatgaggtcactaaacggccctcaggagtttctaatcgcttctctggctccaagtctggcaacacggcctccctgaccatctctgggctccaacctgaggacaggctcactattattgcagctcatatacaagcagcgtcacttgggtgttcggcggagggaccgacctgaccgtctaggtcagcccaggctcgcccctggtcnctctcgttcccacctcctcacgtgctcg

SEQ ID NO: 256995 - DNA, 543 bp, Homo sapiens
  misc_feature: GYAE6OF01BH038.38.39.D06.1.454.CMB.1.raw
  modified_base (210)..(210): a, c, t, g, unknown or other
  misc_feature (210)..(210): n is a, c, g, or t
  modified_base (239)..(239): a, c, t, g, unknown or other
  misc_feature (239)..(239): n is a, c, g, or t
  modified_base (281)..(281): a, c, t, g, unknown or other
  misc_feature (281)..(281): n is a, c, g, or t
tcagtcgatcacgtcacgaccggtgctcgatttagtgacatctcgcgtaggttctttggggactttgcctgggctctgctgctcctcaccctccgtccactcagggcacagggtcctggcccagtctgccctgactcagcctgcctcgtgtctgggtctcctggacagtcgatcaccatctcctgcactggaaccagcagtgacgttggnggttataaatatgtctcttggtaccaagntcaccaacatcacccaggcaaagtcccaaaatcaataattangaggtacactaaacggcctcaggatttcaatcgcttctctggcttccaagttctggactaacgaccggcctccctagacctatctcgtgggctccaactgaggacgtaggtcttacgtaactattacttgcagctacaatatacaagcagcgtactacttgggtgttcggcggaacggaccgtacgtgtaccgttcgttacgtcacgccctaaggcctcgcccctaggtccactctcgttacccgcctcctcacgtgactcg

SEQ ID NO: 256996 - DNA, 431 bp, Homo sapiens
  misc_feature: GYAE6OF01A3KUL.38.39.D06.1.454.CMB.1.raw
  modified_base (411)..(431): a, c, t, g, unknown or other
  misc_feature (411)..(431): n is a, c, g, or t
tcagtcgatcacgtcacgaccggtgctcgatttagtgacatctcggcagttctttggggactttgcctgggtggatgttggtggttataaatatgtctcttggtaccaacatcaccaacatcacccaggcaaagtcccaaactcataatttatgaggtcactaaacggccctcaggagtttctaatcgcttctctggctccaagtctggcaacacggcctccctgaccatctctgggctccaacctgaggtacgaggctcactatattgcagctcatatacaagcagcgtcacttgggtgttcggcggagggaccgacctgaccgtcttaggcagcccaaggctcgcccctcggtcactctgttcccacctcctcacgtgatcgactgacgcgggctggcaaggcgcatgnnnnnnnnnnnnnnnnnnnnn

SEQ ID NO: 256997 - DNA, 484 bp, Homo sapiens
  misc_feature: GYAE6OF01A06SH.38.39.D06.1.454.CMB.1.raw
  modified_base (434)..(434): a, c, t, g, unknown or other
  misc_feature (434)..(434): n is a, c, g, or t
  modified_base (436)..(436): a, c, t, g, unknown or other
  misc_feature (436)..(436): n is a, c, g, or t
  modified_base (438)..(439): a, c, t, g, unknown or other
  misc_feature (438)..(439): n is a, c, g, or t
  modified_base (442)..(442): a, c, t, g, unknown or other
  misc_feature (442)..(442): n is a, c, g, or t
  modified_base (445)..(445): a, c, t, g, unknown or other
  misc_feature (445)..(445): n is a, c, g, or t
  modified_base (447)..(447): a, c, t, g, unknown or other
  misc_feature (447)..(447): n is a, c, g, or t
  modified_base (452)..(454): a, c, t, g, unknown or other
  misc_feature (452)..(454): n is a, c, g, or t
  modified_base (457)..(484): a, c, t, g, unknown or other
  misc_feature (457)..(484): n is a, c, g, or t
tcagtcgatcacgtcacgaccggtgctcgatttagtgacatctcgtcgagttctttggggacttttgccctgggtggacgttgggtgggttataaatatgtctcttggtaccaacatcaccaacatcacccaggcaaagtccccaaatcataatttatgaggtcactaaacggccctcaggagtttctaatcgcttctctggctccaagttctgggcaacacggcctcccgtgacccatcctctgggctccaacctgacggacgaggctcactattattgcacgctcatatacaagtcagcgtcacttggggtgtttcggcgggagggaccgacctgaccgtcttaggtcagccccaaggctgcccctggtcacgtctgtcccacctcctcacgtgactccgactgagccgggctgggcaacggcgcattacgncncnnagnacncngcgcnnncgnnnnnnnnnnnnnnnnnnnnnnnnnnnn

SEQ ID NO: 256998 - DNA, 603 bp, Homo sapiens
  misc_feature: GYAE6OF01AF7PD.38.39.D06.1.454.CMB.1.raw
  modified_base (229)..(229): a, c, t, g, unknown or other
  misc_feature (229)..(229): n is a, c, g, or t
  modified_base (292)..(292): a, c, t, g, unknown or other
  misc_feature (292)..(292): n is a, c, g, or t
  modified_base (354)..(354): a, c, t, g, unknown or other
  misc_feature (354)..(354): n is a, c, g, or t
tcagtcgatcacgtcacgaccggtgctcgatttagtgacatctcgcgtaggttctttcggggactttcgccgtgggctctgcttgctcctcaccctcctcactcagggcacagggtcctgggcccagtctgccctgactcgagcctgcctccgttgtctgggtctcctaggacagtcgatcaccatctcctgcactgggaaccagcagtgacgttggtggttataaatntgtctcttggtaccaacatccaccaacatccacccaggcaaacgtccccaaatcataatttangaggtcactaaacggccctcgaggtagtttctaagtcgcttctctggctcagtctggcaacncggccctccctgaccatcctcgtcgggtcctaccgaaccgtgacggacgaggctacacttattattcgactagctacatactacaagcagccgtctacgttgggtcgtcgggacgggacgggacccgtaccgtcgtaccgttcgtacggtcgacggcccgaaagggtcctaccggtcccccgtgggtcccgacgtcccgttccggttccccgtccccgttccgttacccgaccggtcgtacgtacccgg

SEQ ID NO: 256999 - DNA, 604 bp, Homo sapiens
  misc_feature: GYAE6OF01B70EA.38.39.D06.1.454.CMB.1.raw
  modified_base (235)..(235): a, c, t, g, unknown or other
  misc_feature (235)..(235): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaanatcaccaacatcacccaggcaaagtcccaaactcataattatgaggtcactaaacgccctcaggatttctaatcgcttctctggctccaagtctggcaacacgcctccctgacctatctctgggctaccaacctgaggacgaggctcacttattattgcagctacatactacaagctaagccgtctacgtttgggtagtttcggggaccggtaggggaccccgtaccgtcggtaaccccgttcgttacggtccgaacggacccctaaagggtcctccggtccccccgttccgggtaccctaacccgttccgttacccgttccccccggtccccttaccccgtacctacccggttcgaccgttaccccgg

SEQ ID NO: 257000 - DNA, 782 bp, Homo sapiens
  misc_feature: GYAE6OF01DA528.38.39.D06.1.454.CMB.1.raw
  modified_base (207)..(207): a, c, t, g, unknown or other
  misc_feature (207)..(207): n is a, c, g, or t
tcagtcgatcacgtcacgaccggtgctcgatttagtgacatctcgcgtaggttctttggggactttgcctgggctctgctgctcctcaccctcctcactcagggcacagggtcctggcccagtctgccctgactcagcctgcctccgtgtctggtctcctggacagtcgatcaccatctcctgcactggaaccagcagtgacgttgngttataatatgtctcttggaccaacatcacaacatcaccaggcaaagtcccaaatcataacttatgaggtacacgtaaacggcctacaggtacgtttcaatcgccttctcttggccttaccgaaagtcgttaggactaaaccgtaccggtacccttacccctaggaaccctaagtcccgtacgtacggggtaccttacccgaaacccgttggaaacgggaaccggtaagggttacccttaacctaaaccttaacgttttaacgttacggtacctaacgtaccgttaccgtaaagttaacttaaaccgtaaacgaccgtaagtacccgttacgtaacgttttcggggttacggttttaccgggacgggtaacggggtaaacccgttacccgttacggtaaccccgtttacgttaaccggttaccgtaaccggtaccccgtaaaaccgggtcccttaacccgggtacccccccgttaagggttaccctaacccggtttacccgttacccgggtttaccccccgtacccccgtttaccccgttaccgtacccggtttccggaccgtttaacccccggg

SEQ ID NO: 257001 - DNA, 513 bp, Homo sapiens
  misc_feature: GYAE6OF01EF7J7.38.39.D06.1.454.CMB.1.raw
  modified_base (340)..(340): a, c, t, g, unknown or other
  misc_feature (340)..(340): n is a, c, g, or t
  modified_base (486)..(486): a, c, t, g, unknown or other
  misc_feature (486)..(486): n is a, c, g, or t
  modified_base (505)..(505): a, c, t, g, unknown or other
  misc_feature (505)..(505): n is a, c, g, or t
  modified_base (510)..(510): a, c, t, g, unknown or other
  misc_feature (510)..(510): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcaactaaacggccctcaggagtttctaatcgcttctctgctccaagtctggcaacncggcctccctgaccatctctgggcctccaacctgaggacgaggctcactattattgcagctcatatacaagcagcgtcacgttgggtgttcggcggacggaccgtaccgtgaccgtcttaggtcagcccaaggctcgcccctgtcnctctcgtcccgcctcctcncgtgntcg

SEQ ID NO: 257002 - DNA, 546 bp, Homo sapiens
  misc_feature: GYAE6OF01A76P6.38.39.D06.1.454.CMB.1.raw
  modified_base (349)..(349): a, c, t, g, unknown or other
  misc_feature (349)..(349): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaacggcctcaggagtttctaatcgcttctctggctccaagtctggcaacacggcctcccngaccatctctcgggctccaacctgacggacgaggctcactattattgcagctcatatacaagcagctacactttgggtgttcgggcggacgggaccgtaccgtggacccgttacgtaggtccaggacccaagggcctacgtcccccgtaggtcctaccttccgtcgttccccgtccctccctcacgtgtactaccgg

SEQ ID NO: 257003 - DNA, 520 bp, Homo sapiens
  misc_feature: GYAE6OF01DOX7L.38.39.D06.1.454.CMB.1.raw
  modified_base (347)..(347): a, c, t, g, unknown or other
  misc_feature (347)..(347): n is a, c, g, or t
  modified_base (485)..(485): a, c, t, g, unknown or other
  misc_feature (485)..(485): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcacaacatcacccaggcaaagtccccaaactcataattatgaggtcactaaacggcctcaggagtttctaatcgcttctctggctccaagtctggcaacacggcctcccngaccatctctgggctccaacctgaggacgaggctcacttattattgcagctcatatacaagcagcgtcacgttgggtgttcggacggacggaccgacctgaccgtcttaggtcagcccaaggctcgccccctggtccncttctcgttccccgtccctcctccacgtgctaccg

SEQ ID NO: 257004 - DNA, 966 bp, Homo sapiens
  misc_feature: GYAE6OF01AYAYA.38.39.D06.1.454.CMB.1.raw
  modified_base (239)..(239): a, c, t, g, unknown or other
  misc_feature (239)..(239): n is a, c, g, or t
tcagtcgatcacgtcacgaccggtgctcgatttagtgacatctcgtcgtagggttcctttcggggactttgccctagggactctgactgcctcctcgtaccctccctccactcaggggcgacagggtccctcgggacccagtcgtcgccctcgacgtcacgaccctgccctccggtgtccggtcgggtcctcctgggacaggtccgtagtcaccctatccctcctcgcacgtggaaccngctaggtcgaccgttcggtagttactaaagttagttggtttcctcgtttggggtaccctaacggtacgtccaaaccgaacctaccgtaccggaaaccccggacgggtaccgaaaaaacggttccccccaaaaaagtttccggaaagtttaaatttttacgttcggtaacgggttaacctaaaccggtttaaaaaccgggggcccccgtttaaccgtaaaggggttaaaccgtttttaccgttaaaaccgtttcccggtacctttttaccgtaaccgttacggggtaccccttaacccggtaaaacggttccccttaaggggtaccctaaaaccccgtacccgggggttcccccttaaccccccgttacgggtaaaccccctaaaggttccccttaaacgttcccgggggtaccctttttaccccccgaaaaccggttaggaacgggtaccggtaacgggttcccttacgtaaccgttaacgttacgttcgaccgaacggtccgttactaacgttactacggtaacgcgtaaggaccgtacgtacgttagggttcgttcgggacgggttacgggaccgttacgttacggtacccgtacttacggtacgacgtacccggaacgggtccctccgggtacccccccgtggggtaccctaacggttacccgttaccggtttacccccgaccccgttacccttaccgtacccggttcggtaccttaccccggg

SEQ ID NO: 257005 - DNA, 532 bp, Homo sapiens
  misc_feature: GYAE6OF01BCC64.38.39.D06.1.454.CMB.1.raw
  modified_base (477)..(477): a, c, t, g, unknown or other
  misc_feature (477)..(477): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaccatgtctcctggtaccaacatcacccagacaaggcccccaaactcataatttatgacgtcagtagtcggccctcaggggtttctgatcgcttctcaggctccaagtctggcaacacggcctccctgaccatctctgggctccgaggttgaggacgaggctgactattatgcgcctcacatggaatcgagggtagggttttcggcggacgggaccaaagtcgaccgtcgtaggtcacgcccgaaggcctcgccccgtcgtcnctctcgttccccgcctccctcacgtcgacgtcgacgtgacgcggctggcaacggg

SEQ ID NO: 257006 - DNA, 429 bp, Homo sapiens
  misc_feature: GYAE6OF01CB1EV.38.39.D06.1.454.CMB.1.raw
  modified_base (331)..(331): a, c, t, g, unknown or other
  misc_feature (331)..(331): n is a, c, g, or t
  modified_base (388)..(388): a, c, t, g, unknown or other
  misc_feature (388)..(388): n is a, c, g, or t
  modified_base (421)..(429): a, c, t, g, unknown or other
  misc_feature (421)..(429): n is a, c, g, or t
tcagtcgatcacgtcacgaccggtgctcgatttagtgacatctcgcagttctttggggactttgcctgggtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaacctgaggacaggctcactattattgcagctcataataccaagccagcgtcacgttggggtgttcggcggagggacccgacctgaccgtnttaaggtcagcccaaggctcgcccccgtcgtcactctgttccccgccctctcacgtnactcgactgagtcgggctggcaaggcgcatagnnnnnnnnn

SEQ ID NO: 257007 - DNA, 520 bp, Homo sapiens
  misc_feature: GYAE6OF01C5R6Z.38.39.D06.1.454.CMB.1.raw
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
  modified_base (243)..(243): a, c, t, g, unknown or other
  misc_feature (243)..(243): n is a, c, g, or t
  modified_base (277)..(277): a, c, t, g, unknown or other
  misc_feature (277)..(277): n is a, c, g, or t
  modified_base (296)..(296): a, c, t, g, unknown or other
  misc_feature (296)..(296): n is a, c, g, or t
  modified_base (346)..(346): a, c, t, g, unknown or other
  misc_feature (346)..(346): n is a, c, g, or t
  modified_base (374)..(374): a, c, t, g, unknown or other
  misc_feature (374)..(374): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataaatntgtctcttggtaccaacatcaccaanatcacccaggcaaagtccccaaatcataatttangaggtcactaaacggcctnaggagtttcaatcgcttctctggctccaagtctggcaacacggcctcccngaccatctctggctccaactgaggacgngctcactattatgcagctnatanacaagcagcgtcacgttgggtcgttcggacggacgggaccgacctggaccgttcgttaggtcacgcccaaggcctcgcccccgtggtccactcctcgtcccctacctcctcacgtgtacgtcg

SEQ ID NO: 257008 - DNA, 534 bp, Homo sapiens
  misc_feature: GYAE6OF01DRSD2.38.39.D06.1.454.CMB.1.raw
  modified_base (494)..(494): a, c, t, g, unknown or other
  misc_feature (494)..(494): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcacaacatcacccaggcaaagtccccaaactcataattatgaggtcactaaacggccctcaggtagtttctaatcgcttctctggctccaagtctggcacacggcctccctgaccatctctgggctccaacctgaggacgaggctcactattattgcagctcatatacaagcagcgtcacgtttgggtgttcggcggacgggaccgaccgtgaccgttcgttacgtcacgcccgaagtcctcggccccctcggtccnccttcctccgttccccgccccttcctccacgtgctaccgg

SEQ ID NO: 257009 - DNA, 537 bp, Homo sapiens
  misc_feature: GYAE6OF01B4SPR.38.39.D06.1.454.CMB.1.raw
tcagtcgatcacgtcacgaccggtgctcgatttagtgacatctcgcagttctttggggactttgcctgggctctgctgctcctcaccctcctcactcaggacacagggtcctgggcccagtctgccctgactcagcctgcctccgtgtctgggtctcctggacagtcgatcaccatctcctgcactggaaccagcagtgacgttggtggttataaatatgtctcttggtaccaacatcacaacatcacccaggcaaagtccccaaactcataatttatgaggtcactaaacggcctcaggagtttctaatcgcttctctgctcaagtctggcaacacggcctccctgaccatctctgggctaccaacctgacggacgaggctcactattattgcagctcatataacaagcagcgtacacgttgggtgttcggacgggacgggacccgaccgtcgaccgttcgttacggtcacgcccgaaggcctacggccccctcggtccacttcctcgttccccaccctcctacgactcgatccgg

SEQ ID NO: 257010 - DNA, 519 bp, Homo sapiens
  misc_feature: GYAE6OF01A8H9Q.38.39.D06.1.454.CMB.1.raw
  modified_base (488)..(488): a, c, t, g, unknown or other
  misc_feature (488)..(488): n is a, c, g, or t
  modified_base (515)..(515): a, c, t, g, unknown or other
  misc_feature (515)..(515): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaaacggccctcaggagtttctaatcgcttctctggctccaagtctggcaacacggcctccctgaccatctctgggctccaacctgaggacgaggctcactattattgcagctcatatacaagcagcgtcacttgggtgttcggcggagggacccgaccgtgaccgtcttaggtcagcccaaggcctcgccccctggccnctctcgttcccgcccttcctcacgtgntccg

SEQ ID NO: 257011 - DNA, 539 bp, Homo sapiens
  misc_feature: GYAE6OF01C5NA5.38.39.D06.1.454.CMB.1.raw
  modified_base (356)..(356): a, c, t, g, unknown or other
  misc_feature (356)..(356): n is a, c, g, or t
  modified_base (425)..(425): a, c, t, g, unknown or other
  misc_feature (425)..(425): n is a, c, g, or t
  modified_base (485)..(485): a, c, t, g, unknown or other
  misc_feature (485)..(485): n is a, c, g, or t
  modified_base (515)..(515): a, c, t, g, unknown or other
  misc_feature (515)..(515): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcctggtaccaacaacacccaggcaaacgcccccaaaatcatcatttatgacgtcactcatcggccctcaggggtttctactcgcttctctggctcctaagtttggcaacaccggcctccctgacctatttcngggcctccaggctggaggacgaggcttgtaattttatgctctcatatacaggcagcagcctacccttancgtcttcggaactgggaaccaaggtccaccgtcctacgtcacgcccaaggccccaacccnctcgtcacgttcctcgttccccgccttccncacgtcactccgactgaggtccgg

SEQ ID NO: 257012 - DNA, 157 bp, Homo sapiens
  misc_feature: GYAE6OF01DLBPG.38.39.D06.1.454.CMB.1.raw
  modified_base (156)..(157): a, c, t, g, unknown or other
  misc_feature (156)..(157): n is a, c, g, or t
tcagtcgatcacgtcacgaccggtgctcgatttagtgacatctcgcagttctttgggggaagaggaagactgacggtcctgccacagcggccctgggctgcctggtcaaggactacttccacgtgatcgactgagcgggctggcaaggcgcatagnn

SEQ ID NO: 257013 - DNA, 517 bp, Homo sapiens
  misc_feature: GYAE6OF01BD04L.38.39.D06.1.454.CMB.1.raw
  modified_base (509)..(509): a, c, t, g, unknown or other
  misc_feature (509)..(509): n is a, c, g, or t
  modified_base (514)..(514): a, c, t, g, unknown or other
  misc_feature (514)..(514): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaacctgaggacgaggctcactattattgcagctcatatacaagcagcgtcacttgggtgttcggcggagggaccgaccgtgaccgtcttaggtcagcccaaggcctcgccccctggtcactctcgttccccgccctcctccncgtgntcg

SEQ ID NO: 257014 - DNA, 512 bp, Homo sapiens
  misc_feature: GYAE6OF01ENMR6.38.39.D06.1.454.CMB.1.raw
  modified_base (486)..(486): a, c, t, g, unknown or other
  misc_feature (486)..(486): n is a, c, g, or t
  modified_base (496)..(496): a, c, t, g, unknown or other
  misc_feature (496)..(496): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
  modified_base (509)..(509): a, c, t, g, unknown or other
  misc_feature (509)..(509): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaaagtccccaaactcataatttatgaggtcactaaacggccctcaggagtttctaatcgcttctctggctcaagtctgcaacacgctcctgaccatctctgggcctccaacctgaggacgaggctcactattattgcagctcatatacaagcagcgtctacgttgggtcgttcgggcggagggacccgacgtcgaccgtcttacggtcagcccaaggctcgcccctggcnctctgtcccnccctcncncgtgntcg

SEQ ID NO: 257015 - DNA, 564 bp, Homo sapiens
  misc_feature: GYAE6OF01BZFQW.38.39.D06.1.454.CMB.1.raw
  modified_base (236)..(236): a, c, t, g, unknown or other
  misc_feature (236)..(236): n is a, c, g, or t
  modified_base (410)..(410): a, c, t, g, unknown or other
  misc_feature (410)..(410): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttggtaccaanatcacaacatcacccaggacaaagtccccaaactcataattatgaggtcactcatccggcctcaggggtttctactcgcttctctggctcaagttgctacacggcctccctgactatttctgggctccgaggctagaggacgagctagtaattttatgcttcctactatatacnggactagcacgcctacccctttatcgttacttacggaactacgggacctaaggtcctacccgtcctacgtcaccgaccaacggacccaaccccgtacgtccgactaccttccgttaccgttacccctacccttccctacacgtgtactacccgg

SEQ ID NO: 257016 - DNA, 529 bp, Homo sapiens
  misc_feature: GYAE6OF01D8B33.38.39.D06.1.454.CMB.1.raw
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
  modified_base (443)..(443): a, c, t, g, unknown or other
  misc_feature (443)..(443): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtcccaaatcataattatgagtcactaacgcctcagagttctatacgcttctctcgctccagtctggacaacacgcctccctcgacactctctcggtctcctactgaggacgagcgtctactattattgcacgctcatatactanacancactctacttgggtcgtcgggcggggaccgaagtcngtaccgtccgtaggtcgacgaccgacggtctccgccccgtcggtccacgtccttcggttccccaccgttccctctaccgtgtaccg

SEQ ID NO: 257017 - DNA, 589 bp, Homo sapiens
  misc_feature: GYAE6OF01BMRBE.38.39.D06.1.454.CMB.1.raw
  modified_base (235)..(235): a, c, t, g, unknown or other
  misc_feature (235)..(235): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaanatcaccaacatcacccaggcaaagtccccaaaactcaataatttatgaggtcaactaaacggccctagaggtagtttctaatcgctttctctggctccaagtctggcaacacggcctccctgaccatcctcgtcgggcttaccgaacctgacggacgaggctcgactattatgcagctacatatacaagcagctcacgttgggtgttacggacggacgggaccgtaccgtcgtaccgtcgttacggtccaaggaccccgtaaaggtccctcggccccccgttgggtaccctaccgttccgttacccgttcccccgtccccgttccccttaccgtacccgttgtacgttacccgg

SEQ ID NO: 257018 - DNA, 543 bp, Homo sapiens
  misc_feature: GYAE6OF01B4V1N.38.39.D06.1.454.CMB.1.raw
  modified_base (235)..(235): a, c, t, g, unknown or other
  misc_feature (235)..(235): n is a, c, g, or t
  modified_base (501)..(501): a, c, t, g, unknown or other
  misc_feature (501)..(501): n is a, c, g, or t
  modified_base (530)..(530): a, c, t, g, unknown or other
  misc_feature (530)..(530): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaanatcaccaacatcacccaggcaaacgtccccaaaactcataatttatgaggtcactaaacggcctcaggagtttctaatcgcttctctgctccaagtctggcaacacggcctccctgaccatctctcgggctccaactgaggacgacggctcactattattgcagctcatactacaagcagcgtctacgtttgggtgttcgggcgggacgggaccgtaccgtgtaccgttcttaggtcagcccgaaggcctcggccccctcggtccncctccgtccgttccccgcccttccgtacnccgtgcgtaccgg

SEQ ID NO: 257019 - DNA, 566 bp, Homo sapiens
  misc_feature: GYAE6OF01B1Z15.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcacaacatcacccaggcaaagtccccaaactcataattatgaggtcactaaacggccctacaggagtttctaatcgcttctctggctcaagtctggcaacacgcctccctgaccatctctgggctccaactgaggacgaggctcactattatgcagctcatatacaagcagcgtcacgttcgggtgttcggacgggagggacccgtaccgtcgacccgttcttacggtcacggcccgaaaggcccgtcggccccccgtcgggttccaccgttcccgttccgttcccccctaccccttccccttaccgtaccggttcgacgttacccggg

SEQ ID NO: 257020 - DNA, 546 bp, Homo sapiens
  misc_feature: GYAE6OF01BTQ2O.38.39.D06.1.454.CMB.1.raw
  modified_base (279)..(279): a, c, t, g, unknown or other
  misc_feature (279)..(279): n is a, c, g, or t
  modified_base (337)..(337): a, c, t, g, unknown or other
  misc_feature (337)..(337): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaacgtccccaaactcataattangagtcactaaacggcctcaggagtttctaatcgcttctctggctcaagtctggcaacncggcctccctgaccatctctgggcctccaaccgtgacggacgaggctcactattatgcagctacatatacaagcagcgtctacgttgggtcgttcggcggacgggaccgtaccgtgacccgttgtacggtcacgcccgtaaggcctccgcccccgtggtcctaccgttccgtccgttccccgtccccttcctaccgacgtgacgtaccg

SEQ ID NO: 257021 - DNA, 527 bp, Homo sapiens
  misc_feature: GYAE6OF01BJ6JY.38.39.D06.1.454.CMB.1.raw
  modified_base (462)..(462): a, c, t, g, unknown or other
  misc_feature (462)..(462): n is a, c, g, or t
  modified_base (517)..(517): a, c, t, g, unknown or other
  misc_feature (517)..(517): n is a, c, g, or t
  modified_base (522)..(522): a, c, t, g, unknown or other
  misc_feature (522)..(522): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaacgtccccaaactcataatttatgaggtcactaaacggccctcaggagtttctaatcgcttctctggctccaagtctggcaacacggcctccctgaccatctctgggctccaacctgacggacgaggctcactattattgcagctcatatacaagcagcgtctacgttgggtgttcggcgggagggtaccgaccgtgacccgttntacggtcacgcccgaggcctcgccccctggtccactctcgttcccgcctcctccncgtgngtccg

SEQ ID NO: 257022 - DNA, 557 bp, Homo sapiens
  misc_feature: GYAE6OF01BSIVA.38.39.D06.1.454.CMB.1.raw
  modified_base (278)..(278): a, c, t, g, unknown or other
  misc_feature (278)..(278): n is a, c, g, or t
  modified_base (295)..(295): a, c, t, g, unknown or other
  misc_feature (295)..(295): n is a, c, g, or t
  modified_base (347)..(347): a, c, t, g, unknown or other
  misc_feature (347)..(347): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaacgtcccaaactcataattangagtcactaacggcctnaggtagttctaatcgtcttctctggctccaagtctggcaacacggcctcccngaccatctcgtcgggcctaccaaccgtggaacggacgaggctacacttattattcgcagctacatatacaagcagcgtctacgttgggtgttcgggacggacgggaccgtaccgtcgaccgtcgtacggtcacgcccaggcctaccgcccccgtcggtacctccgttccttccgttccccgcccttcccgtaccgtacgtcgacgtccgg

SEQ ID NO: 257023 - DNA, 856 bp, Homo sapiens
  misc_feature: GYAE6OF01C3I5R.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttggtaccaacatcacaacatcacccaggacaaacgtcccaaatcaattaattatgagtacaactaaaccggcctacgaggtacgtttactaactcgtcttctcgttacggccttaccgaaacgttccgttaggaccgaaaccgtaacccgggtccccttaccccgtacgtaaccccgtaaacttcccgttaccggttccgggggtaccctttacccccgaaaaccggtttacgggaaaccggggtaacccgggaacgggtacccgttacctaaactttaacgttttaacgtttacgggaccctaacggtaccttaaccctaaagttaaccttaaaacgaaaccggacgtaacggttacccggttaacgttaaccggttttgggggttaccgggtttaccgggggaaccgggggtaaacggggtaacccccggtaccggttaccggtaacccggttttacggttaacgggttacccggaacggtacccccggaaacggtccggttacccccggtaccccccggtttacccggggttaccctaaccccggtttccccgtcccgggttttccccccccgtcccccgttacccgttacccgtaacccgggttccgtaacggtttaacccccggg

SEQ ID NO: 257024 - DNA, 585 bp, Homo sapiens
  misc_feature: GYAE6OF01DO34A.38.39.D06.1.454.CMB.1.raw
  modified_base (234)..(234): a, c, t, g, unknown or other
  misc_feature (234)..(234): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatatgtctcttggtaccaanatcaccaacatcacccagcaaagtcccaaatcataatttatgagtcactaaacggcctcagagtttcaatcgcttctctgctcaagtctaggcaacacgcctccctgaccatctctgggcctacccaactgacggacgaggctcactattattgcagctctaatactaacaagcaagccgtactagtttgggtcgtttccgggacggacgggacccgtaccgtacggtacccgttcgttacggacgtacgccccgaaaggtcctacccggcccccttgggccctaccgttcccgttcccggtttcccccaaccccgtttccctacccgtaccggttcgaacggttacccgg

SEQ ID NO: 257025 - DNA, 559 bp, Homo sapiens
  misc_feature: GYAE6OF01COCUP.38.39.D06.1.454.CMB.1.raw
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttaataatatgtctcttggtaccaacatcaccaacatcacccaggcaaagtccccaaatcaataattatgaggtcactaaacggcctacaggtatttctaatcgtcttctctggcctcaagtctggactaacacggccctccctagaccatctcgtcgggcctaccaaccgtgaggacgacggctcacttattattgactagctnatanacaagcagcgtcgacgtttgggtacgttcgggcgggacgggacccgtacgttcggaccgttcgttaggcaacgtcccgaaggctccgccccgtcggtacctacttcctcgttccccgcccttccgacaccgttgctaccgg

SEQ ID NO: 257026 - DNA, 511 bp, Homo sapiens
  misc_feature: GYAE6OF01AZPUE.38.39.D06.1.454.CMB.1.raw
  modified_base (503)..(503): a, c, t, g, unknown or other
  misc_feature (503)..(503): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaacggccctcaggagtttctaatcgcttctctggctccaagtctggcaacactgcctccctgaccatctctgggctccaacctgagacgaggctcactattattgcagctcatatacaagcagcgtcacttgggtgttcggcggagggaccgacctgaccgtctaggtcagcccaaggctcgcccctcggtcactctcgttcccgccctcctcncgtgtacg

SEQ ID NO: 257027 - DNA, 540 bp, Homo sapiens
  misc_feature: GYAE6OF01DAOPO.38.39.D06.1.454.CMB.1.raw
  modified_base (299)..(299): a, c, t, g, unknown or other
  misc_feature (299)..(299): n is a, c, g, or t
  modified_base (359)..(359): a, c, t, g, unknown or other
  misc_feature (359)..(359): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataattatgaggtcaactaaacggccctnaggagtttctaatcgcttctctggctccaagtctggacaacacggcctccctgaccatcnctcgggctccaacctgaggacgagctcactattatgcagctacatatacaagcagcgttcacgtttgggtcgttcgggacggacgggaccgacgtcggaccgttcgttacggtcaacgcccaaggcctcggcccctacggtcactccgtacgttccccgtcccttcctcacgtgcgtaccg

SEQ ID NO: 257028 - DNA, 534 bp, Homo sapiens
  misc_feature: GYAE6OF01A16D9.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaactgagacgagctcactattattgcagctacatatacaagcagcgtcacttgggtgttcgggcggagggaccgacctgaccgtcttacggtcacgcccaaaggcctcgcccccttggtccacgttccctcgttcccccacccttcccgtccaccgttgctacccgg

SEQ ID NO: 257029 - DNA, 572 bp, Homo sapiens
  misc_feature: GYAE6OF01CGDYB.38.39.D06.1.454.CMB.1.raw
  modified_base (281)..(281): a, c, t, g, unknown or other
  misc_feature (281)..(281): n is a, c, g, or t
  modified_base (347)..(347): a, c, t, g, unknown or other
  misc_feature (347)..(347): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggacaaacgtccccaaactcataatttangagtcactaaacggcctacaggagtttcaatcgcttctctggctcaagtctgcaacacggcctccnaccatctctggctccgaacctgacggacgagctcactattatgacagctcatactacaagcagcgtactacgttgggtgttccggacgggacgggaccgtaccgtggtacccgtcgttacgggtcacggtcccgaaacggtcctccggcccccgttgggaccctaccgttcccgttaccgtttcccccctaacccgttccctaccgtaccgttcgacttcccggg

SEQ ID NO: 257030 - DNA, 567 bp, Homo sapiens
  misc_feature: GYAE6OF01DLWWY.38.39.D06.1.454.CMB.1.raw
  modified_base (303)..(303): a, c, t, g, unknown or other
  misc_feature (303)..(303): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaaactcaataatttatgaggtcactaaacggcccctanaggagtttctaatcgcttctctggctccaagtctggcaacacggcctccctgaccatctctgggctccaactgaggacgaggctcactattattgcagctcatactacaagcagcgtcacgttgggtgttcggcggagggacctaccgtggtaccgttcgttaggtccaggcccaagggtcctccgtccccccgtagggtccctaccgttcccgttcggtttccccccgccccttaccctccgtaaccgttggtacttacccgg

SEQ ID NO: 257031 - DNA, 653 bp, Homo sapiens
  misc_feature: GYAE6OF01CADQ9.38.39.D06.1.454.CMB.1.raw
  modified_base (185)..(185): a, c, t, g, unknown or other
  misc_feature (185)..(185): n is a, c, g, or t
  modified_base (236)..(236): a, c, t, g, unknown or other
  misc_feature (236)..(236): n is a, c, g, or t
  modified_base (245)..(245): a, c, t, g, unknown or other
  misc_feature (245)..(245): n is a, c, g, or t
  modified_base (284)..(284): a, c, t, g, unknown or other
  misc_feature (284)..(284): n is a, c, g, or t
  modified_base (326)..(326): a, c, t, g, unknown or other
  misc_feature (326)..(326): n is a, c, g, or t
tcagtcgatcacgtcacgaccggtgctcgatttagtgacatctcgcagttctttggggactttgcctgggctctgctgctcctcaccctcctcactcagggcacatggtcctgggcccagtctgcctgactcagcctgcctccgtgtctgggtctcctggacagtcgatcaccatctcctgcacnggaaccagcagtgagttggtagttaataaatatcgtctcttcggaaccaanatcaccaanatcacccaggacaaaactcccaaaactctaataatttangaggttacaacgtaaaccggccctagaaggtatttacaatcnctttctcgtcggtccttaccgaagttcgacggaccaaacgaccggtccctcccgtacgaaccaattccgtcgtacgggccctacccaaccgtggacggacgacggtcctactaacttatttaagttcgacctaagtcctatataactaacaaagctaagcgtactaggttgggtggttcggacgggacgggaccgaccgtacgtaccgtacgttaacggcacggacccgaacggtcctcccggtcccccgtacgggttccctaaccgtttccgttacccggttcccccgtcccgttaccccgttccgtaacggttccgtaaacccgg

SEQ ID NO: 257032 - DNA, 752 bp, Homo sapiens
  misc_feature: GYAE6OF01DXY8F.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatatgtctcttggtaccaacatcaccaacatcacccagacaaacgtcccaaactcataattatgaggtcaactaaacggccctacaggtacgtttctaatcgtacttctctggccttaccaagtctggacaacgaccggaccctccccgtagaacccattccgtaccgtcgggtaccctacccgaaaccgttgggaacggaccggtaacggtcccgttacctaacttagtttaacttcggactaacgtccttacaacttaacgtaaccgtaaaggccgtaacgtccggtttaccgtaaccggtttttgggggtaccggtttacccgggggaccggggtaaccgggggtaaccccgtaacccgttacgggttaaccccggtttacgttaacgggtacccaaccgggtacccccgaaagggtcccgtacccgggtcccccccgtttagggtacccctaacccgtttcccgttccccggttttaccccccccgcccgttaccccgttaccgttaacccggtcggtaacccgttaccccggg

SEQ ID NO: 257033 - DNA, 425 bp, Homo sapiens
  misc_feature: GYAE6OF01CNVSR.38.39.D06.1.454.CMB.1.raw
  modified_base (416)..(425): a, c, t, g, unknown or other
  misc_feature (416)..(425): n is a, c, g, or t
tcagtcgatcacgtcacgaccggtgctcgatttagtgacatctcgcagttctttggggactttgcctgggtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaacctgaggacgaggctcactattattgcagctcatatacaagcagcgtcacttgggtgttcggcggagggaccgacctgaccgtcttaggtcacgcccaaggctcgccccctcggtcactctcgttccccgccctcctcacgtgatcgactgagcgggctggcaaggcgcatagnnnnnnnnnn

SEQ ID NO: 257034 - DNA, 526 bp, Homo sapiens
  misc_feature: GYAE6OF01DK4X7.38.39.D06.1.454.CMB.1.raw
  modified_base (234)..(234): a, c, t, g, unknown or other
  misc_feature (234)..(234): n is a, c, g, or t
  modified_base (406)..(406): a, c, t, g, unknown or other
  misc_feature (406)..(406): n is a, c, g, or t
  modified_base (520)..(520): a, c, t, g, unknown or other
  misc_feature (520)..(520): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctcgtgtctgggtctcctggacagtcgatcaccatctcctgcactggaaccagcagtgacgttggtggttaataaatatgtctcttgtaccaanatcacaacatcacccagcaaagtcccaaactcataattatgaggtcactaaacggccctacaggagtttctaatcgcttctctggctcaagtctggctaacacggccctcctcgaccatctctcgggctccaaccgtgaggacgaggctacacttattatgacagctcatanacaagcagctcacgttgggtgttcggcggaggaccgtaccgtgtaccgtcgttacggtcacgcccgaacggctccgcccctggtcactctcgtcccctaccctcctcgacgtgntaccgg

SEQ ID NO: 257035 - DNA, 565 bp, Homo sapiens
  misc_feature: GYAE6OF01AS99Z.38.39.D06.1.454.CMB.1.raw
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (280)..(280): a, c, t, g, unknown or other
  misc_feature (280)..(280): n is a, c, g, or t
  modified_base (297)..(297): a, c, t, g, unknown or other
  misc_feature (297)..(297): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatntgtctcttggtaccaanatcaccaacntccacccaggcaaacgtcccaaactcataattangagtcactaacggcctnaggtatttcaatcgcttctctgctccaagtctggacaacgaccggcctccctgacctatcctcgtcgggcctcccaacgtggaggacgacggctctacttattatcgacagctacaatactaacagcagcgtctacgttgggtcgtcggacggacgggacctcgtacgtaccgttgtacgccgacgacccgaaggcctccggccccttggtcctaccgttccgttccgttcccccgtcccttacccgtcgaccgtcgtacgtacccgg

SEQ ID NO: 257036 - DNA, 430 bp, Homo sapiens
  misc_feature: GYAE6OF01BW39Y.38.39.D06.1.454.CMB.1.raw
  modified_base (413)..(413): a, c, t, g, unknown or other
  misc_feature (413)..(413): n is a, c, g, or t
  modified_base (419)..(430): a, c, t, g, unknown or other
  misc_feature (419)..(430): n is a, c, g, or t
tcagtcgatcacgtcacgaccggtgctcgatttagtgacatctcgcagttctttggggactttgcctgggtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctcctgaccatctctgggctccaacctgaggacgaggctcactattattgcagctcatatacaagcagcgtcacttgggtgttcggcggagggacccgactggaccgtctaggtcacgcccaaggcctcgcccctggtccactcgtcgttccccgcctcctccacgtgactcgactgagcgggctggcgaggcganagtagnnnnnnnnnnnn

SEQ ID NO: 257037 - DNA, 592 bp, Homo sapiens
  misc_feature: GYAE6OF01CBYTE.38.39.D06.1.454.CMB.1.raw
  modified_base (193)..(193): a, c, t, g, unknown or other
  misc_feature (193)..(193): n is a, c, g, or t
  modified_base (587)..(587): a, c, t, g, unknown or other
  misc_feature (587)..(587): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataaatatgtctcttggtaccaacatcaccaacatccacccaggccaaaagtccccaaaactcaattaaatttatgaggtacaactaaaacggccctcaaggtagtttctaatcgtcttctctcggctcccaagtctggaccaacaccggcctccctagacccatcttctagggcctacctaaccgtgaacgggaccgtaggctaccgaacttatttacttgctaagtctacaattatactaacgcagacgtacacgttagggtgttcgggcggacgggaccgaccgtcgaaccgtcgttaggcacggtccgaaacggtccacggtccccctggtccacgtccttaccgttcccaccttccctaccgtacgtccgtntaccg

SEQ ID NO: 257038 - DNA, 547 bp, Homo sapiens
  misc_feature: GYAE6OF01AJA55.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacaacacccaggccaaacgcccccaaactcatcatttatgacgtcactcatcggccctcaggggtttctactcgcttctctggctcaagtttggcaacacggcctccctgaccatttctgggctccgaggctgaggacgaggctgtaattttatgctcctcatatacaggcagcagcctaccccttatcgtccttcggaactcgggaaccgtaaggtcctaccgtcctacgtcacgcccaacgcccaacccacctcgtccaccttcctcgttcccctacccctccctcacgtacgactaccgactgcggtccggg

SEQ ID NO: 257039 - DNA, 628 bp, Homo sapiens
  misc_feature: GYAE6OF01B3XXH.38.39.D06.1.454.CMB.1.raw
  modified_base (613)..(613): a, c, t, g, unknown or other
  misc_feature (613)..(613): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgcctgactcacgccgtcgtccgtccgtcgttcgttcgggttcgttcctcggacgacgtcgactcaccactctcctcgcactacggaaccgacgcgagtggtacggttggttggttaattaaataatgtctcttcggtaccaacactcaccaacactcacccacggacaaactaccccaaacctacataaattttatgacggtacactaaaacggcctcaggtagtttctaatcgtcttctctcgctccagtctcgcaacacggcctcctcgacactctcgtgggctacctaacctggacggacgacggctctactagtttacttcgcacgctctaatactaacaacgacgcgtacgtctacgttggggttcggttcgggacgggacgggaccgtaccgtggtaccggtcgtttacggcacggacccgaaggtccgtcgcccccgttacgggtctacccgttcgttccggtttccccgccctccgttaccncggttcgcgtaccgg

SEQ ID NO: 257040 - DNA, 531 bp, Homo sapiens
  misc_feature: GYAE6OF01BGU18.38.39.D06.1.454.CMB.1.raw
  modified_base (403)..(403): a, c, t, g, unknown or other
  misc_feature (403)..(403): n is a, c, g, or t
  modified_base (418)..(418): a, c, t, g, unknown or other
  misc_feature (418)..(418): n is a, c, g, or t
  modified_base (490)..(490): a, c, t, g, unknown or other
  misc_feature (490)..(490): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatatgtctcttggtaccaacatcacaacatcacccaggcaaagtccccaaactcatcatttatgacgtcactcatcggccctcaggggtttctactcgcttctctggctccaagtttcgcaacacggcctccctgacctatttcgtcggctccaggctggaggacgaggctgtaattttattgctcctnatatacaggcagcanccacccttatcgtcttacggactgggaccaaggtcctaccgtcctacgtcacgcccgaaggcccaaaccccnctcgtccactccttcgttccccgccctccctctcgtgtacg

SEQ ID NO: 257041 - DNA, 421 bp, Homo sapiens
  misc_feature: GYAE6OF01CNQEV.38.39.D06.1.454.CMB.1.raw
  modified_base (414)..(421): a, c, t, g, unknown or other
  misc_feature (414)..(421): n is a, c, g, or t
tcagtcgatcacgtcacgaccggtgctcgatttagtgacatctcgcagttctttggggactttgcctgggtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaacctgaggacgaggctcactattattgcagctcatatacaagcagcgtcacgttgggtgttcggcggagggaccgacctgaccgtcttaggtcagcccaaggctcgcccctcggtcactctcgttcccgccctctcacgtgactcgactgagcgggctggcaaggcgcatagnnnnnnnn

SEQ ID NO: 257042 - DNA, 523 bp, Homo sapiens
  misc_feature: GYAE6OF01A2GKF.38.39.D06.1.454.CMB.1.raw
  modified_base (492)..(492): a, c, t, g, unknown or other
  misc_feature (492)..(492): n is a, c, g, or t
  modified_base (514)..(514): a, c, t, g, unknown or other
  misc_feature (514)..(514): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggcctccaacctgaggacgaggctcactattattgcagctcatatacaagcagcgtcacttgggtgttcgggcggagggaccgtaccgtgaccgttcgtacggtcacgcccaaggctcggcccctcggtcnctctcgttccccgccctcctcncgtgcgtcg

SEQ ID NO: 257043 - DNA, 529 bp, Homo sapiens
  misc_feature: GYAE6OF01E4360.38.39.D06.1.454.CMB.1.raw
  modified_base (235)..(235): a, c, t, g, unknown or other
  misc_feature (235)..(235): n is a, c, g, or t
  modified_base (425)..(425): a, c, t, g, unknown or other
  misc_feature (425)..(425): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaanatcaccaacatcacccaggcaaagtccccaaactcataatttatgaggtcactaaacggcctcaggagtttctaatcgcttctctgctccaagtctggcaacacggcctccctgaccatctctgggctccaacctgaggacgaggctcgactattattgcagctcatatacaagcagctcacgtttgggngttcggacggagggacccgtacctggaccgtcttacggcacgcccaaaggcctcggcccctcggtccacttcctgttccccctaccctcctccacgtgataccg

SEQ ID NO: 257044 - DNA, 612 bp, Homo sapiens
  misc_feature: GYAE6OF01BJR2N.38.39.D06.1.454.CMB.1.raw
  modified_base (217)..(217): a, c, t, g, unknown or other
  misc_feature (217)..(217): n is a, c, g, or t
  modified_base (234)..(234): a, c, t, g, unknown or other
  misc_feature (234)..(234): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatntgtctcttggtaccaanatcaccaacatcacccaggcaaacgtccccaaactcaataattatgagtcactaaacgcctacaggtagtttctaatcgtctttctctggctaccaagtctggaccaacaccggcctcccgtgaccatcctcgtcgggcctccaacgtgacggacgaggcctcacttattattgacagtctacatactacaagcagcgtctacgttgggtgttcggacgggtacgggacccgtaccgtcggtaccgttcgttacggtccgaacggtccccgaagggtcctacccggtcccccgttacgggtccctacccgttcccgttacccggttcccccgtacccccgttcccgttacccgtaccggttcggtaaccgtacccggg

SEQ ID NO: 257045 - DNA, 651 bp, Homo sapiens
  misc_feature: GYAE6OF01CR7RA.38.39.D06.1.454.CMB.1.raw
  modified_base (243)..(243): a, c, t, g, unknown or other
  misc_feature (243)..(243): n is a, c, g, or t
  modified_base (286)..(286): a, c, t, g, unknown or other
  misc_feature (286)..(286): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgccttccgtgtctgggtctcctggacagtcgatcaccatctcctgcacgtggaaccagcaggtcgacggtttggtggttaataaatatgtctcttggtaccaacntacaccaacatcacccaggcaaacgtcccaaatcataacttangacggtcaacgtaaacggcctagaggtagtttctaatcgacttctctggctcgaagtctggaccaacgaccggtccttcccagaccctatccgtcgtcggggtaccctaccgaaaccgttggaacggaccggtacggtacctacgaacttaactttaacgttcgactacgtctacaatactaacaacgcagtcgtactacgttgggtcggttacgggacgggacgggaccgtacgtcgtaccgttacttacggtactacgacccgaacggtccgtaccggtcccccgttaggtacctaaccgttccgttacccgttcccccgtacccgttcccgttaccgtaaccggttcgtaccgttacccggg

SEQ ID NO: 257046 - DNA, 520 bp, Homo sapiens
  misc_feature: GYAE6OF01EB3K1.38.39.D06.1.454.CMB.1.raw
  modified_base (360)..(360): a, c, t, g, unknown or other
  misc_feature (360)..(360): n is a, c, g, or t
  modified_base (499)..(499): a, c, t, g, unknown or other
  misc_feature (499)..(499): n is a, c, g, or t
  modified_base (514)..(514): a, c, t, g, unknown or other
  misc_feature (514)..(514): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaaactcataatttatgaggtcactaaaacggccctcaggagtttctaatcgcttctctggctccaagtctggcaacacggcctccctgaccatcnctggctccaacctgaggacgaggctcactattattgcagctcatataacaagcagcgtcacttgggtgttcggcggaggaccgacctgaccgtcttaggtcagcccaaaggctagccccctggtcactctcgttccccnccctccctcacgtgntaccgg

SEQ ID NO: 257047 - DNA, 532 bp, Homo sapiens
  misc_feature: GYAE6OF01DZ1JF.38.39.D06.1.454.CMB.1.raw
  modified_base (193)..(193): a, c, t, g, unknown or other
  misc_feature (193)..(193): n is a, c, g, or t
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
  modified_base (333)..(333): a, c, t, g, unknown or other
  misc_feature (333)..(333): n is a, c, g, or t
  modified_base (519)..(519): a, c, t, g, unknown or other
  misc_feature (519)..(519): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccngcagtgacgtttggtggttaataaatatgtctcttggtaccaantccaccaanatcacccaggcaaagtccccaaactcataattatgagtcactaaacggcctcaggtatttctaatcgtctctcgtggctccaagtcnggcacgaccggcctccctgaccatcctcgtcgggcctccgaacgtgacggacgacggctacacttattattgcagctacactatacaagcagcgtcacgttggtgttcggcggacggaccgactcgacgtcgttagtcgacgccgaacgctccgccccgtaggcctcgtctcgtccccgtcctccnctcgtgcgtaccg

SEQ ID NO: 257048 - DNA, 583 bp, Homo sapiens
  misc_feature: GYAE6OF01DQ0YB.38.39.D06.1.454.CMB.1.raw
  modified_base (235)..(235): a, c, t, g, unknown or other
  misc_feature (235)..(235): n is a, c, g, or t
  modified_base (294)..(294): a, c, t, g, unknown or other
  misc_feature (294)..(294): n is a, c, g, or t
  modified_base (433)..(433): a, c, t, g, unknown or other
  misc_feature (433)..(433): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttaataaatatgtctcttggtaccaanatcacaacatcaccagcaaacgtcccaaatcataattatgaggtcactaaacggcctanaggagtttcaatcgtcttactctggtctcctaagtctaggcaaacgacggtccctccctgaaccattcctcgtgggcctaccaaccgtgaacgggaacgaggcctacacttaacttattcgctagcttacattactaanaacgcagctcgacgttgggtgttcggcgggaaggacccgtactcgaccgttgttacggtccacgacccgaaggcctccggacccccgttggtacctaccgttcgttccgttaccccctcccgttaccctcgtaaccgtgtacgtacccgg

SEQ ID NO: 257049 - DNA, 675 bp, Homo sapiens
  misc_feature: GYAE6OF01D2AYW.38.39.D06.1.454.CMB.1.raw
  modified_base (220)..(220): a, c, t, g, unknown or other
  misc_feature (220)..(220): n is a, c, g, or t
  modified_base (293)..(293): a, c, t, g, unknown or other
  misc_feature (293)..(293): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatcctcctgcactggaaccagcagtgacgttggtagttaataaatntgtctcttggtaccaacatcaaccaacactccaacccgaggaccaaaacgtccccaaactctaattaatttangaggtaccaactaaaccggccctagaggtactttactaatccgtctttcctcgtcggccttaccgtaagtctggaccaaccgaccggtccctccccgtagaaccctacttccgtcgtcgggtaccctacccgaaccgtggaacggacgacggtcctactaactttattagttcgactacgtctacaattactaacgagcacgtcctacgtacggttcgggttggtaccggacgggaccgggtaccctaccgttcggtacccgttacgttacggaccacggtacccgtaacggtccttccccgggtcccccgttcggttacccacctttcccgttaccccggttcccccgtaccccttcccttaccgcgttcgccgtacccgg

SEQ ID NO: 257050 - DNA, 624 bp, Homo sapiens
  misc_feature: GYAE6OF01EX0UB.38.39.D06.1.454.CMB.1.raw
  modified_base (238)..(238): a, c, t, g, unknown or other
  misc_feature (238)..(238): n is a, c, g, or t
  modified_base (425)..(425): a, c, t, g, unknown or other
  misc_feature (425)..(425): n is a, c, g, or t
tcagtcgatcacgtcacgaccggtgctcgatttagtgacatctcgcaggttctttggggactttgcctgggctctgctgctccctcaccctcctcactcagggcacagggtccctgggcccagtctgccctgactcagcctgcctccgtgtctgggtctcctggacagtcgatcaccatctcctgcactggaaccagcagtgacgttggtgttataaatatgtctcttggtaaccaanactacaccaacatcacccagacaaacgtcccaaactcataattatgagtcactaaacgcctcaggtagttctaatcgcttctctggctccaagtctaggcacaccggcctccctagaccatccgtacgtcgggtcctacctaaaccgtgacggacgacggtctactaacttattacttgctaagctnatatacgaagcagtcgtcgtaacgttcgggtagttccgggacgggtaacgggacccgtaccgtacgtaccgtacgttacgggtcctacggtcccctaaacgggccttcccgggcccccgttaggtcccaaccgttccccggttcccgttacccccggccccgtttcccgttaccgtaccggtttcggaccgttacccgg

SEQ ID NO: 257051 - DNA, 661 bp, Homo sapiens
  misc_feature: GYAE6OF01BO437.38.39.D06.1.454.CMB.1.raw
  modified_base (244)..(244): a, c, t, g, unknown or other
  misc_feature (244)..(244): n is a, c, g, or t
  modified_base (269)..(269): a, c, t, g, unknown or other
  misc_feature (269)..(269): n is a, c, g, or t
  modified_base (338)..(338): a, c, t, g, unknown or other
  misc_feature (338)..(338): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctctggacagtcgatcaccatctcctgcactggaaccagcagtgacgttggtggttataaatttgtctcctggtaccaacagcaccgggnaatcgaccccaaaatcatgatttangagtcactcactcggccctcgacggggtttactaactcggtctttctctgacatccaagtctggcaacnccggtccctcctcgaccactctcgtcgggtcctacgacggcgtggaacggacgagggtacttaatttacgtttcgtagactaacggtttcaagttataaacccaaccgtagacctaaactaccttctacgtacttaggttccgggacgggtaacggaacccgtaacggtccgttacggtacccgttaccgtaaacgttccgaaccgtacccgtaaacggccgttacccggtccccccgttacgggttaccaacccgttcccgttacccgttaccccctacccccgttaccttacccgtacggttacgtacctccggtaaccgg

SEQ ID NO: 257052 - DNA, 567 bp, Homo sapiens
  misc_feature: GYAE6OF01A2082.38.39.D06.1.454.CMB.1.raw
  modified_base (282)..(282): a, c, t, g, unknown or other
  misc_feature (282)..(282): n is a, c, g, or t
  modified_base (303)..(303): a, c, t, g, unknown or other
  misc_feature (303)..(303): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatatgtctcttggtaaccaacatcaccaacatcacccaggacaaacgtccccaaactcaataatttangaggtcaactaaacggccctnaggtagtttctaatcgcttctctggctcaagtctggacaacgacgcctccctgaccatctcgtggcctccaaccgtgacggacgaggcctacactattatgactagctcaatatacaagcagcgtctacgttgggtcgtcggcggacggaccgtaccgtgtaccgtcgttacgtcacggacccgtaaggccgtccggtcccccgttggtacctaccgttccgtccgttcccctacccttcccgtactaccggtcgcgtacccgg

SEQ ID NO: 257053 - DNA, 524 bp, Homo sapiens
  misc_feature: GYAE6OF01CZL6S.38.39.D06.1.454.CMB.1.raw
  modified_base (298)..(298): a, c, t, g, unknown or other
  misc_feature (298)..(298): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaatcataatttatgaggtcactaaacggccctnaggagtttctaatcgcttctctggctccaagtctggcaacacggcctccctgaccatctctgggctccaacctgaggacgaggctcactattattgcagctcatatacaagcagcgtcacgtttgggtgttcggcggagggaccgacgtgaccgtcgttaggcaggcccaaggctcgcccccgtgtccactccgtcgttccccgtcccttcctcaccgtgcgtccg

SEQ ID NO: 257054 - DNA, 572 bp, Homo sapiens
  misc_feature: GYAE6OF01EIHZB.38.39.D06.1.454.CMB.1.raw
  modified_base (470)..(470): a, c, t, g, unknown or other
  misc_feature (470)..(470): n is a, c, g, or t
  modified_base (535)..(535): a, c, t, g, unknown or other
  misc_feature (535)..(535): n is a, c, g, or t
  modified_base (560)..(560): a, c, t, g, unknown or other
  misc_feature (560)..(560): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaacgtccccaaactcataattatgaggtcactaaacggcctcaggagtttctaatcgctttctctggctccaagtctggaccaacgaccggccctccctacgaccctatccgtcgtcgggcctacccgaaccgtggaacggtacgacgggtcctacaccttaattattgcagctacagtatacaagcagccgtctacgtttgggtcgttcgggngggaacgggacccgacgtcgtaccgttcgttacggtcacgccgaggcctcgcccccttggtaccncgtcctcgtccccgtcctcctaccncgtcgcgtaccg

SEQ ID NO: 257055 - DNA, 724 bp, Homo sapiens
  misc_feature: GYAE6OF01EUAS6.38.39.D06.1.454.CMB.1.raw
  modified_base (236)..(236): a, c, t, g, unknown or other
  misc_feature (236)..(236): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttaataaatatgtctcgttgtaccaanatcaaccaacactcaccaggacaaacgtccccaaactcaataatttatagagtacaaccgtaaaccggcctacgaggtacttttactaactccgtcttctcgtcggtcctaccgaagttctacggaccaaaccgaccggtccctcccgtacgaaccctatcctaccgtcgggtacctacccgaaaccgtggaacgggaccgtaggtaccttaccgtaactttaactttacgttacggacctacggtaccttactaaacttaacgtaacgaacgtcgaacgtccgtacgttaccggtttaggggttcgttaccggggacgggtaaccgggtacccgtaacccgttcggtacccgttacgttaaccgggtcaccggtacccgtaacgggcccttcccggcccccttacgggttaccctacccgttcccgttaccccggtttccccccgtcccgtttacccctaccgtaccggttcgtaccggttacccgg

SEQ ID NO: 257056 - DNA, 812 bp, Homo sapiens
  misc_feature: GYAE6OF01A6JC7.38.39.D06.1.454.CMB.1.raw
  modified_base (234)..(234): a, c, t, g, unknown or other
  misc_feature (234)..(234): n is a, c, g, or t
  modified_base (279)..(279): a, c, t, g, unknown or other
  misc_feature (279)..(279): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttaataatatgtctcttggtaccaanatcaccaacatcacccaggacaaacgtcccaaactcaataattangaggtacacgtaaacggcctagaggtacgtttactaatcgcttctctgtacctctaagtctcggacaacgaccggtccctccctagacccattccgtacgtcgggtacctacccaaccgtacggacgggtaaccgacgggtaccctacgtaacttaacgtttacttcggacctagtccttaactaaccgtaacttaaaccgaaagggtaccctaacgggtccggtttacccgttaacgggttttcgggggtttaccgggttaccggggtacccggggtaacccgggggtaaccccggttaacccggtttaccgggtaaccccggtttaccgggtttaacggggtaccctaaaccggggtacccccgtaaaaccggggtcccccgttacccgggtaccccccccggttaccgggtttaaccccgtaccccccgttttccggttaccccccgggttttacccccccccggtcccccgttaaccccgtttacccccgggtaacggtttcccgggtaaccccgtttaacccccgggg

SEQ ID NO: 257057 - DNA, 672 bp, Homo sapiens
  misc_feature: GYAE6OF01AQ2T1.38.39.D06.1.454.CMB.1.raw
  modified_base (235)..(235): a, c, t, g, unknown or other
  misc_feature (235)..(235): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatatgtctcttggtaccaacntacaccaacatccacccaggacaaacgtccccaaactcaattaattatgaggtacaaccgtaaacggccctacgaggtacgtttactaatcgtcttactcgtcggcctaccgtaacgttcgtacggacctaaaccgaccggtccctcccgtacgaccctacttccgtccgtcgggtacctacccgtaaaccgtggaacggaccggacggtacctacgtaacttattattcgacacgtctactaatactaacacgacacgtcgtcgtacgttgggtcggtcgggaccgggtacgggtacccgtaccgtcgtaccgttacgttacgtaccgaccgacccgtacggtcccgtcccggtcccccgttaggtacccgttacccttccgttacccgtttccccgtcccccgttacctaccggtaccgttcggtcgtacccggg

SEQ ID NO: 257058 - DNA, 650 bp, Homo sapiens
  misc_feature: GYAE6OF01CGX9M.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctggccagtctcgccctgactcagcctgcctccgtgtcgtgggtctcctggacagtcgatcaccatctcctgcacgtggaaccagcagtgacgttggtaggttaataaagtatgtcttcgttggtaaccaatatacaaccaaacatcacccaggacaaacgtccccaaaatcaataatttatgacggtacaacgtaaaacggccctacgaaggtactttactaatcgtcttctctcggtcctccaagtctggacaacacggcctccctacgaccactctcgtcgggcctaccgaaccgtggacggacgacggctactacttattaattcgactacgtacttacaattaacaacgaacgacacgtcgtacgtacgtttcggggtcggttacgggacgggtacgggaacccgtaccgtcggtaacccgttacggttacggttacgacgacccgtaacggccttccggtacccccgtcggtaccctccgttccgttcccgtttacccccgcccttacccgtaccgtaccgttgacgtacccgg

SEQ ID NO: 257059 - DNA, 823 bp, Homo sapiens
  misc_feature: GYAE6OF01C9LTC.38.39.D06.1.454.CMB.1.raw
  modified_base (194)..(194): a, c, t, g, unknown or other
  misc_feature (194)..(194): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctcgtgtctgggtctcctggacagtcgatcaccatctcctgcactcggaaaccngcagtgtacgttggtagttaataatatgtctcgttgtaccaacatccacaacactaccacccaaggacaaacgtaccccaaactctaattaattactagaacggtaccaacgtaaaccggccctagaggtacgtttactaatcgtacttctacgttcggcctaccgaaagtcctaggaccaaacgacccggtcccttaccctacggaacctaacgttccgtacggttaccggggacccttaaccccggtaaacgtacgggaaacggtaaccgggtaacgggtacccttacctaaaccgttttaaagttttacttacggggaccttaacggaccgtttaacctaaacgtttaaacttaaacccgaaacggttaccgaacggttaccggttttaacccggtaacggtttttaccggggggttacggtttaacccgggggaccgggggtaaacccggggttaaccccggtacccgttaccgggtaacccggtttaccgtttacgggaccgttaaaccggcccggtaaaccggtccgtaccccggtacccccgttacggttacctaacccgtttcccggttcccgttacccccgtccccctttacctacgtacccggtagtcccttaaccggg

SEQ ID NO: 257060 - DNA, 709 bp, Homo sapiens
  misc_feature: GYAE6OF01E50OJ.38.39.D06.1.454.CMB.1.raw
  modified_base (200)..(200): a, c, t, g, unknown or other
  misc_feature (200)..(200): n is a, c, g, or t
  modified_base (227)..(227): a, c, t, g, unknown or other
  misc_feature (227)..(227): n is a, c, g, or t
tcagtcgatcacgtcacgaccggtgctcgatttagtgacatctcgctagtttctttggggactttgcctgggctctgctgctcctcaccctcctcactcgagggcacgagggtcctgggccctagtcctcgccctgactcagcctgcctcgtgtcgtgggtctcgtggacagtcatcatcactctctgcgacgtacgacngtcgtagtgttagttagtattaatatntctctacgtacaacactacaccaacacacaccaccgaagaacctaacctaaccaatataattatacgacgtactaacgaaccgtaccgtctagttacgttacttactacgtccttacttcgacgtcgtactacgtacgtacgaccgaacccgtacgtcccgtacctaccgtactaccgtcgtaccggtcggtaccaacccgtaacgacgggacgtacgtacgtactacttaacttacgttactacgacgtaactactacttaaacgacgtaacgtaccgtacgtaccggttacggtttccggttacgggttcgggttaccgggccgggttaaccgggacggtcccgttacgtaccggtccgttacggtaccgtacgaccgttcccgtaccgtaccggtcccgttcccgtacccggttacccttcccgtttcccgtaccccgttcccccgtaccgttccgaaggttcccgtaggtcgtaccgg

SEQ ID NO: 257061 - DNA, 563 bp, Homo sapiens
  misc_feature: GYAE6OF01BMJ6B.38.39.D06.1.454.CMB.1.raw
  modified_base (193)..(193): a, c, t, g, unknown or other
  misc_feature (193)..(193): n is a, c, g, or t
  modified_base (340)..(340): a, c, t, g, unknown or other
  misc_feature (340)..(340): n is a, c, g, or t
  modified_base (398)..(398): a, c, t, g, unknown or other
  misc_feature (398)..(398): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttataaatatgtctcttggtaccaacatcaccaacatcacccaaggcaaacgtccccaaactcataatttatgaggtcaactaaacggccctcaggagtttctaatcgcttctctggctcaatctgcaacncggcctcctgaccatctctggctccaactgaggacgaggctcactattatgcagctanatatacagcagctctacgttgggtgttacggcggacgggaccgtaccgtcgtaccgttcgtacggtccacgtaccccgaaacggtcctaccggccccccgttcgggtaccctaccgtccgttaccgttcccccgtccccttccctaccgcgttcgacgtacccgg

SEQ ID NO: 257062 - DNA, 538 bp, Homo sapiens
  misc_feature: GYAE6OF01BXOUX.38.39.D06.1.454.CMB.1.raw
  modified_base (213)..(213): a, c, t, g, unknown or other
  misc_feature (213)..(213): n is a, c, g, or t
  modified_base (218)..(218): a, c, t, g, unknown or other
  misc_feature (218)..(218): n is a, c, g, or t
  modified_base (340)..(340): a, c, t, g, unknown or other
  misc_feature (340)..(340): n is a, c, g, or t
  modified_base (523)..(523): a, c, t, g, unknown or other
  misc_feature (523)..(523): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttanaaatntgtctcttggtaaccaacatcaccaacatcacccaggcaaagtccccaaatcataattatgaggtcactaaacggccttacaggtatttctaatcgtcttctctggctcaagtctggcaacncggcctccctgaccatctctgggcctccgaactgaggacgaggtctcacttatattgcagctacatatacaagcagtcgtctacgttgggtcgtcggcgggacggaccgtaccgtgtaccgtcgttacggtcgacgacccgaggcctcgccccgtggtccactcgtccgttcccacccttccnctacgtgtcgtaccg

SEQ ID NO: 257063 - DNA, 567 bp, Homo sapiens
  misc_feature: GYAE6OF01AUISW.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaacgtccccaaatcataattatgaggtcactaaacggcctacaggactttctaatcgcttctctggctccaagtctggcaacacggcctccctgaccatctctgggcctaccaactgaggacgaggctcactattattgacagctacatataacaagcagcgtacacgttgggtcgttccggcgggacgggaccgtacccgtcgtaccgttcgttacggtccacgcccgtaaggccgtaccggtcccccgtggtacctaccttccgtccgtttacccccaccccttccctacctacgtcgtcgttacccgg

SEQ ID NO: 257064 - DNA, 616 bp, Homo sapiens
  misc_feature: GYAE6OF01DS558.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtaggttaataaatatgtctcttggtaaccaacatacacaacatccaacccaggcaaacgtcccaaactcataattatgagtcaactaaacgcctgagagtttacaatcgacttctctggctaccaagtctggaccaacgacgcctcccgagacctatctcgtggcctaccaacgtgacggacgagactctaacttacttatcgcagctactaatactaacaagcagtccgtactacgtttgggtcgttcgggacgggtacgggaccgtaccctacggtaacccgttcgttacggctaaccggacccgtaaacggtcccgtcccggtccccccgttcgggtactacccgttccgtttcccggttccccccgtccccgttccctaccgtaccggttagtccgttaacccggg

SEQ ID NO: 257065 - DNA, 600 bp, Homo sapiens
  misc_feature: GYAE6OF01EJ7NQ.38.39.D06.1.454.CMB.1.raw
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (278)..(278): a, c, t, g, unknown or other
  misc_feature (278)..(278): n is a, c, g, or t
  modified_base (295)..(295): a, c, t, g, unknown or other
  misc_feature (295)..(295): n is a, c, g, or t
  modified_base (314)..(314): a, c, t, g, unknown or other
  misc_feature (314)..(314): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatntgtctcttggtaccaanatcaccaacntcaccaggcaaacgtcccaaactcataattangagtcactaacggcctnagtattctaatcgcttctntgctcaagtctcgcaacacgcctaccctgacctatccgtcgtcgggtcctaccgaaccgtggaacggacgacggtacctactaacttatttaacttcgactagctacgatatacaacgcagcgtactacgtttgggtgttcgggacgggtacgggaccgtaccgttcgtaccgttacgttacggtacgacgacccgaacggtccttaccggtccccccgttcggtccctaccgttccgttcccgttcccccgtccccttccctaccgtaccgtcgtacgtacccgg

SEQ ID NO: 257066 - DNA, 674 bp, Homo sapiens
  misc_feature: GYAE6OF01BD0FC.38.39.D06.1.454.CMB.1.raw
  modified_base (195)..(195): a, c, t, g, unknown or other
  misc_feature (195)..(195): n is a, c, g, or t
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
  modified_base (508)..(508): a, c, t, g, unknown or other
  misc_feature (508)..(508): n is a, c, g, or t
tcagtcgatcacgtcacgaccggtgctcgatttagtgacatctcgcaggttctttggggactttgcctgggctctgctgctcctcaccctcctcactcagggcacagggtccctgggccccagtctgccctgactcagcctgcctcgtgtctgggtctcctggacagtcgatcaccatctcctgcactggaaccngcagtgtacgttggtagttaataaatgtcgtctcgttaggaccaanctacaccaacntccaccaggactaaacgtcccaaatcaataattatcgagtactaacgtaaaccggcctagaggtactttactaatccgtccttcctcgtcggtctaccgtaagtccgttacggacctaaccgaccggtccctacccgtacgaaccctactccgtaccgtcgggtaccctacccgaaccgtggaacggtacgtacggtcctacgtaaccttattacgttcgacacgtactactataactacgagtacgtagacgttntacggttgggtcggtacggtcgggacggtacccgtaccgtcggtaccggttaccttagggtccaccggtacccgtaggtcccgtacccggtcccccgttagtcctcccgttcgtccccgttccccgtaccccgttcccgtacgacccggttcgtcccgttacccgg

SEQ ID NO: 257067 - DNA, 642 bp, Homo sapiens
  misc_feature: GYAE6OF01BNQPS.38.39.D06.1.454.CMB.1.raw
  modified_base (281)..(281): a, c, t, g, unknown or other
  misc_feature (281)..(281): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttggtaccaacatcaccaacatcacccaggacaaacgtccccaaatcataatttangagtcactaacggcctcgaggtatttctaatcgtcttctctgctacaagtctgaccacgacggccctcccgtacgacctatctcgtcgggtcctacctaaccgtgacggacgacggtctacaacttattagttcgacagtctacaattacacaagcgtacgtccgtactacggtttcgggttcggttaccgggacgggtaacgggaacccgtaccgtacggtacccgtttacgttacggtccaacggtacccgaacgggtcccttaccccggcccccgtttccgggacccttaccgttcccgttacccggtttaccccctaccccgtttcccgacccgttaccggtgtaccgttacccggg

SEQ ID NO: 257068 - DNA, 611 bp, Homo sapiens
  misc_feature: GYAE6OF01AFSZX.38.39.D06.1.454.CMB.1.raw
  modified_base (287)..(287): a, c, t, g, unknown or other
  misc_feature (287)..(287): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttggtaaccaacatccaccaacatccacccaggaccaaacgtccccaaactcattaatttangaggtacaactaaaccggccctcaggtagtttactaatcgtcttctctggctccaagtctggcaacgcggccctccctcgaccatcctcgtcgggcctaccaaccgtggacggacgacggactcacttattattcgctagctacaactataacgaagtcagtccgtcgtacgttggggtgttccgggcgggacgggacccgtacgtacggtaccgttacgttacggtacgaccgccgacggcctaccggtcccccttcgggtacctacccgttccgttcccggttcccccgccccttcccgtaccgtccgtgtacgttcccggg

SEQ ID NO: 257069 - DNA, 599 bp, Homo sapiens
  misc_feature: GYAE6OF01BGX3J.38.39.D06.1.454.CMB.1.raw
  modified_base (342)..(342): a, c, t, g, unknown or other
  misc_feature (342)..(342): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttaataaatatgtctcttggtaccaacatcaccaacatcacccaggcaaagtccccaaactcaataatttatgaggtacaactaaacggccctgaggtagtttctaatcgcttctctgctcaagtctggcaacncgcctccctgccatctcgtcggcctaccaaccgtgacgggacgacggtcctactaacgttactttaagttcgacacgtctacataataacaacgaccagtccgtacgtacgttagggtcggtccgggcggacgggacccgtaccgtcgaccgttcgtacggtcgacgtacccgaacgtccgtccgcccccgtcggtacctaccgttccgttcccggttccccgtcccccttacctccgacggttcgtaccgtaccgg

SEQ ID NO: 257070 - DNA, 538 bp, Homo sapiens
  misc_feature: GYAE6OF01BE5QF.38.39.D06.1.454.CMB.1.raw
  modified_base (410)..(410): a, c, t, g, unknown or other
  misc_feature (410)..(410): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcacatctcctgcactggaaccagcagtgacgttggtggttataaatatgtctcttggtaccaacatcaccaacatcacccaggcaaaagtccccaaaatccataatttaatgaggtcactaaaacggccctcaggagtttctaaatcgcttctctggctccaagtctggcaacacggcctccctgaccatctctgggctccaactgaggacgaggctcactattattgcagctcatatanaagcagcgtcaacttgggtgttcggcggaggaccgacctgaccgtacgttaggtcaggcccaaggccgtcgccccccgtggtccactccgtcgttaccccgtccccttcgtccaccgtgagtacccgg

SEQ ID NO: 257071 - DNA, 553 bp, Homo sapiens
  misc_feature: GYAE6OF01CSX31.38.39.D06.1.454.CMB.1.raw
  modified_base (236)..(236): a, c, t, g, unknown or other
  misc_feature (236)..(236): n is a, c, g, or t
  modified_base (275)..(275): a, c, t, g, unknown or other
  misc_feature (275)..(275): n is a, c, g, or t
  modified_base (293)..(293): a, c, t, g, unknown or other
  misc_feature (293)..(293): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttggtaccaantcacaacatcacccagcaaacgtcccaaatcataattangagtcactaaacggcctnaggtagttctaatcgtcttcttctggctcaagtctgacacacggcctccctcgaccatctctcgggctaccaactgaggacgagctcactattatgacagctacatataacaacgcacgcgtacacgttgggtcggttcgggacgggacgggaccgacgtcgccggttacttcggtactacgcccgtaaggccgtaccgcccccgtggtacctcccttccgttccgttccccgtccctcctaccgacgtgtacctaccgg

SEQ ID NO: 257072 - DNA, 567 bp, Homo sapiens
  misc_feature: GYAE6OF01A3Q0Y.38.39.D06.1.454.CMB.1.raw
  modified_base (217)..(217): a, c, t, g, unknown or other
  misc_feature (217)..(217): n is a, c, g, or t
  modified_base (233)..(233): a, c, t, g, unknown or other
  misc_feature (233)..(233): n is a, c, g, or t
  modified_base (520)..(520): a, c, t, g, unknown or other
  misc_feature (520)..(520): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatntgtctcttggaccaanatcacaacatcaccaggcaaagtccccaaatcataatttatgaggtcactaaacggccctcaggggtttctaatcgcttctctggctcaagtctggcaacacggcctcctgaccatctctggctccaggctgaggacgaggctgattattactgacagtctacgttataagaagtaagtagaccacgttacgttgggtcgtttcgggacgggtaacgggacccgaaaggtccgtacgacccggtacctaacggtccacgaccccaaaggctccgcccccgtgtaccnccgttcctcggttaccccctacccctcctaccaccgtgcgttaccgg

SEQ ID NO: 257073 - DNA, 558 bp, Homo sapiens
  misc_feature: GYAE6OF01A7YKN.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaacggccctacaggagtttctaatcgcttctctggctccaagtctggcaacacggcctccctgaccatctctgggctccaactgaggacgaggctcactattattgcagctacatactaacaagcagcgtcacgtttgggtcggttcgggcgggacgggacccgaccgttgacccgttcgttacggtcacgacccgaggcctcggcccccgttggtcctaccttccgttccgttccccctaccctccctaccgaccgttgcgtacccgg

SEQ ID NO: 257074 - DNA, 739 bp, Homo sapiens
  misc_feature: GYAE6OF01DEZRN.38.39.D06.1.454.CMB.1.raw
  modified_base (278)..(278): a, c, t, g, unknown or other
  misc_feature (278)..(278): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgtacgttggtggttaataaatatgtctcttgtaccaacatacaccaacatccaccagacaaatccccaaatcataattangagtcacgtaaaccggcctacgaggtacgtttactaatcgtcttctctcggcctaccaagttctggaccaaccgaccggcccttcccgtagaccctattcccgtcgtacggggtcccttacccaaaccgttggaacgggacggtacggtaccttaccgtaactttaagtttattcggaccgtacgtccttaacgaacttaactaacgaaacgccgtaaggttcccgttaacgttaccgggttttacgggggtttcgggtttaccggggaccgggggtaacggggtaccccgtaccggttaccggtaacccggtttacgtttacgggtaccgaccggtaccccgaaaccgggttcccgtccccgggtaccccccgttacgggttacccttacccgttcccgtttacccggttcccccccgtcccctttaccccgttccgaaccggttcgtaccgttaccggg

SEQ ID NO: 257075 - DNA, 609 bp, Homo sapiens
  misc_feature: GYAE6OF01BPFRH.38.39.D06.1.454.CMB.1.raw
  modified_base (282)..(282): a, c, t, g, unknown or other
  misc_feature (282)..(282): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttggtaccaacatcaccaacatccacccaggacaaacgtccccaaactcataattangaggtcaactaaaccggcctacaggtagtttctaatcgtcttctctggctacctaagtctaggaccaacgaccggtccctcccgtacgacctactcctacgtcgggacctaccaaccgttaggacggacgacggtccttactaacttattaattcgactagctacataactacaagcgacgtcgtactagttgggtgttcgggcggacggtacccgtacgtacgaccgttcgtacgtacgacgaccgacggtcctcccggcccccgtgtacccgtacgttccgtccgttacccccgcccttaccctacgtaccgtcgtagtacccgg

SEQ ID NO: 257076 - DNA, 706 bp, Homo sapiens
  misc_feature: GYAE6OF01CXDGD.38.39.D06.1.454.CMB.1.raw
  modified_base (292)..(292): a, c, t, g, unknown or other
  misc_feature (292)..(292): n is a, c, g, or t
  modified_base (361)..(361): a, c, t, g, unknown or other
  misc_feature (361)..(361): n is a, c, g, or t
  modified_base (383)..(383): a, c, t, g, unknown or other
  misc_feature (383)..(383): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctcgtgtctgggtctcctggacagtcgatcaccatctcctgcactggaaccagcagtgacgttggtagttaataaatatgtctcgttaggtaaccaacatccaaccaacataccacccaggaccaaacgtaccccaaactctaattaattangtagtacaacctaaacggcctacgaggtatttactaatcgtcttctctcgctacaagtctggaccaacnccgtcctccctgaccatccgtntcggacctccgaacgtgaacggacgacgtcctactaacgttattacgttcgacgtacgtctacgaacttactaacgtaagtccgaacgtccgtacgttaacggtttcggggttacgggttccgggacggggtaccgggtaaccccgtaccgttacggtacccggtttacgttaacgggttacccgaacggtaccccggtaaacgggtcccgttcccgggtccccccgttaccgggtacccttacccggtttcccgttaccccgtttacccccgtaaccccccttccggtacccgttacccgggttacgtccgttaaccccggg

SEQ ID NO: 257077 - DNA, 678 bp, Homo sapiens
  misc_feature: GYAE6OF01DF03H.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttaataaatatgttctcgttaggtaccaacatacaaccaacataccaacccaaggaccaaaacgtcccccaaaacttcaaatttaaatttataggacggtacctaacgtaaaaccggccctacgaggtagtttactaaatccgtacttctcgtcggcctaccaagtctggacaaccgcggcctaccctagacctatctcgtcggcctaccaaccgtgacggacgacgctacacttattatgactcgactacactatacaacgcacgtccgtacgtacgttcgggttcggttaccgggaccgggaaccgggtacccgtaccgtacggtaacccgttcgttacgggtaccgaaccggtacccgaaaccggtccgtacccggtcccccgttcgggttaccctaccgttcccgttaccccggttcccccgtcccccttacccgttccgtaaccggttccgtacgttacccggg

SEQ ID NO: 257078 - DNA, 855 bp, Homo sapiens
  misc_feature: GYAE6OF01DNS14.38.39.D06.1.454.CMB.1.raw
  modified_base (233)..(233): a, c, t, g, unknown or other
  misc_feature (233)..(233): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaacagcagtgtacgttgtagttaataaatatgtctctgtacaacntacaccaactactcgaaccaggaccaaaacgtacccctaaatacaattaactttagtagaacgtacctaaccgtaaaccggtccctacgtaggtagttttacctaatccgtcttcgtcgttcgtaccttaccgtaacgtaccgttacggaacctaaacccgaccggtcccctacccgtacgtaccctacgttaccgtccgttcggggacccctttacccggaaacccgttgggaaccgggtaaccggtaacgggtaccctttaccgtaaaccgtttaagttttaccgtttacggtaccgtaaccgttacccttaagttaaaccgttacgtaaaacccggtaaacgtaccgtaaccggtacccggttaacggtttaacggttttcgggggttaaccggtttccggggaaccgggtaacccgggtacccgggttaccggtacccggttaccggttaaccggttacgggaaccgttaccggaacccgggtttaaacccgggccccgttaccccggtacccccgtttccggaaccccgttcccgtttacccgttaccccgttccccccctttaaaccccgttccccgttaacccgttaaccggtcccgtaaccgtttaccccgggg

SEQ ID NO: 257079 - DNA, 437 bp, Homo sapiens
  misc_feature: GYAE6OF01BPL6D.38.39.D06.1.454.CMB.1.raw
  modified_base (419)..(420): a, c, t, g, unknown or other
  misc_feature (419)..(420): n is a, c, g, or t
  modified_base (422)..(437): a, c, t, g, unknown or other
  misc_feature (422)..(437): n is a, c, g, or t
tcagtcgatcacgtcacgaccggtgctcgatttagtgacatctcgcagttctttggggactttgcctgggtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaacctgaggacgaggctcactattattgcagctcatatacaagcagcgtcacttgggtgttcggcggaggggaccgacctgaccgtcttaggtcagcccaaggctgccccctcggtcactctgttccccaccctcctccacgtgactcgactgagcgggctggcaagggcgcagtagcnncnnnnnnnnnnnnnnnn

SEQ ID NO: 257080 - DNA, 653 bp, Homo sapiens
  misc_feature: GYAE6OF01EWD5F.38.39.D06.1.454.CMB.1.raw
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
  modified_base (271)..(271): a, c, t, g, unknown or other
  misc_feature (271)..(271): n is a, c, g, or t
tcagtcgatcacgtcacgaccggtgctcgatttagtgacatctcgcagttctttggggactttgcctgggctctgctgctcctcaccctcctcactcaggcacagggtcctgggcccagtctgccctgactcagcctgcctccgtgtcgtgggtctccgtggacagtcgatcaccatctcctgcacgtcggaaccagcaggtgacgttggtagttaataatatntctctgtacanancacanancaccagacaacncccaatnataattangagtacaacgtaacgcctacgaggtagttactatcgtcttacgtctcggactcgtagtcgtcgaccaaccgaccggtccctaccctacgaccctacttccgttcggtcggtaccctacccgtaacggtaggaacggaccggtacgtacctaccgttaacttacgtttagtacacgtacgtactactaacttaagtaaccaacgccgtacgtccgtacgttacggttgggtcggtacgggacgggaccggacccgtacgttacggtacccgttaggtaccggtacaccggacccgtaggtccccttccggtccccgttgtacccttcccgtccgttaccccgttaccctcccgttaccttaccgtaccgtgtacccgtacggg

SEQ ID NO: 257081 - DNA, 566 bp, Homo sapiens
  misc_feature: GYAE6OF01C4JTO.38.39.D06.1.454.CMB.1.raw
  modified_base (349)..(349): a, c, t, g, unknown or other
  misc_feature (349)..(349): n is a, c, g, or t
  modified_base (422)..(422): a, c, t, g, unknown or other
  misc_feature (422)..(422): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttggtaccaacatcaccaacatcacccaggcaaacgtccccaaactcaataatttactgaggtcaactaaacggccctacgaggtagtttctaatccgctttctctggctcaagtctggcaacncggcctcctcgacctatctcgtcgggcctaccaaccgtgacggacgaggctctacttattatcgacagtctanataatacaagcagccgtcacgttgggttcgtacggacggacgggtaccgacgtcggaccttcgttacggcgacgacccgaggtcctcgccctacgttcggtaccaccttcgtcccgttccccgacccttcctacgcgtgtaccg

SEQ ID NO: 257082 - DNA, 798 bp, Homo sapiens
  misc_feature: GYAE6OF01CXG7D.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctcgccctgactcacgcctcgtcctccggtgtcgtcgggtcctccgtaggacacgtcgactccacctctccgtccgtcgtacgtacgtaggaacgtcggtagttacgtagtacgttaggttaggttaacttaacttacgttcgttaccgtaccgtaccgtaaccgaaacccgaacccaaccggaccgaaccgaaccctaaacccctacctaaacttctaacgttaacgttagttacccgaccgtacctaacccgtcgttccggtccccggtttacccgtacgggtttaccgtttctcccgttcgtaccttccggtcggttcgacttaaccgttacggtacgacccaccggttacctccgtaccgtacgtatttccggaggccgtcgacggacgtacgtacggacgtagtacgtttatagttacctcgttactccgttaacgtacacgttaacgacgtaccgtaccgtactacgtacccgttacgttaaccggttcgtaccggtaccgtacggtacccgtacgtacccgtaccggtaccctaccgtaccccgtaccgaacccgaccgtaacccgccccgtaactacccggtcctcccgtttcccgtaccgtacccgttcccgtcccgtacggccgtaccgtaacggtcggcgtaaccggttcgaacgggtccggtacg

SEQ ID NO: 257083 - DNA, 445 bp, Homo sapiens
  misc_feature: GYAE6OF01CD4TW.38.39.D06.1.454.CMB.1.raw
  modified_base (430)..(445): a, c, t, g, unknown or other
  misc_feature (430)..(445): n is a, c, g, or t
tcagtcgatcacgtcacgaccggtgctcgatttagtgacatctcgcagttctttggggactttgcctgggtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaacctgaggacgaggctcactattattgcagctcatatacaagcagcgtcacgttggggtgtttcgggcgggagggacccgaccgtggaccgttcgttaggtcacgcccgaaggctcgccccctcggtcactctcgttcccaccctcctcacgtgactcgactcgaggcggctggctaaggcgacagtgnnnnnnnnnnnnnnnn

SEQ ID NO: 257084 - DNA, 613 bp, Homo sapiens
  misc_feature: GYAE6OF01EB0B4.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaatcataattatgaggtcactaaacggccctcaggagtttctaatcgctttctctggctccaagtctggcaacacggcctccctgaccatctctgggctaccaaccgtgacggacgaggctacacttattattcgcagctacgatactactaagcagcgtcacttgggtgttccgggcgggacgggacccgtaccgttggaacccgttcgttacggttaccgacggtacccgtaaacgggccttccggacccccccgtttcggggttcctaacccgttacccgttcccggtttaccccccggtcccccttacccgttaccctaacccggttcgtacgttaaccccggg

SEQ ID NO: 257085 - DNA, 537 bp, Homo sapiens
  misc_feature: GYAE6OF01BDKE3.38.39.D06.1.454.CMB.1.raw
  modified_base (496)..(496): a, c, t, g, unknown or other
  misc_feature (496)..(496): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgagtcactaaacggcctcaggtagtttctaatcgtcttctctggctcaagtctggcaacacggcctccctgaccatctcgtggctccaacctgaggacgagctcactattattgcagctacatatacaagcaagtcgtcacttgggtgttcgggacggacggaccgtaccgtgaccgtcgttaggtacacgacccaaggcctcgcccccgttgaccncctcctcgttccccctaccctccctaccgacgtgactacgg

SEQ ID NO: 257086 - DNA, 701 bp, Homo sapiens
  misc_feature: GYAE6OF01B1ODX.38.39.D06.1.454.CMB.1.raw
tcagtcgatcacgtcacgaccggtgctcgatttagtgacatctcgcagttctttggggactttgcctggctctgctgctcctcaccctcctcactcaggcacagggtcctggcccagtctgccctgactcagcctgcctccgtgtctgggtctcctggacagtcgatcaccatctcctgcactggaaccagcagtgacgttggtgttaataaatatgtctcttaggtaaccaacatacaccaacataccaacccgaaggacaaaacgtacccctaaaactacctaattaaactttagtgaacggttacaaccgtaaaaccggtccctacgtaggtacgtttactaatccgtacttctcgtcggcttaccgtaagtcgtacggacctaaacgcccggtacctacccgtacgaacctactcgtccgtacgggtaccctaccgtaaaccgtggtaacgggacgaccggtactaccctaattattacgtcggataccgcttacaattactaacgaagaccgtagttaccgtagtaccgtttggggttaccgttaccggggaagggtaccgggaacccgtaccgttaccggttacggttaccgttaacgggtaccaccgtacccgaaccggtccgtaccccggtcccgtccgtacctacccgtcgtttaccccgtccccgtacctcccacggtcctgtcccgtacg

SEQ ID NO: 257087 - DNA, 603 bp, Homo sapiens
  misc_feature: GYAE6OF01DBAAF.38.39.D06.1.454.CMB.1.raw
  modified_base (193)..(193): a, c, t, g, unknown or other
  misc_feature (193)..(193): n is a, c, g, or t
  modified_base (285)..(285): a, c, t, g, unknown or other
  misc_feature (285)..(285): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttaataaatatgtctcttggtaccaacatcaccaacatccacccaggcaaaacgtccccaaactcaattaatttangaggtcaactaaacggccctgaggtattctaatcgcttctctgctccaagtctgcacacggcctccctcgaccatctcgtcggctaccgaacctgtaggacgaggctaccattaactttattcgactcgacttacaacttaataaccgaacgactacgtcgttccgtacgtttaggggttgttaccgggcggggaacgggtaccgaccgttcggaccgttcggtaggtaccaccggacccacggtcctccggcccccgttcggtactcccgtcccgttcgttacccccgtccctaccctcgtaaccggtgtcgtaccg

SEQ ID NO: 257088 - DNA, 689 bp, Homo sapiens
  misc_feature: GYAE6OF01B821P.38.39.D06.1.454.CMB.1.raw
  modified_base (238)..(238): a, c, t, g, unknown or other
  misc_feature (238)..(238): n is a, c, g, or t
  modified_base (285)..(285): a, c, t, g, unknown or other
  misc_feature (285)..(285): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgtacgttggtggttaataaatatgtctcttcggtaccaanatacaccaacatcacccaggaccaaagtccccaaatcaataatttangaggtcaactaaacggccctacgagtagtttctaatccgtacttctctgggcttaccaagtctggaccaaacgaccgccctccctacgaccaattcctcgtcgggccttacccgaaccgtaggaacggaacgacggtcctactaacctttaattaactttgacctagtactacaataataacaaagcacgtccgttacgaacggtttcgggtacggtttaccgggcgggaacgggaccgtaacccgtacgtaccgtaccggttacggttaccgacggtaaccccgaacgtacccggttcccgtacccccccggttagggttacccctaacgttcccttaccccggtttccccccgtaccccctttcccgtaacccgtaccggtttacggtaaccgttacccggg

SEQ ID NO: 257089 - DNA, 712 bp, Homo sapiens
  misc_feature: GYAE6OF01DIJA2.38.39.D06.1.454.CMB.1.raw
  modified_base (166)..(166): a, c, t, g, unknown or other
  misc_feature (166)..(166): n is a, c, g, or t
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (253)..(253): a, c, t, g, unknown or other
  misc_feature (253)..(253): n is a, c, g, or t
  modified_base (288)..(288): a, c, t, g, unknown or other
  misc_feature (288)..(288): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtcctccgtggacngtcgatcaccatctcctgcacgtcggaaccagcaggtgacgttggtagttaataaatntgttctcgttggaaccaanatcaacaacntccaccaggacaaacgtcccaaattcaattaattngaggtcaacgtaacggccctagaggtactttactaagtcgtacttctctacggcttaccaagttctggtaccaaccgtaccggtcccttcccgtagaaccctattccgtcggtcgggcccttacccgaaccgtggaacggacggtacggcttaccgacttaagtttacttcgaccgtaagtaccttacgtaataacgttaacgaacgacgtacgtcgttacgttacggtttcgggttacgggttccggacgggtaccgggtaaccccggttacgtacccggtaccgtttacggttacggtccgaacggtccccgtaaaacgggtccttaccccggtcccccggttacggtacccgttcccttaccggttcccgtttaccccccaacccgtttcctacccggtaacgttcgtaacccgttaccgg

SEQ ID NO: 257090 - DNA, 732 bp, Homo sapiens
  misc_feature: GYAE6OF01CYMPM.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtcgtgggtcctcctggacagtcgatcaccatcctctgcactcggaaccagcagtgacgttggtagttaataatattcgtcttcttacggtaaccaacactaccaacctaacacgtaccacccgaacggaccaaacgtaccccaaactacaattaactttagtagacgtaccaaacgtaaaccggccctacgtacggtacgtttactaacgtccgtctttcgtctcggcttaccgaacgtccgtgggaaccaacgaccggtaccccttcccgacgtaaccctacttcccgtcgtaccgggtcctacccgtaaccgtaggaacggacggtacggtacctaccgtaactttaacgtttaagtccgacgtaactcctaactagtaactaaccgaacgtcgagtaccgtacgtagggtttcgggttcggtacgggaccgggacgggtacctccggtacggtaccgttacggtagaccgaccgacccggtaacggtcccgtacccgtccccgttcggtacctcccgttccccgtttacccgttcccccttaacccccggttctacccggttacgcccggtcgtaacccggg

SEQ ID NO: 257091 - DNA, 649 bp, Homo sapiens
  misc_feature: GYAE6OF01EUAOB.38.39.D06.1.454.CMB.1.raw
tcagtcgatcacgtcacgaccggtgctcgatttagtgacatctcgcagttctttggggactttgcctgggctctgctgctcctcaccctcctcactcagggcacaggtcctgggcccagtctgccctgactcagcctgcctccgtgtctgggtctcctggacagtcgatcaccatctcctgcactggaaccagcagtgacgttggtgttaataaatatgtctcttggtaccaacatcaaccaacactccaacccaggacaaaacgtccccaaactctaataatttatagacggtaccaactaaaccggcctacgaggtacgtttactaatccgtacttctctcggcttaccgaagtctacggaccaaaccgaccggtccctacccgtgaccctactctcgtcggccctacctaaccgtggaacggacgacggctacacttattactgcagctactaagtataacgaagtcgagcctcgtacgttgggtcgttcgggacgggtacggtaccgtaccgtcgtacccgttacgttacggccgtaacggaccccgtaaggtcccgttccggccccccgtttacggaccctaccgttcccgttcccggttacccccgtccccttaccgtacgtacccggttgacgttacccggg

SEQ ID NO: 257092 - DNA, 562 bp, Homo sapiens
  misc_feature: GYAE6OF01A1N43.38.39.D06.1.454.CMB.1.raw
  modified_base (279)..(279): a, c, t, g, unknown or other
  misc_feature (279)..(279): n is a, c, g, or t
  modified_base (344)..(344): a, c, t, g, unknown or other
  misc_feature (344)..(344): n is a, c, g, or t
  modified_base (548)..(548): a, c, t, g, unknown or other
  misc_feature (548)..(548): n is a, c, g, or t
tcagtcgatcacgtcacgaccggtgctcgatttagtgacatctcgcagttctttggggactttgcctgggctctgctgctcctcaccctcctcactcaggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaacgtccccaaactcataatttangaggtcactaacggcctcagagtttcaatcgcttctctggctcaagtctggcaacacgcctcccngaccatctctgggcctccaaccgtgacggacgaggcctcacttattaactgcagctcaattactacaagccaagcgtactacgttgggttcgttcgggcggacgggaccgtacctcggaccgttcttaccggctacggcccgaaaggtcctccgtcccccgtcggtacctacctcccgtcggttccccgtccccttccctaccnccgtgaccgtccgg

SEQ ID NO: 257093 - DNA, 576 bp, Homo sapiens
  misc_feature: GYAE6OF01BXR73.38.39.D06.1.454.CMB.1.raw
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
  modified_base (382)..(382): a, c, t, g, unknown or other
  misc_feature (382)..(382): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttggtaccaacatcacaacatcacccagcaaacgtccccaaactcaataatttatgaggtcactaaacggccctcaggtagtttctaatcgtcttctctggctcagtctgcacacgcctccngacatctcnggctccacngagacgagctcactatnttgcagctcatactacaagcagcgtcacgtttgggtcggttcggcgggacgggtaccgaccgtacggacccgttcgttacgggtccaacggccccgaacgggtccctcccggtccccccgttcggtaccctaccgttcccgtcccgttacccccctaccccttcccgtaccgacccgttgtaccgttacccggg

SEQ ID NO: 257094 - DNA, 734 bp, Homo sapiens
  misc_feature: GYAE6OF01CQG58.38.39.D06.1.454.CMB.1.raw
  modified_base (235)..(235): a, c, t, g, unknown or other
  misc_feature (235)..(235): n is a, c, g, or t
  modified_base (301)..(301): a, c, t, g, unknown or other
  misc_feature (301)..(301): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctcgtgtctgggtctcctggacagtcgatcaccatctctgcactggaaccagcagtgacgttggtaggttaataaatatgtctcttagtaccaanatcacaacatcacccaggacaaacgtaccccaaatccaattaattatgagtacaactaacgcctanaggtatttctaatcgtcttcttctgctacaagtctaggaccaacgaccggtccctccctacgacctattcgtaccgttcgggcctacccgaacgtcggaacgggtaacggacggtaccttacgtaactttaactttagttcggacctacgtacttaacctaattaaccgtaaacgaaccgtacgtaacggttcccgttaccgttaaccgggttttcgggggttagggttttaccgggaccggggtaaccgggtaacccgtaccgttaccggttaacccggttacgttaccggtaccggacccgtacccggtaaacggtcccgtacccggtccccccggttacggttaccctacccggtttacccgttaccccggttccccccgtaccccgtttacccgttacccggtaacccgtttcggaccgttaacccggg

SEQ ID NO: 257095 - DNA, 584 bp, Homo sapiens
  misc_feature: GYAE6OF01A1EII.38.39.D06.1.454.CMB.1.raw
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
  modified_base (239)..(239): a, c, t, g, unknown or other
  misc_feature (239)..(239): n is a, c, g, or t
  modified_base (269)..(269): a, c, t, g, unknown or other
  misc_feature (269)..(269): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatntgtctctgtaccanatcacaanatcaccagcaacgtcccaaatcataattangagtacactaaccggcctgaggtagtttctaatcgtcttctctggctccaagtctggacaacgccgcctcctacgacctatctcgtggcctccaacgtgaggacgagtctactacttattatgctagctactaatacaacgaagcagtcgtctacggttgggtacggttccgggacgggacgggaccgtaccgtacggtaccgttcgttacggtaccacggcccgaacggtccgtcccggtcccccgttcggtacctcccgttccgttcccgttacccccgtacccttcccgtaccgtcggtacgtcgtacccgg

SEQ ID NO: 257096 - DNA, 761 bp, Homo sapiens
  misc_feature: GYAE6OF01C5CS5.38.39.D06.1.454.CMB.1.raw
  modified_base (235)..(235): a, c, t, g, unknown or other
  misc_feature (235)..(235): n is a, c, g, or t
tcagtcgatcacgtcacgaccggtgctcgatttagtgacatctcgcagttctttggggactttgcctgggctctgctgctcctcaccctcctcactcagggcacgagggtcctgggcccagtctcgccctgactcagcctgcctccgtgtcgtgggtcctccgtggacagtcgatccaccatcctcctgcacgtacggaaccagcaagtcgtacggttggtagttaaactaaatntcgtactcgttacgaaccactactaccaaacacactccaacccgaaggaccaaaccgtacccaaactactaattaatttagtcggaacgtaccaaacctaaaccggtcctacgtaaggtactttactaactcgtaccttctccgtgtctacgtaagtcgtacggaccaaccgccgtaccctcgtacaacctctccgtacgtcgggtacctaacccgaacgtacggaacggaccgtacgtccctaactaacttactttacgtacacgtactaccttataactaacgtaaacgtacgacacgtaaccggttacgtttagggttacggggtaccggttccggggaaccgggtaaccgggaccccgttacgtaccggtaccggtttacggtacggtacccgtaaccggtcccggtaaacccgtccgtaccccccgggtcccccggtaacgtacccccttacgttccccgtttcccccgttaaaccccccgtcccttaccccgaacggtaccctaggtcccctaaccgggg

SEQ ID NO: 257097 - DNA, 680 bp, Homo sapiens
  misc_feature: GYAE6OF01EUKFC.38.39.D06.1.454.CMB.1.raw
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctcgtgtctgggtctccgtggacagtcgatcaccatcctcctgcacgtcggaaccagcagtgacgttggtagttaataaatntgtctctgtaccanatcacacntccaccagacaacgtcccaaatcaataattatgagtacaacgtaaccgcctagaggtacgtttactaactcgtacttctcgtcggctaccgtaagtcgtacggactaaccgaccggtccctccgtacgacctactcctcgtcgggtacctacccgaacgtggaacggacgtacggtcctactaaccttaatttacgttcgactacgtctactaattaactaacgtaagaccgagttccgacgtttacggttgggttcggtttaccggaccggggtaaccggtacccgtaccgttacggtaccgtttacgtacgggtacctaacggaccccgtagggtaccccttcccgggtacccccgttacggtacccgtaccgttcccgttccccgttcccccgtaccccttcccgttaccgtaccggttcgtcccgtaacggg

SEQ ID NO: 257098 - DNA, 728 bp, Homo sapiens
  misc_feature: GYAE6OF01C3NJT.38.39.D06.1.454.CMB.1.raw
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (239)..(239): a, c, t, g, unknown or other
  misc_feature (239)..(239): n is a, c, g, or t
  modified_base (275)..(275): a, c, t, g, unknown or other
  misc_feature (275)..(275): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctctgcacgtggaaccagcagtgtacgttggtagttaataatatgtctntgacanatacacantacaccagacaacgtaccccaactacaattaattanagagtacaacgtaaccggcctagaggtacgtttactaacgttcgtcttctcgttcggacctaccgtaagttccgtacggaccaaccgtacccggtcccctacccgtacgaccctacgttcctcggtacgggcccttaccaaccgtgggaacggacggacggtacctactaacgtttaatttactacggtactacggtaccttaacctaattaactaaaccgaacgtaccgacggtaccgtttcgtacggtttcggggttacggttacccgggacggggtaaccgggtaccccgtaaccggtcggtaccccgtttacggttacggtaccgtaacccggacccgacgggtcccgtccccggtcccccgttagggttaccctacccgtttcccgttaccccgtttcccccgtacccccgttacccgttccgtaaccggtcgtacccggtaacccgg

SEQ ID NO: 257099 - DNA, 582 bp, Homo sapiens
  misc_feature: GYAE6OF01CX7RP.38.39.D06.1.454.CMB.1.raw
tcagtcgatcacgtcacgaccggtgctcgatttagtgacatctcgcagttctttgggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttggtaccaacatcacaacatcacccaggcaacgtcccaaactcaataatttatgagtcaactaacggcctcaggtagtttctaatccgtcttctctcggtctaccaagtctggacacgaccgccctcctcgaccatctcgtcgggcctaccgaacctggacggacgacggctactactaatttatcgcagtctactatatacaagcacgtcgtacacgttgggttcggttcgggacggtacgggacccgtaccgtcggtaccgtcgttagacgaccgaccgaacggtcctccggtccccctcgggtacctccttcgttcccgttccccgtcccctcctcctacgtgtcgtaccgg

SEQ ID NO: 257100 - DNA, 787 bp, Homo sapiens
  misc_feature: GYAE6OF01CENLF.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtaggttaataaatatgtctcttggtaccaacatccaccaacatcacccaggaccaaacgtccccaaactctaataatttatgacggtaccaactaaaccggccctacgaggtacttttactaactcgtctttctcgtcggtctccaagttctcgggaccaaccgaccggtccctacccgtcgaaccctacttccgtcgttcggggtaccctacccgtaaacccgttgggaacgggaaccggtacgggtccttaccgtaacctttaagtttaactttcggaccgtaacggtccttactaactttaactaaccgaaacggccgtaacggtccgttacctaacgggttttggggtttacgggtttccggggacggggtaaccggggaccccgttacccgtacgggttaccccgtttacggtttaccgggtaccgaaccggtacccccgtaaacgggtcccgttaccccgggtcccccccgtttaccgggttaccctcccggtttaccccgtttccccggttttcccccccggtcccccctttaccccgttccgtaaccccggtttcggaacccgtttacccggg

SEQ ID NO: 257101 - DNA, 576 bp, Homo sapiens
  misc_feature: GYAE6OF01ALGTN.38.39.D06.1.454.CMB.1.raw
  modified_base (277)..(277): a, c, t, g, unknown or other
  misc_feature (277)..(277): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaatcataattangaggtcactaaacggcctcaggagtttctaatcgcttctctggctccaagtctggcaacacggcctccctgaccatctctgggctccaacctgacggacgaggctacactattattgcagctacatactacaagcagcgtctacgttgggtagttcggacggacgggaccgtacctaggaccgttcgttacggtcgacgacccaaacggccttacggcccccgttcgggtaccctaccgttccgttccggttacccccgtccccttaccccgttaccgaccgttcggtcgttacccggg

SEQ ID NO: 257102 - DNA, 690 bp, Homo sapiens
  misc_feature: GYAE6OF01BF2RN.38.39.D06.1.454.CMB.1.raw
  modified_base (292)..(292): a, c, t, g, unknown or other
  misc_feature (292)..(292): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttaataaatatgtctcttaggtaccaacataccaaccaacactccacccgaggaccaaacgtaccccaaatcaattaattagngacggtacaacgtaaacggcctacgaggtactttcaatcgtacttctctggcctacgaacgttcgtaggaccaaaccgccggtcccctaccgtacgaaccctacgttccttccggtacgggaccttaccccgaaaccgttacgggaacgggaccggtaacggtccttaacgtaacctttaacgtttaacttcggacctacggtaccttacgaaattaactaacgaacgtaccgtacggtccgttacgtaacggtttcgggtacggttaccgggacgggtaccgggaacccgtccgtacgtaccgttacgtaggtccacgaccgtaacgccgttacccgccccgtagtacctacgttcccgtaccgttccccacccttccacgtcgtgtaaccgtccgg

SEQ ID NO: 257103 - DNA, 649 bp, Homo sapiens
  misc_feature: GYAE6OF01E4IB2.38.39.D06.1.454.CMB.1.raw
  modified_base (218)..(218): a, c, t, g, unknown or other
  misc_feature (218)..(218): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctggtctcctggacagtcgatcaccatctcctgcactggaaccagcagtgacgttggtagttaataaatntgtctcttaggtaccaacatcaaccaacactcacccaggcaaacgtccccaaactcataatttatgaggtcaactaaacggccctacaggtagtttctaatcgtcttctctcggtctaccaagtctggacaaaccgaccggccctcccgtacgaccaactctcgtgggcctaccaaccgtggaggacgacggtctacgtaacttattattgcacgtctactaatactaacaagcacgcgtcgtacgttgggttcgttcggggacggtaacggggaccctaccgttacgacccgttacgttacggttaccgacggtacccgaaacggtccctacccggtccccccgttacgggtaccctcccgtttccgttccccggtttaccccccggtcccctttccccgtacggtacccggttcgtaacgttacccggg

SEQ ID NO: 257104 - DNA, 779 bp, Homo sapiens
  misc_feature: GYAE6OF01D8JXQ.38.39.D06.1.454.CMB.1.raw
  modified_base (223)..(223): a, c, t, g, unknown or other
  misc_feature (223)..(223): n is a, c, g, or t
  modified_base (240)..(240): a, c, t, g, unknown or other
  misc_feature (240)..(240): n is a, c, g, or t
tcagtcgatcacgtcacgaccggtgctcgatttagtgacatctcgcagttctttggggactttgcctgggctctgctgctcctcaccctcctcactcaggcacagggtcctgggcccagtctgccctgactcagcctgcctccgtgtcgtgggtctcctggacagtcgatccaccatctcctgcacgtggaaccagcagtgtacgttggtaggttaataaatntgtctcttaggaccaanatccaaccaacactaccacccgaggacaaacgtaccccaaaactcaataatttagagtaggtacctaaaccgtaaaccggccctagtaggtacgtttactaacgtccgtacttcttcgtcggtacctaccgaaagttcgtaccgggacctaaaccgacccggtccctaccccgtacgaaccctacgttccgtaccgtcgggtaccctacccgaaccgtcggaacgggacgacggtacctacttaacttatttacgttcgaccgtacgtccttactaaacgttaactaaaccgaacgtccgtaacggtaccgttaccgtacgggttttacggggttcggttaccggggtaccggggtaccgggaaccccgtaccggttaccggtacccgtttacgggttacggtaccgacccggacccggtaacggtccccgttcccggtaccccccggtttggtaaccccttccgttccccgttaccccggttccccccccgttccccttacccgtacccggttaacccggttggtaccgttacccggg

SEQ ID NO: 257105 - DNA, 604 bp, Homo sapiens
  misc_feature: GYAE6OF01AI818.38.39.D06.1.454.CMB.1.raw
  modified_base (115)..(115): a, c, t, g, unknown or other
  misc_feature (115)..(115): n is a, c, g, or t
  modified_base (142)..(142): a, c, t, g, unknown or other
  misc_feature (142)..(142): n is a, c, g, or t
  modified_base (151)..(151): a, c, t, g, unknown or other
  misc_feature (151)..(151): n is a, c, g, or t
  modified_base (164)..(164): a, c, t, g, unknown or other
  misc_feature (164)..(164): n is a, c, g, or t
  modified_base (169)..(169): a, c, t, g, unknown or other
  misc_feature (169)..(169): n is a, c, g, or t
  modified_base (178)..(178): a, c, t, g, unknown or other
  misc_feature (178)..(178): n is a, c, g, or t
  modified_base (185)..(185): a, c, t, g, unknown or other
  misc_feature (185)..(185): n is a, c, g, or t
  modified_base (206)..(206): a, c, t, g, unknown or other
  misc_feature (206)..(206): n is a, c, g, or t
  modified_base (210)..(210): a, c, t, g, unknown or other
  misc_feature (210)..(210): n is a, c, g, or t
  modified_base (215)..(215): a, c, t, g, unknown or other
  misc_feature (215)..(215): n is a, c, g, or t
  modified_base (225)..(225): a, c, t, g, unknown or other
  misc_feature (225)..(225): n is a, c, g, or t
  modified_base (235)..(235): a, c, t, g, unknown or other
  misc_feature (235)..(235): n is a, c, g, or t
  modified_base (269)..(269): a, c, t, g, unknown or other
  misc_feature (269)..(269): n is a, c, g, or t
  modified_base (406)..(406): a, c, t, g, unknown or other
  misc_feature (406)..(406): n is a, c, g, or t
  modified_base (452)..(452): a, c, t, g, unknown or other
  misc_feature (452)..(452): n is a, c, g, or t
tcagtcgatcacgtcacgaccggtgctcgatttagtgacatctcgcagttctttgggactttgcctggctctgctgctcctcaccctcctcactcaggcacaggtcctggacccngtctgccctgactcagcctgcctcgtntcgtggtcnctgacagtcatcncatcncctgacacnggaaccngcaggtcacgttggcgttaanaatntgctnttggaccaantaccacaaancgtcaccagcaaacgtcccaaatcaacttattangtagacacgtaaacgcccatacgacttatatacgcttatctgctacctagtctcgacacgaccgtcctccgtcactactcctatcggtacctaccactacggagtacgagctacgtactacgtactgtcacgctacncgtatacacacgacgtctcgtacgttaggttcggtaccggtacggngggacccgtacgtaccgttccgtacgtttacggaccttacgaccggtaaccgcgttaccccgtacccggttaccggtccgttacccgtaccgttcccgttacccccgtacccgtttaccccgaccccgttacgttccgtaacccgttaccgg

SEQ ID NO: 257106 - DNA, 684 bp, Homo sapiens
  misc_feature: GYAE6OF01CUC8U.38.39.D06.1.454.CMB.1.raw
  modified_base (193)..(193): a, c, t, g, unknown or other
  misc_feature (193)..(193): n is a, c, g, or t
  modified_base (252)..(252): a, c, t, g, unknown or other
  misc_feature (252)..(252): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctcgtgtctgggtctcctggacagtcgatcaccatctcctgcacgtggaaccngcagtgtacgttggtagttaataaattatgtctcttaggtaaccaacataccaccaacntccacccagacaaacgtccccaaatcaattaattatgagtcaactaacggccctagagtagtttactaatcgtcttctcgtggcctacaagtcgtggaccaacgaccggtccctacccgtacgacctacttccgtcgtcgggccctaaccgaacccgtggaacggacgacgggtcctacgtaacttaagtttacttcgaccgtaacgtctacaattaactaccgaaagccgtacgtccgtactacggtttgggtacggttccgggacgggaccgggtacccgtaccgttacggtacccgtttcgttacggtaccaaccggtcccgtaaacggtccgttcccgcccccggttaccggtacctaccgttcccgtttaccccggttccccccgacccctttcccgtaacgttcccggtagtaccggttaacccgg

SEQ ID NO: 257107 - DNA, 727 bp, Homo sapiens
  misc_feature: GYAE6OF01BD09H.38.39.D06.1.454.CMB.1.raw
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (288)..(288): a, c, t, g, unknown or other
  misc_feature (288)..(288): n is a, c, g, or t
tcagtcgatcacgtcacgaccggtgctcgatttagtgacatctcgcagttctttggggactttgcctgggctctgctgctcctcaccctcctcactcaggcacagggtcctgggcccagtctgccctgactcagcctgcctcgtgtctggtctcctggacagtcgatcaccatcctcctgcactggaaccagcagtgacgttggtgttaataaatatgtctcgttacggtaccaanatccaaccaanctccacccaggacaaaacgtccccaaactcaattaatttangagttcaactaaaccggccctgaaggtacgtttactaatcgtctttctctggtcctacctaagtctacggcaaaccgaccggtcccctccctagacccacttccgtcgtccgggacctacccaaccgtggaacgggacgacggtcctactaacgtttactttacttcgtacacgtaccttactaacgttaactaaccgaacgaccgtaacggtcccgttacgttaccggttttggggtcggttacggggtaccggggaaccggggaaccccggtacccgtaccggtacccggttccggttacggtaccgaccggtacccgaaacggtcccgttccccggtaccccccgttccgggtaccctcccgtttacccgttaccccgtttacccccctacccccgttacccgttacccgaccgttccggtaaccgttaccccggg

SEQ ID NO: 257108 - DNA, 786 bp, Homo sapiens
  misc_feature: GYAE6OF01BGTIS.38.39.D06.1.454.CMB.1.raw
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
  modified_base (352)..(352): a, c, t, g, unknown or other
  misc_feature (352)..(352): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatcctcctgcactggaaccagcagtgacgttggtgttaataaatntgtctcttggtaccaanatcaccaacatcacccaggacaaacgtccccaaactcattaattatgagtacaaccgtaaaccggccctacgaggtagtttactaatcgtcttctctgactcaagtctgaccaacnccggtcctcccgtacgacctactcctcgtcgggtcctacccgaaccgtgacggacggacggcctaccgtaacttatttacgttcgactacgtacctactaacttacgtaacaacgccgtaacggtccgttacgtaaccggtttgggggttcggtttacccggggaccgggtaaccggggtaccccgtaacccggttacgggttaccccggtttacggtttaacccgggtaccgtaacccgggtaacccccggtaaaccggggtcccccgttacccccgggtacccccccccggtttaccgggttacccccgttaacccggttttcccccgtttacccccgggttttaacccccccccttaaacccccccgttttcccccgtaacccccgggtttaaacccggtttcccgggtaacccgtttaaccccccggggg

SEQ ID NO: 257109 - DNA, 737 bp, Homo sapiens
  misc_feature: GYAE6OF01CE4F7.38.39.D06.1.454.CMB.1.raw
  modified_base (188)..(188): a, c, t, g, unknown or other
  misc_feature (188)..(188): n is a, c, g, or t
  modified_base (244)..(244): a, c, t, g, unknown or other
  misc_feature (244)..(244): n is a, c, g, or t
tcagtcgatcacgtcacgaccggtgctcgatttagtgacatctcgcgagttctttggggactttgcctgggctctgctgctcctcaccctcctcactcaggcacagggtcctgggcccagtctgccctgactcagcctgcctcgtgtctgggtctcctgacagtcatcacatctctgcacgtcgaacngcagtgtacgttggtgtaataatatgtctcttggtaaccaagtctacaaccaaacnctaccaacccgtagacaaaaccgtacccctaaaattctaaacttaactttagtacgtaacggtaactaaacctaaaaccggccctacgtagggtaactttaccgtaatccggtacttcgtacgtcgacctaacgtaagtccgtaggacctaaccggtaccggtccctaccgttacggaccctaacgttcctaccgttacgggacccctttaacccaaccggttaggaaccgggtaaccggtaaccggtccttaacgtaaacttttagttaactttcgacgtaacgtacctacgtaaattactaacgaaacgtacaacggttcggtaccttaaggttcgggttcggtaccgggtaccgggaacgggtaacctaacccggtcgtaacggttcgtaccgactaccggtccgaaccgtccacccggtccccgtacgttacctacccgttcgtccccgttacccgtccccgttacctaccgaccgtttcgagtacccg

SEQ ID NO: 257110 - DNA, 825 bp, Homo sapiens
  misc_feature: GYAE6OF01AH1IT.38.39.D06.1.454.CMB.1.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
  modified_base (297)..(297): a, c, t, g, unknown or other
  misc_feature (297)..(297): n is a, c, g, or t
tcagtcgatcacgtcacgaccggtgctcgatttagtgacatctcgcagttctttggggactttgcctgggctctgctgctcctcaccctcctcactcaggcacagggtcctgggcccagtctgccctgactcagcctgcctcgtgtctggtctcctggacagtcgatcaccatctcctgcactcggaaccngctagtgtacgttggtagttaataatntgtctcttacggtaaccaacataccaaccaactactaccacccgaggacctaaacgtaccccaaactcaattaatttanacgacggtacctaaccgtaaaccggcccctacgtacggtacgttttacctaactccggttacctttcgtacgttcggtcccttaccgtaaacggttccgtacggaccctaaaccgtacccgggtaccccttaccccgtacgaaccctacgttcccgttaccggttaccggggtaccccttaacccgtaaacccgtggggtaaaccggtaccggtaaccgggtccttaaccgtaactttaacgtttacgttacgactaacgtacctacttaaactaacgtaaccgaacggtacctacggtaccgttaccgttacggtttacggggttacggtttaccggggaccgggtaacccggggtaacccggttaacccgttccggttaacccgttaccggttaaccggtaccgtacccggacccgtaaccggtcccgtaccccggtcccccgttaccgggtaccctacccgttccggttaccccgttccccccgtaccccttacccgtaccgtcccggttagtccgttacccggg

SEQ ID NO: 257111 - DNA, 179 bp, Homo sapiens
  misc_feature: GYAE6OF01C82GC.38.39.D06.1.454.CMB.1.raw
  modified_base (176)..(179): a, c, t, g, unknown or other
  misc_feature (176)..(179): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcatcaccatnnnn

SEQ ID NO: 257112 - DNA, 445 bp, Homo sapiens
  misc_feature: GYAE6OF01AR22K.38.39.D06.1.454.CMB.1.raw
  modified_base (425)..(445): a, c, t, g, unknown or other
  misc_feature (425)..(445): n is a, c, g, or t
tcagtcgatcacgtcacgaccggtgctcgatttagtgacatctcgcagttctttggggactttgcctgggtgacgttggtggttataaatatgtctcttggtaccaacatcaccaacatcacccaggcaaagtccccaaactcatcatttatgacgtcactcatcggccctcaggggtttctactcgcttctctggctccaagtttggcaacacggcctccctgacccatttctgggctccaggctgaggacgaggctgaattttattgctcctcatatacaggcagcagcaccccttatgtcttcggaactgggacccaaggtccaccgtcctacgtcacgcccaaggcccaaccccatgtccactctcgttccccgccctcctcacgtgactcgactgacgcgggctggcaaggcgacatagnnnnnnnnnnnnnnnnnnnnn

SEQ ID NO: 257113 - DNA, 661 bp, Homo sapiens
  misc_feature: GYAE6OF01BNCJV.38.39.D06.1.454.CMB.1.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (278)..(278): a, c, t, g, unknown or other
  misc_feature (278)..(278): n is a, c, g, or t
tcagtcgatcacgtcacgaccggtgctcgatttagtgacatctcgcagttctttggggactttgcctgggctctgctgctcctcaccctcctcactcagggcacagggtccctgggcccagtctgccctgactcagcctgcctccgtgtctgggtctccgtggacagtcgatcaccatctcctgcactcggaaccngcagtgacgttggtagttaataaatntgtctcttagaccantcaccantccaccaggacaacgtccccaatcaattaattangtacgtacaccgtaacgcctagaggtagtttactactcgtcttctactcggtcctaccaagttcgtacggaccaacgtaccgtccctcccgtacgacctatccgtcgtcggtacctccaaccgtggacggtacgagttacttaatttacgtttcgcgtacgtacgttacaactaactaacccgaacctagaaccctaacgtcctctacgtccgttacggttcgggacgggtaaccgaaccgtacggtaccttacggtacccgttaccgtaagtacccgaccggaacccgtacggtccgtacccggtcccccgttacggttccctacccgttcccgttccccgttcccccgtccctaccctacggtaccgttcgtaaccgtccg

SEQ ID NO: 257114 - DNA, 678 bp, Homo sapiens
  misc_feature: GYAE6OF01CWXOZ.38.39.D06.1.454.CMB.1.raw
  modified_base (188)..(188): a, c, t, g, unknown or other
  misc_feature (188)..(188): n is a, c, g, or t
  modified_base (201)..(201): a, c, t, g, unknown or other
  misc_feature (201)..(201): n is a, c, g, or t
  modified_base (419)..(419): a, c, t, g, unknown or other
  misc_feature (419)..(419): n is a, c, g, or t
  modified_base (433)..(433): a, c, t, g, unknown or other
  misc_feature (433)..(433): n is a, c, g, or t
  modified_base (503)..(503): a, c, t, g, unknown or other
  misc_feature (503)..(503): n is a, c, g, or t
tcagtcgatcacgtcacgaccggtgctcgatttagtgacatctcgcagttctttggggactttgcctgggctctgctgctcctcaccctcctcactcaggcacgagggtcctgggcccagtctgccctagactcagtcctcgcctccgtgtctcgggtctccgtaggacagtcgactcaccatcctcngcacgcggaaccngcgagtcggtagttggtagttaataatgtcgttctacgttacggtaaccaactactaccaaccaactactacccgaaccgaacggacctaaaaccgtacccaaatctaacttaattacgagtacgtacgaaccgtaaccggccgtagtaggtactttacgtaactcgtacttctcgtacgcctacgaacgtcgtacgaccaacggtccgcctacccgngacctagtcctcgngtaccaccgtacgacgtacgacgctacgactacttagtacgtacgactagctaacctataacgtaacganaccgactaccgtacggttaagggttccgggttaggtcccgggtaaccggacgggtaccctaccgggttacgaccggttacgtacggtaccgacgtaccgaccgtaccgccggtccctaggtccgtaccttccggtaccctacccgttccctaccgagtaccctggacgttaccgg

SEQ ID NO: 257115 - DNA, 686 bp, Homo sapiens
  misc_feature: GYAE6OF01CAKK5.38.39.D06.1.454.CMB.1.raw
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
tcagtcgatcacgtcacgaccggtgctcgatttagtgacatctcgcagttctttgggggactttgcctgggctctgctgctcctcaccctcctcactcagggcacagggtcctgggcccagtctcgccctgactcagcctgcctcgtgtcgtgggtctccgtggacagtcgatcaccatctcctgcacgtcggaaccngcaggtgtacgttggtagttaataaatntgtcttcgttacggtaaccaactactaccaaccaacactaccaacccgaaggaccaaaccgtaccccaaatactaattaatttagagaacgtacaacgtaaaccggcctagtaggtatttacaagtcgttctctcgtcggacctaccgtaagtccgtggaacctaaccgaccggtccccttcccgtacgaccctatccgtcgtccggacctacccgaacgtaggaacggtacgacgtactacgtaacttactttagtcgactcgtactactaacgttacaacgagtacgacggtccgttaacgtacgggtttggggaccggttacggggaccgggtacgggacccctcgtaccggtaccgttagtacgtaccgacgtacccggaacgtcccgtcccggtcccgtgtaccctaccttcccgttcccttacccctcctaccggtctacggtactccgtacgg

SEQ ID NO: 257116 - DNA, 847 bp, Homo sapiens
  misc_feature: GYAE6OF01DYK9H.38.39.D06.1.454.CMB.1.raw
  modified_base (452)..(452): a, c, t, g, unknown or other
  misc_feature (452)..(452): n is a, c, g, or t
tcagtcgatcacgtcacgaccggtgctcgatttagtgacatctcgcagttctttggggactttgcctgggctctgctgctcctcaccctctcactcagggcacagggtcctgggcccagtctgcctgactcagcctgcctcgtgtctggtctcctggacagtcgatcaccatctcctgcactggaaccaggcagtgacgttggtagttaataaatctgtcctacgttacggtaaccaactataccgaaccaaatacgttaccaacccgtaaggaccttaaaaacgtacccccaaaaattcctaaaggttaaaacttttagtaggaacgggttaccaaaaccgttaaaaccggccctacggtaagggttacttttaacctaaacttcgaccgttttcacgttcgggtacctacgaaacgtcgtacgggaccaaaccgaccgttcccttacccncgtaaacctagttccgtacgttcgggtaccctaccggaaacccttgggacggaaccggtaaggtcctaactaaccttaattaactttgaccccgaaggtccctaacgtaaactttaaagtaaaccgtaaacgaccgttaaacggccgttacgtttaaacccgggtttggggttaaccggttttccgggacggggtaaaacccggggggaccccttaacccggtttacggaaaccccggttttagttttaacgggtaaccgtaaccggaacccccgtaaaacgggtcccttaacccccggggttcccccggtaacgggtccgtttaaacttcccggtttacccttacccccgttaaccccttccgtaacccgtacggttacgtaacttacccgggg

SEQ ID NO: 257117 - DNA, 670 bp, Homo sapiens
  misc_feature: GYAE6OF01B2HCI.38.39.D06.1.454.CMB.1.raw
  modified_base (194)..(194): a, c, t, g, unknown or other
  misc_feature (194)..(194): n is a, c, g, or t
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatcctcctgcactggaaccngcagtgacgttggtagttaataaatntgtctctagtacanancacaanatcaccagacaacgtacccaaatctaattaattatgagtacaactaaccggcctgaggtacgtttactaatctcttctctggctacaagtctggaccacaccggtccctcccgtagacctatccgtcgtcggacctaccgaacgtgacgggacgacggtccttactaattactttgtacgcaggtcctaataactaataaccaacgctacggtccgttacgtaaggtttggggtaccggttacgggaccggggtacggacccggtaccgttacggttaccgttacgttacggaccgaaccggtacccggtaaacggtcccgtcccccggttacccccgacggttcccgtaacccgttccccggtttccccgttaccccccggtccccttacccggttacccgtacggttacgtaaccccgtacccggg

SEQ ID NO: 257118 - DNA, 837 bp, Homo sapiens
  misc_feature: GYAE6OF01APPPI.38.39.D06.1.454.CMB.1.raw
  modified_base (238)..(238): a, c, t, g, unknown or other
  misc_feature (238)..(238): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactcggaaccagcagtgacgttggtggttaataaatatgtctcgttggtaccaanatccaccaacatccacccaggacaaacgtaccccaaactctaattaacttttatgaacggttaccaaccgtaaaaccggcccttacgaacggtacgttttactaaagttccgtctttcgtaccgtggtccttaccgaagtccgtaggaccaaccgtaccgggtccccttacccgtcggaaccctacgttccgttccgtcgggtacccttacccgaaacccgttggaacgggaaccggacgggtctacccgtaactttacgtttacgttacgaccgtaacgtcttactaacgtaactaaccgtaacgaccgtaacggtcccgttacgttacgtttccgggggttcggttaccggggtaccggggtacggggtaaccccggtaccggttaccggtaaccccggtttacggttaacgggttcccgaaacgggtacccccgtaaacggggttccccttaccccggggtccccccccgttttaccgggttaccccgttaccccgtttaccccggttttaccccggtttacccccccctaacccccggttttacccccttaccccggtaacccggggtttccgtaaaccgggtttacccccgggg

SEQ ID NO: 257119 - DNA, 765 bp, Homo sapiens
  misc_feature: GYAE6OF01B72Y0.38.39.D06.1.454.CMB.1.raw
  modified_base (549)..(549): a, c, t, g, unknown or other
  misc_feature (549)..(549): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcacgcctcgcctccgtgtctcgggtctccgtggacagtcgactcaccactcctcctgcacgtacggaaccagcaggtgtacggttggtagttaataatatgtctcgttacgtaaccgggaacactacaaccaaacactaccaaccgacggacaaaccgtacccaaactactaattaattagtcgaacggtacctaaaccgttaaaccggcctacgaggtacgtttactaactcggtacttctcgtcggtacctacgtaacgttcgacggaccaaccgaccgtccctacccgtacgtaacctacgttccttacggtccggtacctaaccctaaccgtacgggaaacggtacggaaccggtctaacgttaacttacttacgtacgtaccgtacgactactaaacgtacgtaaacgaacnccgtaacgtcccgttacgttacggggtttccggggtacgggttaccgggaacggggtaccggtaaacccggtacccgtacgggttacccgttacgggttacgtacccgaccggtaacccggtacgccggtccccggtccccgtcgggttaaccctcccggttccgttacccgtcccccggtacccttccgacccgttccggaacttacggtaccgg

SEQ ID NO: 257120 - DNA, 854 bp, Homo sapiens
  misc_feature: GYAE6OF01DQVOK.38.39.D06.1.454.CMB.1.raw
  modified_base (178)..(178): a, c, t, g, unknown or other
  misc_feature (178)..(178): n is a, c, g, or t
  modified_base (200)..(200): a, c, t, g, unknown or other
  misc_feature (200)..(200): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcacgcctgcctccgtgtcgtgggtctccgtggacagtcgatcaccntctcctgctacgtacggaaccngctagtcgtacggttggtaggttaaataaatatcgttcttacgttaggaaccaatactaccaaccgaatactaccaacccgacggtaacctaaaccgtaccccaaaatcctaatttaactttagacggaacggtaccaacggtaaacccggtcctagtacggttactttacgtaacgtccgttacttccgtagtcgtaccttaccggtaagtccggtaggtaacccaaccggtaccggtccccttccgtacggtaacctcgttaccgttccgtccgggtaccctaaccccggtaacttcgggaacgggtaccgtacggtaccctaccgttaacgtttacgttacgttacgacggtaaccgttacgtaactaacgttaacctaaacggtaaccgtacgtaacgggttcccttacgggttaacggtttcggggttacgggttaccggggaccgggtaccggggtaaccctaccgggttaaccggtaccggttaaccggttacggtaaccggtcccgtaacccgggtaccggtcccgttaccccgggtccccgttaccggtacccggttaacccggttcccgtttaacccccgggttcccccgttaccccggttaacccgttacccggtaaacggtttccgtccgggtaaacccggg

SEQ ID NO: 257121 - DNA, 598 bp, Homo sapiens
  misc_feature: GYAE6OF01AEQQ2.38.39.D06.1.454.CMB.1.raw
  modified_base (213)..(213): a, c, t, g, unknown or other
  misc_feature (213)..(213): n is a, c, g, or t
  modified_base (218)..(218): a, c, t, g, unknown or other
  misc_feature (218)..(218): n is a, c, g, or t
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
  modified_base (275)..(275): a, c, t, g, unknown or other
  misc_feature (275)..(275): n is a, c, g, or t
  modified_base (314)..(314): a, c, t, g, unknown or other
  misc_feature (314)..(314): n is a, c, g, or t
  modified_base (368)..(368): a, c, t, g, unknown or other
  misc_feature (368)..(368): n is a, c, g, or t
  modified_base (431)..(431): a, c, t, g, unknown or other
  misc_feature (431)..(431): n is a, c, g, or t
  modified_base (444)..(444): a, c, t, g, unknown or other
  misc_feature (444)..(444): n is a, c, g, or t
  modified_base (593)..(593): a, c, t, g, unknown or other
  misc_feature (593)..(593): n is a, c, g, or t
tcagtcgatcacgtcacgaccggtgctcgatttagtgacatctcgcagttctttggggactttgcctgggctctgctgctcctcaccctcctcactcagggcacagggtcctggcccagtctgccctgactcagcctgcctccgtgtctgggtcctccgtggacagtcgatcaccatctcctgcactggaaccagcagtgacgttggtgttanaaatntgtctntggtaccacatcaccaantcacccagtcaaacgtcccaaatcataactttngacggtcaacctaacggcctacaggtatttcaatccgtnttctactaggccttacgaagtctggaccaaacgccggtccttcccgcgaacctntccgtccgtgggtcctaccctaacgtcgagggtacgacggtccttaccgtattattaggttcncgtaactcctaanacttaacaacgaacgctagccgttacgtcggttcgggttacgtccgggcgggtacggtaaccctcgtacggtccgtactaggtccgacgccgtacggtcctacccggtcccgtgtcccactcgttacgtccccctagtcctacgactgntaccg

SEQ ID NO: 257122 - DNA, 737 bp, Homo sapiens
  misc_feature: GYAE6OF01CZFPH.38.39.D06.1.454.CMB.1.raw
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
  modified_base (285)..(285): a, c, t, g, unknown or other
  misc_feature (285)..(285): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatcctcctgcactggaaccagcagtgacgttggtagttaataatntgtctctagtaccaacntacaccaacatccacccaggacaaacgtaccccaaatcaattaattagngagtaccaactaaccggcctagaggtagtttactaactccgtcttactcgtcggactaccgaagttctacgaccaacgtccggccctacccgtacgtaaccctattccgtacgtcgggaccttaccgaaccgtggaacgggacggtacgccgttacaacgtttatttacgtcgactacgtaccttaacgtattaacgtaaaccaacggtaccgtaccggtccgtttaccggtaacggttttcggggttaccgggttaccggggaccgggggtaaaccgggtcccccggtaacgttcggtaaccccgtttaggttacggtaccgaaccgtccccggaagggtcccttaccccggtccccggttaccgggttacctacccggttcccgtttacccccggtcccccgttacccccgttaccgttaccggaaccggttccggttaccgtacccggg

SEQ ID NO: 257123 - DNA, 658 bp, Homo sapiens
  misc_feature: GYAE6OF01ECBKC.38.39.D06.1.454.CMB.1.raw
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttataaatntgtctcttgtaccaantcacaacactcaccagacaaacgtccccaaatcattaattatgacgtacaactaaacggcctagaggtactttacaatcgtcttctctggacctccgaagtctcggacaacgtaccggccttcccagtacctactcctcgtcgggtaccctaccgtaaccgtggaacggtacgacggtacctactaacttattacgttcgactagcttactaagttactaacgaagactacgtaccggttctaaggttttcggggtcggttaccggggacggggtacggtaccccggtaacgttccggacccgtttcggttaacggcccgtacggtacccgaacggtccctccggtaccccccggttggtacccctcgtacccgttcccggtaccccctaccttccccgtacgtaccgttcgtacgttacccgg

SEQ ID NO: 257124 - DNA, 588 bp, Homo sapiens
  misc_feature: GYAE6OF01AOY59.38.39.D06.1.454.CMB.1.raw
  modified_base (217)..(217): a, c, t, g, unknown or other
  misc_feature (217)..(217): n is a, c, g, or t
  modified_base (234)..(234): a, c, t, g, unknown or other
  misc_feature (234)..(234): n is a, c, g, or t
  modified_base (279)..(279): a, c, t, g, unknown or other
  misc_feature (279)..(279): n is a, c, g, or t
  modified_base (297)..(297): a, c, t, g, unknown or other
  misc_feature (297)..(297): n is a, c, g, or t
  modified_base (350)..(350): a, c, t, g, unknown or other
  misc_feature (350)..(350): n is a, c, g, or t
  modified_base (441)..(441): a, c, t, g, unknown or other
  misc_feature (441)..(441): n is a, c, g, or t
  modified_base (540)..(540): a, c, t, g, unknown or other
  misc_feature (540)..(540): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatntgtctcttggtaccaanatcaccaacatcacccaggacaaacgtcccaaactcataatttangagtcactaacggccttnacggagtttcaatcgacttctctggcctcaagtctggcaacgaccggctcccngaccatcctcgtggcctaccgactgacggtacgaggtctcactattatttcgacagccttacaattaacgtaccaaagcgaagccgtaacncgtttaggggtcgttcggtacgggacggacccgtacgtcgacccgttctttacgggacctagacccgaaacggtccctcgtaccccccgtcggttaccnccgttaccgtccgttacccgccccttctacccgtacgtcgacgtaccg

SEQ ID NO: 257125 - DNA, 587 bp, Homo sapiens
  misc_feature: GYAE6OF01EEYSB.38.39.D06.1.454.CMB.1.raw
  modified_base (236)..(236): a, c, t, g, unknown or other
  misc_feature (236)..(236): n is a, c, g, or t
  modified_base (308)..(308): a, c, t, g, unknown or other
  misc_feature (308)..(308): n is a, c, g, or t
  modified_base (352)..(352): a, c, t, g, unknown or other
  misc_feature (352)..(352): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttggtaccaanatcaccaacatcacccaggcaaaacgtccccaaaactcaattaatttatgaggtcaactaaaacggccctanaggtagtttctaatcgactttctctggctccaagtctggcaacncggtcctccctgaccatctctcgggtcctaccgaaccgtgacggacggagtctactacgtattagtgcagtctacatactacaagcagcgtcagtttggggcgttacgggcggagggtacccgacgttacgacccgttacttacggcaacgcccgaaaggccgttccggcccccgttcggtccacttcccgtccgttacccccgtcccttcccgtactacggtcgcgttacccgg

SEQ ID NO: 257126 - DNA, 569 bp, Homo sapiens
  misc_feature: GYAE6OF01EDXAS.38.39.D06.1.454.CMB.1.raw
  modified_base (218)..(218): a, c, t, g, unknown or other
  misc_feature (218)..(218): n is a, c, g, or t
  modified_base (236)..(236): a, c, t, g, unknown or other
  misc_feature (236)..(236): n is a, c, g, or t
  modified_base (279)..(279): a, c, t, g, unknown or other
  misc_feature (279)..(279): n is a, c, g, or t
  modified_base (301)..(301): a, c, t, g, unknown or other
  misc_feature (301)..(301): n is a, c, g, or t
  modified_base (425)..(425): a, c, t, g, unknown or other
  misc_feature (425)..(425): n is a, c, g, or t
  modified_base (460)..(460): a, c, t, g, unknown or other
  misc_feature (460)..(460): n is a, c, g, or t
  modified_base (540)..(540): a, c, t, g, unknown or other
  misc_feature (540)..(540): n is a, c, g, or t
  modified_base (561)..(561): a, c, t, g, unknown or other
  misc_feature (561)..(561): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatntgtctcttggtaccaacntcaccaacatcaccaggcaaacgtccccaaactcataatttangaggtacactaaacggccctanacgggtatttctaatcgtcttctcgtgtctcgaagtctcggacaacaccggtcctaccctgacctatctcgtcgggcctaccaactggacggtacgacggtctactactattagtcgctagctnaactatacagtcagcgtctacgttggtcgttcggnggacggaccgctcgtactcgttggacgacgaccgacggtctccggtacccctgggtcaccgttccttccggttacccccncccttaccgacctacggtcgngtacccgg

SEQ ID NO: 257127 - DNA, 689 bp, Homo sapiens
  misc_feature: GYAE6OF01CFO1N.38.39.D06.1.454.CMB.1.raw
  modified_base (302)..(302): a, c, t, g, unknown or other
  misc_feature (302)..(302): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactaggaaccagcagtgtacgttggtaggttaataaatatgtctcgttacggtaaccaacactaccaccaacactaccacccgaggaccaaaccgtaccccaaactcactactatttancgacgtcactcactccgcctacgtacgggtttctactcgtcttctcgtcgtctccgtaagttcggaccaacgccggtccctcccgtacgaccttactttcgtacgggtcctccgaggtccgtaggacggacggacggtacttacggtttaattttacgtcgtaccttacctactaattacgtacgacggcacgtacaccgtaccctacccgtttagttacgttccgttaacggtaaccgtacgggtaacccgtaacggtccccgtaccgttaccgtacgtacccgaacgtccccgaaaccgtccccgaaacccgtcgtaccggtaccttacccgttaccgttaccccgtaccccctacccttacccgacttaccggtgttaacccgg

SEQ ID NO: 257128 - DNA, 668 bp, Homo sapiens
  misc_feature: GYAE6OF01ESWRS.38.39.D06.1.454.CMB.1.raw
  modified_base (221)..(221): a, c, t, g, unknown or other
  misc_feature (221)..(221): n is a, c, g, or t
  modified_base (242)..(242): a, c, t, g, unknown or other
  misc_feature (242)..(242): n is a, c, g, or t
  modified_base (480)..(480): a, c, t, g, unknown or other
  misc_feature (480)..(480): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctggtctcctggacagtcatcaccatctcctgcacgtggaaccagcagtcgacgtttggtagttaataaactntcgtctcgttacgtaaccaanactaccaaccaacactaccacccgacgaccaaaccgtaccccaaactacatacttaatttagcgtaccgtacacctcacgtccggtcccgtagtacgggtttcctaccgtcgtcttctcgtcgtacctacgttaagttcgacaaccgccgtcctccctagtaccttacgtttcgtcggtccgtcgtacggcgtaggacggtacgtacgtcgttaagttattttatcgtccttacctanattacgacgagacacgacgtaccgtaccttacccgttgtacgttaccgtacggtacgtacgggtaaccgttacggtaccctaccgtacctaccggtacgacccggtacccgtaaacccgtaccccctacctccgttacgtcctacccgttcctacccgtacccctcccgtaccacgtacgtcgtaccg

SEQ ID NO: 257129 - DNA, 687 bp, Homo sapiens
  misc_feature: GYAE6OF01E5WXY.38.39.D06.1.454.CMB.1.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (283)..(283): a, c, t, g, unknown or other
  misc_feature (283)..(283): n is a, c, g, or t
  modified_base (305)..(305): a, c, t, g, unknown or other
  misc_feature (305)..(305): n is a, c, g, or t
  modified_base (493)..(493): a, c, t, g, unknown or other
  misc_feature (493)..(493): n is a, c, g, or t
  modified_base (500)..(500): a, c, t, g, unknown or other
  misc_feature (500)..(500): n is a, c, g, or t
tcagtcgatcacgtcacgaccggtgctcgatttagtgacatctcgcagttctttggggactttgcctgggctctgctgctcctccaccctcctcactcagggcacagggtcctgggcccagtctgccctgactcagcctgcctcgtgtctgggtctcctggacagtcgatcaccatctcctgcacgtcggaaccagcagtgacggttggtagttaataatntgtctcttcgtaccaanactcaaccaacntaccaccagacaaactcccaatctaataattangagtacaacctaaccggcctanacgtagttactaacgtcgtcttcttcgtcgtactaccgaacgttccgtacggacctaaaccgaccggtcccttacccctcgaaccctacttccgtcggttacggtaccctacccgtaaaccgtcggaacggaccggtacggtactaccgtaacgttaattacgttcgactacgtcctaagtaactaanaacgaanccgtacgtacccgttcgtacggtttcggggtcggtccgggacgggacggacccgtacgtacggttaccgtacggttacgacgaacccggccgtaaccggtccgtcccgtcccccgttcgtaccccgtccgttacccgtccccgtttacccccgtcccttcccgttacgtaccgttcgtcgtaccggg

SEQ ID NO: 257130 - DNA, 725 bp, Homo sapiens
  misc_feature: GYAE6OF01DP3S1.38.39.D06.1.454.CMB.1.raw
  modified_base (205)..(205): a, c, t, g, unknown or other
  misc_feature (205)..(205): n is a, c, g, or t
  modified_base (532)..(532): a, c, t, g, unknown or other
  misc_feature (532)..(532): n is a, c, g, or t
  modified_base (673)..(673): a, c, t, g, unknown or other
  misc_feature (673)..(673): n is a, c, g, or t
tcagtcgatcacgtcacgaccggtgctcgatttagtgacatctcgcagttctttggggactttgcctgggctctgctgctcctcaccctcctcactcgagggcacagggtcctgggcccagtctgccctgactcacgcctgcctccgtgtcgtgggtctccgtggacagtcgatccaacctatcctcctgcacgtacggaaaccngcctaggttcggtacggtttgggtaggttaaattaaaagttcttcgttccttacgttacggtaaaccaaacgtactaccaaccaaactacttacccaacccgaaggaacctaaaaaccggtaccccaaaacttctaaattaaactttacgcggtaacggtactaaaccgtaaaccgcctacgtaggtacttactaatccgtcttcgtctcgacctacgaagtcgtacggcctaacgccgtaccctccacgtacctactcgtcgtacgggaccctaacccgtaaccgtggacgggaacgcgtaccttctaacttacgttggttacccngtaccgtcttaactataacgtaaccgagtccgaacggtctacgttaggtcgggttacggtcgggaacggacggtacctcgttacgtcggttacgtcgtaccgacgtccctagggtccctacccggtcccgttacgttcccncttacccggtcccttacccccgtacctccgtaaacgttcggataccgtccgg

SEQ ID NO: 257131 - DNA, 729 bp, Homo sapiens
  misc_feature: GYAE6OF01CFLOM.38.39.D06.1.454.CMB.1.raw
  modified_base (198)..(198): a, c, t, g, unknown or other
  misc_feature (198)..(198): n is a, c, g, or t
  modified_base (225)..(225): a, c, t, g, unknown or other
  misc_feature (225)..(225): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctcgccctgactcacgcctgcctcgtgtcgtggtctccgtggacagtcgatcaccactcctcctgcactaggaaccngcagtgtacgttggttagtaataaatntcgttctcgtacggtaaccaacataccacaacactccaacccaggaacctaaaccgtaccccaaactactaaattaactttagtacggtacggtacctaaaccgtaaaccgggtccctacggtaaggttaacgtttaccgttaacttccgtcctttctacgtcgtacctacgtatcgacggaaccaaccgaccgtccctacccgtacgaacctactccgttcggacggtccctaacccacgtacggtaacgggacgtacggtaccttactaccttattacgtacgactacgtacctaactataactaacgaacgcgtaacggtccgttacgtcgggtttagggttacggtaccggggacgggtaaccgggacccggtaccgtaccggtacccgtttacggtacgtaccgtacggtacccgtacggtccgtacccgtcccggtcgtacctccgttcccttcccggtcccccttcccgttaccgtaccgcgttcgtacggtaccgg

SEQ ID NO: 257132 - DNA, 721 bp, Homo sapiens
  misc_feature: GYAE6OF01ALNY3.38.39.D06.1.454.CMB.1.raw
  modified_base (244)..(244): a, c, t, g, unknown or other
  misc_feature (244)..(244): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctccgtggacagtcgatcaccatctcctgcactggaaccagcagtgacgttggtagttaataatatgtctcgtagtacaacatcacaacntccacccgaggacaaacgtaccccaaacttacacttaatttatggaggtaccaaccttaaaccgggccctagaggtactttacgtaactccgtactttctcgtagctaccgaagtcgtggcaaaccgaccggtcctccacgacctaactcctcgtcgggtacctaccgtaaacctggaacggacggaccggctacctattaatttacgtcgacacgtactactataactaacgacgacgtacgaccgttacttacggttcgggttacgggttacgggtaccgggaaccggggtacccgtaccggtaccggtacccgttccggttaacggaccgtacccggacccggtaaccggtacccgttcccggacccccggttaccggtaccgttacccccgtttcccggttcccccggtttaccccccgtccccgtttaccccccggttacgttacccggtcggttaaccggttaccccgggg

SEQ ID NO: 257133 - DNA, 937 bp, Homo sapiens
  misc_feature: GYAE6OF01B7650.38.39.D06.1.454.CMB.1.raw
tcagtcgatcacgtcacgaccggtgctcgatttagtgacatctcgcagttctttggggactttgcctgggctctgctgctcctcaccctcctcactcagggcacgagggtcctgggcccagtctcgccctgactcacgcctcgcctccggtgtcgtcgggtctccgtggacagtcgactcaaccatcctcgtcgcacgtacgaccagacgaggtcgtaggttggttaggttaaataatatcgttacgttacgttacgaaccaactactacaaccgtaacactacccgaacccgaacggaacctaaaaccgtaccccaaaacttcttaaactttaagtttagtacggtaacggttacctaaaccgggttaaaccccggtccctaacggtaaggtttaacgttttaaccgtaacgttcccggttactttcctacggttaccggtccctaaccggtaacggttccgtaccgggaacctaaccggtacccggttaccccttacccgtaccgtaaacccgtacgttacccgttacggtttacccgggacccctttaacccggtaaaccggtacggggtaaacccggtaaccggggttactaccccgtttaaacccttatttaaacgtttaccgttacggaccgttacgtaaccttaacgtaaacttaacgtaaaccgtaccgaaccgttaccgttcggttaacccggtacggggttttgggttaccgggaccgggtaacggggtaaccccgggttacccgttaccggtacccggggttaccgtttaaccggggtacctaaccgggaccggtaaaccccgggagttcccccggtacccggtaccccccggtttggtacccttaccccggtttccccgtttccccgggtacccccccttaccgtacccccgtttaacgggccgttaacggtcccggtaaccggg

SEQ ID NO: 257134 - DNA, 694 bp, Homo sapiens
  misc_feature: GYAE6OF01BBH5O.38.39.D06.1.454.CMB.1.raw
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
  modified_base (275)..(275): a, c, t, g, unknown or other
  misc_feature (275)..(275): n is a, c, g, or t
  modified_base (294)..(294): a, c, t, g, unknown or other
  misc_feature (294)..(294): n is a, c, g, or t
  modified_base (349)..(349): a, c, t, g, unknown or other
  misc_feature (349)..(349): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctccgtggacagtcgatcaaccatctcctgcactggaaccagcagtgacgttggtacgttataatatgtctcttgtaccaantcaccaantcacccaggcaacgtcccaaatcaatattangagtcacgtaaccggcctnaggtatttacatcgtcttactgtggctcagtctggacaaccgcgcctcctgaccngtcctcgtacggcctaccgaacgtcgagggaccgagtcctactactttattacgttgccgtaacgtcctaacgtaattaccgtaacaacggacctaacgggtcccgttacgttacggtttcgggggttaccgttacccggggtacgggaaccgggtaccccgttaccggtaccggttaacccggttaccggtacggtaaccgaccgggtaaccccggtaaacggcccgttacccggtccccccggtttaggtaccccgttacccgttccccgggtttacccggttcccccccgttacccccgtttaccgttaccgtaccccggttagtaaccccgttacccgggg

SEQ ID NO: 257135 - DNA, 736 bp, Homo sapiens
  misc_feature: GYAE6OF01BYGD2.38.39.D06.1.454.CMB.1.raw
tcagtcgatcacgtcacgaccggtgctcgatttagtgacatctcgcagttctttgggggactttgcctgggctctgctgctcctcaccctcctcactcagggcacagggtcctgggcccagtctgccctgactcagcctgcctcgtgtctgggtctcctggacagtcgatacaccatcctcctgacacgtaggaaccagactagtgtacggtttggtagttaataaatgtgtacttcttacggtaaccaatactaccaaccaactactaccgaacccgaaggaaccaaaacctaccccaaaacttactaattaaattataggtaacgtacctaaccgtaaccggccctagtaggtactttacgtaactccgtctttctcgtagtcctacgtagtccgtacgacaccgacgcccttacccgtagtaacctactccgtcgtcggtaccctacccgtaacggtggaacggtacggtacggtaccttaacgtaactttacgttacgttcgaccgtataccgtaataaactactaacgaacgtacgtacgaccttacggttacggtttcggggttacggtgggaaccgggtaccgggaaccgtaccgttacggtacgttacgtaccggtaccgaccggtacccgacggtacccgtcccggtaccccgtacggtacctacccggttcccgttacccgttcccccggtacccttacgtacccggtcgtacggtccgtacccgg

SEQ ID NO: 257136 - DNA, 788 bp, Homo sapiens
  misc_feature: GYAE6OF01C0QHN.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctcgggcccagtctgccctgactcagcctgcctccgtgtcgtgggtctccgtggacagtcgatcaccatcctcctgcacgtcggaaccagcaggtgtacggttggtaggttaataattagtgtcttacgttacggaacctaacactaccaaccaaccactacccaacccgaacggaacctaaaaccgtaccccctaaaacttactaatttaactttagtacgtaacggttaacctaaccggttaaacccggtcccttaggtaacggtacgttttactaaccgttccgtttactcttcgtacggtacctacgacgtccgtacggaccaacgtccgcccttacccagacctacgtccgtccgtacggtccctacgtacgtacggaacggacgacgtccgttactaactttagttactcgactacgtacctaatacgttaacacgtaccgactaacggttccttacggttacgggttacgggttcggggtaaccggaaccggggtaccggtacccgtaccggtacgttaacccgggttcgtaaccggtaccggaaccggtaccccgtaccgggttcccaccccgggtaccccgttcccggttaccttacccgttaccccggttccccgttacccccggtccccttaaccgttccggtaacgtacccggttcgtacccgggg

SEQ ID NO: 257137 - DNA, 866 bp, Homo sapiens
  misc_feature: GYAE6OF01D62T1.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctcgcctccgtgtcgtgggtcctcctggacagtcgactccaccatcctcctgcacgtagaaccagacaggtggtacggtttggttaggtttaaataaaattagttcgttccgttacgtttacgggtaaccaactactaccaaaccaaacactaccaaccccgaacggaaccctaaaaccgtaccccctaaaacctactaaactttaaatttagtacgtacggtacctaaccgtaaaaccggccctagtaacggtacgtttactaagtccgtcttacttcgtcggcctaccgtaacgtcgtacggaccaaccgaccggtccctacccgtacgacctactccgtccgtcgggtaccctaccgtaacgttacgggaacgggaacggacggtacctacgttaaccttaagtttacgttcgacgtgtacctactaacttacgtaaacacggactaacggtccgttaacgtacgggtttagggtcgggttacccgggaacggggtaccgggtaacccgttacggttacccgggttacccggtttaacggtttacgggtacccgtaaacccgggtaccccgtaaaccggggtcccctttacccccgggtacccccccggttttaccggtacccggtaaccccgttttcccgggtttaccccccggtttccccccggtttaaccccggttttcccaaaccccgggttttaacggtccccggttaagttaaccccgggg

SEQ ID NO: 257138 - DNA, 903 bp, Homo sapiens
  misc_feature: GYAE6OF01D08Q2.38.39.D06.1.454.CMB.1.raw
  modified_base (237)..(237): a, c, t, g, unknown or other
  misc_feature (237)..(237): n is a, c, g, or t
  modified_base (831)..(831): a, c, t, g, unknown or other
  misc_feature (831)..(831): n is a, c, g, or t
tcagtcgatcacgtcacgaccggtgctcgatttagtgacatctcgcagttctttggggactttgcctgggctctgctgctcctcaccctcctcactcgaggcacgtacgggtcctacgggcccagtctcgaccctggacctacgcgtccctcgtccgttccggtgttcgtcgggtcctccgtaggacgtacggttccgactaccacctctcctccgtgacctaaccgtacggaaccncggtacgtagggttacggttacggtttaggttaacgttaaattaaactcggttacttacgtttacgttaacggaaaccaactcctaaccaaactaactaccgtaccaaacccgtaaggaaaccctaacccgtaaccctaaacttactaacttttaaagttacgacggtaaccggtaacctaaacccgtaaccggttccgtaaggttaacggttaactttactaccgttctcccgttcttacgtccgtaccgttaccgaattcccgaacggaacccgacggtacccccgtctaccccgtagaccttacgtccgtcggtacctaccgtaccgtaaggcgggaacccgtagtccgtactaacttaacgttacgttacgaaccgctaactcctaacgtaaagtaaccgtaaccaagggtccccttaacgggttcgtttacgggggtttaggttacccggggtacggggtaaccggggacccgggggtaaacccacccggttttcggaacccgttttaccggtcccggtaaggaccccgacccggttaacggtcccccggttacccgcccccgtttacccggtataccccgttttaccncccccggtttaacccctcccccggtaaaccgtcttaaaccccgggttcggttaacggtccgttaacccgggg

SEQ ID NO: 257139 - DNA, 814 bp, Homo sapiens
  misc_feature: GYAE6OF01BEBZJ.38.39.D06.1.454.CMB.1.raw
tcagtcgatcacgtcacgaccggtgctcgatttagtgacatctcgcagttctttggggactttgcctgggctctgctgctcctcaccctcctcactcgaggcacagggtcctgggcccagtctcgccctgactcacgcctcgcctccgtgtcgtgggtctccgtggacctagtcgactaccacctattcccgtcctcgacctacgtacggaaccagaccgaggttacggtacggtttagggttacggtttaaattaaagtcgtttcggttaccttaccgtttaacgggtaaacccaaacgttacctacccaaaccaaccgtaactccccaacccggaacgggaaccctaaaacccgtaccccctaaactactaaagtttaacttagtacggtaacgtacctaacgtaaccgtaccgtacgtagggttactttacgtaacgttcgtacctttcgccttcggtacctacgtacggttactcggaaccacgtacccggtccctacgtccgacctacgtcctcggtaccgtaccaaccctcggttaacggaccggtagtacccggtacttacgttactaagttacgttacgtactaaccgtacctaacgtaacgtactaaccgaggtaccgtaacgtcgtaccgtaacgggtttggtacggtccggtacggggacccgtacggtaccgtacggtaccgttacgtaccggtaccgtaccggtaccggaccggtacccggtacccgtccccggttaccgtccgttaaccgtcccgttacccgttccccgtaccgtccctaccggtcgtccgtgtacccgg

SEQ ID NO: 257140 - DNA, 729 bp, Homo sapiens
  misc_feature: GYAE6OF01A7P19.38.39.D06.1.454.CMB.1.raw
  modified_base (221)..(221): a, c, t, g, unknown or other
  misc_feature (221)..(221): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcacgtggaaccagcagtgtacggttggtagttaataatntgtctcttggaccaacatccaccaactactccacccgagaccaaacgtccccaaactcaattaactttatgacggtaccaacgtaaaccggcctacgaggttacgtttactaactcgtctttacctcgtacggtctacctaaggtcctaggacctaaaccgaccggtaccctcccgtacgaacctactccgttcgtcggggtaccctacccgtaaccgtaggaacgggtaccgtacgggtaccttaccgtaaccgtttatttaacgttcgctaacgtcctactaaattactaacgacgactacggtcccgtacgttacgtttgggggttacgtaccggggacgggtaacgggacccctacgtccggttacccgttagttacggtaccgccggtaccccgtacgggtccctccccgggtacccccgttcgggtacctccccggttaccgttcccccgggttaccccctccccctttaccggtaccctacgggttccgtacgtacccggg

SEQ ID NO: 257141 - DNA, 788 bp, Homo sapiens
  misc_feature: GYAE6OF01ANN8H.38.39.D06.1.454.CMB.1.raw
  modified_base (226)..(226): a, c, t, g, unknown or other
  misc_feature (226)..(226): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctccgtggacagtcgatcaccatcctcctgcacgtcggaaccagcgagtgtacggttggtagttaataaatntcgtctcgttacgtaaccaacactccaaccaacactccaacccgacggaacctaaaaccgtaccccaaaactacctaaatttaaattttagacggtaacggtacctaaaccggttaaaacccggtccccgttacggaacgggttacgttttacctaacgttcctcctttaccttccgtcggtaccttaccgtaagttccgtacggaccaaaccgtacccggtcccctacccgtacgaccctacgttccgtccgtcgggtaccctacccgtaacgtgggaaccggtaccggtacgtacctaaccgttaactttagtttacgtcgtaacctcggaccttaacgtaataacgtaaccgtaacggcgtacggtaccgttacgttcgggtttacggggtcggttacccggggacgggaacccgggtaccgtacccggttaccggtaacgtttccggtacggaccgtaccggaccccgtacgggtccctcccgggtacccccgttggtaccctcccgttccgttccccgttccccccgtaccttcccgtacgacgtccgtagtcccgg

SEQ ID NO: 257142 - DNA, 799 bp, Homo sapiens
  misc_feature: GYAE6OF01CTX91.38.39.D06.1.454.CMB.1.raw
  modified_base (180)..(180): a, c, t, g, unknown or other
  misc_feature (180)..(180): n is a, c, g, or t
  modified_base (183)..(183): a, c, t, g, unknown or other
  misc_feature (183)..(183): n is a, c, g, or t
  modified_base (200)..(200): a, c, t, g, unknown or other
  misc_feature (200)..(200): n is a, c, g, or t
tcagtcgatcacgtcacgaccggtgctcgatttagtgacatctcgcagttctttggggactttgcctgggctctgctgctcctcaccctcctcactcgagggcacgagggtcctgggcccagtctgccctgactcagcctgccctccgtgtcgtgggtcctccgtggacagtcatcaccntcncctgcacgtaggaaccngcagtgtacggttggtagttaataaatgttgtcttacgttacggaaccaactacacccaaacgaacctactacccgaaccgaacggaaccaaaaccttaaccccaaatacctaaatttaagtttaagtacggtaaccggttaaccgtaaaaccggtaaaccccgggccttaacggtaacggtttaaccgttttaaccgtaacgtccggtttaccttaccgttccggtaacggtacccttaaccgtacggtaccgtacggaaccctaaccgtacccgtccccgtacccgtacgtaacctacgtcccgttacggtacccgggtacctaacccggtaacggtagggaaccgaccgggtaccgtaccttaacttaaacgttacgtttacgtaccgtaacgtaccgtactaacgtaactaacgtacaacggacgtacgtaccgtacgttagggtcgggtacggtacggggaccgggtaccggtacccgtcggtacgttaccggttacgtacggtacccgacgtacccgacggtccctaccggtccccgtacgtacgtcccgttcgttcccctacccggtccttccgagtcggtcgccgtaccgg

SEQ ID NO: 257143 - DNA, 841 bp, Homo sapiens
  misc_feature: GYAE6OF01A4WC2.38.39.D06.1.454.CMB.1.raw
  modified_base (241)..(241): a, c, t, g, unknown or other
  misc_feature (241)..(241): n is a, c, g, or t
tcagtcgatcacgtcacgaccggtgctcgatttagtgacatctcgcagttctttggggactttgcctgggctctgctgctcctcaccctcctcacctcagggcacagggtcctgggcccagtctgccctgactcagcctgcctccgtgtctgggtctcgtggacagtcgatcaccatctcctgcactggaacctagcagtgacgttggtaggttaataatatcgtctcgttaggtaccaanctaccaacctaacgactaccaacccgaggtaccaaaccgtaccccctaaacttcctaattaagtttagacggtaacggtacctaaaccgtaaaacccgggtaccccttacggtaacgggttaacgttttacctaaacgtccgttaccgtttcgttccgtcgggtacccttaccggaaacggttccgtacggtaccgtaaacccgacccggggtacccttacccctacggtaacctaaccgtttccgtaccggttaccggggtaaccctacccgtaaaccggtttacgggaaaccgggtaaccggtaacgggtacccttaaccgttaaccctttaagtttaacggttacgacccgtaacggttaccctaacttaaaccgttaacgtaacccgaaaggtcccgtacgggtacccgttacggttaacggggtttcgggttacgggtaccggggtaacggggtaacccggtacccgtaccgttacggtaccgttacggttacgaccgacggtacccgacggtccctacccgggtcccctaggtaccgtcccgtaccgttcccggtccccgtaccccttcgtaacccgtcggtcgtagtacccgg

SEQ ID NO: 257144 - DNA, 719 bp, Homo sapiens
  misc_feature: GYAE6OF01DIX66.38.39.D06.1.454.CMB.1.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
tcagtcgatcacgtcacgaccggtgctcgatttagtgacatctcgcagttctttggggactttgcctggggctctgctgctcctcaccctcctcactcagggcacgagggtcctgggcccagtctgccctgactcagcctgcctcgtgtctggtctctggacagtcgatcaccatctctgcactggaaccngcagtcgagttggtagttaataaagttntcgtcttcttacggtaaccaaacataccaaccaacactacccgaacccaagggtacaaaacgtaccccctaaaattctaaattaaagttactgaacggtctaacgtaaaccggcctagtaggtaatttactaacgtcgtacctttctcgtacggaccttaccgaagtccgtaggacctaaacgccggcccttcctacgacctatccgtcgtacggtacctcgacggtctagggaacgggacggtagtacgtacggttaacttactacggtcagtaactttaacgaattacgaacaaacgtcctaacgttaccttcgttacctttgtacgttaacggttcgggacgggtacgggtaaccggagggtctaacgtccgttaaacggtacaaccgggtccgaaaccggttcccgtccccggtccccgttacgggttaccctaccggttaccccttacccggtttaccccaacccgtttcccgtacgtacccgttaggtaacccg

SEQ ID NO: 257145 - DNA, 702 bp, Homo sapiens
  misc_feature: GYAE6OF01C3OOT.38.39.D06.1.454.CMB.1.raw
  modified_base (175)..(175): a, c, t, g, unknown or other
  misc_feature (175)..(175): n is a, c, g, or t
  modified_base (184)..(184): a, c, t, g, unknown or other
  misc_feature (184)..(184): n is a, c, g, or t
  modified_base (263)..(263): a, c, t, g, unknown or other
  misc_feature (263)..(263): n is a, c, g, or t
  modified_base (275)..(275): a, c, t, g, unknown or other
  misc_feature (275)..(275): n is a, c, g, or t
tcagtcgatcacgtcacgaccggtgctcgatttagtgacatctcgcagttctttgggactttgcctgggctctgctgctcctcaccctctcactcagggcacaggtcctggcccagtctgccctgactcagcctgcctccgtgtcgtggtccacgtggacagtcgatcaccatcncctgcacgngaccagctagtgacgtgtagttaataagtatcgtctacctaggaaccaaccacacccgaggacctaaccgacccaaacnctatcgtattangaccttcactcgactcggtccctagtcggttacctctctcgttctcgtcggacttacgtaacgtttcgaaccaaccgccgtcccttaccttaggaacccttaagtttccccgttagccgttaaccggacgggtcctaagggaacgaacggtaccggtatttaacggttaacttttaacgccggacctttacccattaaaccttacgtaagacggacgagttaccacggtaccctaaacccgttgtacgttaaccgaaggttaacgacggtaacctacggacccttaacccggaccttaaccgggacccaacggaaccccgaaccgttaaccccaaccgtccgtacgttaacccccgtttacccgtacctaccccctttcccggaactccgttaaccgacttaacgaccgaacttggaaccggccggg

SEQ ID NO: 257146 - DNA, 748 bp, Homo sapiens
  misc_feature: GYAE6OF01A10ET.38.39.D06.1.454.CMB.1.raw
  modified_base (163)..(163): a, c, t, g, unknown or other
  misc_feature (163)..(163): n is a, c, g, or t
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
  modified_base (228)..(228): a, c, t, g, unknown or other
  misc_feature (228)..(228): n is a, c, g, or t
  modified_base (235)..(235): a, c, t, g, unknown or other
  misc_feature (235)..(235): n is a, c, g, or t
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctggtctcctggacngtcgatcaccatcctctgcacgtgaaccngcagtgacgttggtagttataatntgtctctgacantacacantcaccagacaacgccaactanatattangagtcacgtaacgcctagagtacgttactatcgtctttctcgtcgtctaccgaagttcgtcggaccaaccgaccggtcccttacccgtacgtaccctaacttccgttacgtcggggtccctaacccgtaaccgtagggaacggacggtaaccggtaccttaccgtaacttacgtttaagttcgtacgtacgtctactaattaacgtaaccaacgtaccgtaccgtcggttaccgtttaccggtttacggggttacggtttaccggggaccggggtaaccggggtaacccccgtacggttacccgggtaacccgtttacggttacggtacccgtaaccgggaccccggtaaaccgggtcccgtcccccgggttaccccccggttaccggttacccgtaccggtttccccgttcccggtttaccccccccggtccccggttcccccggttaccggttaccccggtttccggtaccggtttaccccgg

SEQ ID NO: 257147 - DNA, 715 bp, Homo sapiens
  misc_feature: GYAE6OF01BK3ZC.38.39.D06.1.454.CMB.1.raw
  modified_base (192)..(192): a, c, t, g, unknown or other
  misc_feature (192)..(192): n is a, c, g, or t
  modified_base (668)..(668): a, c, t, g, unknown or other
  misc_feature (668)..(668): n is a, c, g, or t
  modified_base (693)..(693): a, c, t, g, unknown or other
  misc_feature (693)..(693): n is a, c, g, or t
tcagtcgatcacgtcacgaccggtgctcgatttagtgacatctcgcagttctttggggactttgcctgggctctgctgctcctcaccctcctcactcagggcacgagggtcctgggcccagtctgccctgactcagcctgcctcgtgtctgggtctcctggacagtcgatcacatctcctgcacgtgaaccngcagtgtacgttggtagttaaataatatgtccttacgttacggtaaccaacataccaacctaacactaccgaacccgaggaacctaaaccgtaccccaaataccgtaattaaacttttagacggtacggtaccaaaccttaaaccggggtccctaacggtaggttaacttttaccgtaacgttccgtaccttttcgcgttaccggtccttaccgtaagttccgtacgtaccaaccggtacccgtctaccccgtgtaacctacgttcctacggtccgggaccttaaccctaaacggtcggaacgggtacgacggtactaccgtacgttacttaacgtcgaactacgttacacgtaactacgtaacgaacgtcgaacgtcctacgtacggttcgggttagtaccgggggaccgaacgggtaccctagtccgtacgttcggtacgtcgaccggtacgacgtccgtacccgcccggttancccgtccgttcctaccggttccccncctcgacctcgacgttcaccgg

SEQ ID NO: 257148 - DNA, 735 bp, Homo sapiens
  misc_feature: GYAE6OF01B2GIV.38.39.D06.1.454.CMB.1.raw
  modified_base (194)..(194): a, c, t, g, unknown or other
  misc_feature (194)..(194): n is a, c, g, or t
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
  modified_base (247)..(247): a, c, t, g, unknown or other
  misc_feature (247)..(247): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctccgtggacagtcgatcaccatctcctgcactggaaccngcagtgacgttggtagttaataaatntgtctcttacgtaccaantacaccaanatcaccaggacaacgaccccaaatcaataatttagtgaggtacctaaccgtaaaccggccctacgaaggtacgtttactaagtccgtcttactctcggcctaccgtaagttcctacggaccaaaccgtaccggtcccctcccgtacgaaccaccgttccgtccggtacgggtacccctaccgtaaccggtaggaacgggacggtaaccgtaccttacgtaactttaagtttaacttcggaaccctacgtactaacgtaacttaagtaaccgtaaggaccgtacggtaccgttacgtaccgggtttcggggttcgggttaccggggaaccgggtaaccgggtaccccggtaccgtacggttacccgtaacgttaggcccgtacggtacccgtaggtcccgtaccggcccccgttaggtacccttccgttccgttccccgtacccccgtaccccttaccggttaccgtaaccgtcggtaaccgtacccgg

SEQ ID NO: 257149 - DNA, 737 bp, Homo sapiens
  misc_feature: GYAE6OF01A2USN.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgcctgactcagcctgcctccgtgtctggtctcctggacagtcgatcacatctcctgcacgtcggaaccagctaggtcgtacgttggtagttaataaatactgtactcttacggtaaccaatatacaaccaacactaccacccgaggacctaaacgtaccccaaatcctaattaatttatacgtagtaccaacgtaaaccggcctacgagtacgtttactaactccgtacttctcgtacggcctacgtaaggtctacggacctaaaccgccggtaccctacccgtacgacctaactcgtcgtacggacctaccgaacgtacggacggtaacgacggtctaactaacgttattacttcgactacgtactactaataacgtaacgaacgacgtacgtccgtacgttaggttcggggttacgtacgggtaccggggaccggtaacccgtaaccggttacgtacccggttaacgttacggaacccgtaaccggtaccccggtaaggtcccgttaccccgtccccggttacggttacccgttaacccgttcccggttacccggtttaccccccgtaccccttacccggttaccaacccggttacgtaaccggttacccgg

SEQ ID NO: 257150 - DNA, 739 bp, Homo sapiens
  misc_feature: GYAE6OF01B2K5D.38.39.D06.1.454.CMB.1.raw
  modified_base (299)..(299): a, c, t, g, unknown or other
  misc_feature (299)..(299): n is a, c, g, or t
tcagtcgatcacgtcacgaccggtgctcgatttagtgacatctcgcagttctttggggactttgcctgggctctgctgctcctcaccctcctcactcaggcacagggtcctgggcccagtctcgccctgactcagcctgcctccgtgtctgggtctccgtggacagtcgatcaccatctcctgcacgtacggaaccagcaggtgtacggttggtaggttaaataaagtatgttcttcgttacgtaccaacataccaaccaacactaccacccgaggacctaaaccgtaccccaaacttntaaacttaatttagtcggtaacggtacctaaccgtaaaccggcctacgtaggtacttttacgtaatccgtcctttctcgtcggtaccttacaacgttcgtacggaccaaccgaccggtccctacccgacaacctactcctcgtacggtcccaccgtacgtaggaacggacgacggtactacctaacttacgttacgtacactgtacctacaacgtaactaacgaagtcgaacggtcgttacgttacgggtttacggggttacgggttccgggtaacggggacccggtaaccggtacccggttcgttaaccgttaccggttacggaaccggtaccggtaccgacggttacccgtcccggtcccccggttaagtcccttacgtcccgtttaccccgttccccggtaccccttcccggtacctaccggtacctcgtaacccgg

SEQ ID NO: 257151 - DNA, 736 bp, Homo sapiens
  misc_feature: GYAE6OF01A4AJA.38.39.D06.1.454.CMB.1.raw
  modified_base (218)..(218): a, c, t, g, unknown or other
  misc_feature (218)..(218): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctcgtgtctggtctcctggacagtcgatcaccatctctgcacgtcgaaccagcaggtgtacgttggtagttaataatntgtctacgttacggtaaccaactactaccacctaaacactaccaacccgaaggaccaaaaccgtaccccctaaaactacctaaattaaacgtttactaggtacggtaacctaaccgttaaaccggtccccttacgtagggtaacttttactaacgttccgtcctttactccgtacggtacctaccgtaacgttccgtacggtaccaaaccgtaccggtccctacccgtacgaccctacgttcctacggtaccggtaccctacccgtaacgtaggaccgggaccggtacgtacctaccgttaacttagttaacgtcgctaacgtaccttaactaataacctaacgaacgcgtacgtccgttaagtacggtttcgggtacgggttccgggaaccgggttaacccggaccgttccgtacggtaccctagttaaccggccgaacgccgtacggccttaccccgggccctcggtactccgtcgttaccccgcccctacccgtctaccgacgttcgaccgtcgg

SEQ ID NO: 257152 - DNA, 845 bp, Homo sapiens
  misc_feature: GYAE6OF01A6860.38.39.D06.1.454.CMB.1.raw
  modified_base (228)..(228): a, c, t, g, unknown or other
  misc_feature (228)..(228): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctcgtgtctgggtctcctggacagtcgatcaccatctccgtgcacgtacggaaccagcaggtgtacggtttggtaggttaataaattnttggttcttcgttacggtaaccaacactaccaaccaaactactaccaacccgaaggaacctaaaacccgtaaccccaaactactaactttaaattttagtaggtaacggtactaaaccgtaaaccggtcccgttacggttaacggggttttacttaaccgttcgtcctttccttcgtcggtccttaaccgttaaggtttacgacccaaccgtccggtcccttcctacgtacctacgtttcggtaccggtccttccgaacggtcgtacgggagggtaaccggaggtacgtttaacgtttaatttttacgtcgttaccttacccttacttaaacgttaacttaaccggacgggtacctacggtaccgtaaccggacccctttaaccccgtttacggttccgtttaccggttaaccgggtaaccgggtcggtaacccgttaacgggtacccgtacccgtttaaccgaccgttaaccgacccggtaaaccccggtaaacccggtaccccctaaacccgtaccgttaccgtacccgttacccgttccccggttacccgttaccccccggcccttaaccccgttacgtaacgttacggtaacctccggtcccggtaccggggg

SEQ ID NO: 257153 - DNA, 312 bp, Homo sapiens
  misc_feature: GYAE6OF01EJN36.38.39.D06.1.454.CMB.1.raw
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (307)..(312): a, c, t, g, unknown or other
  misc_feature (307)..(312): n is a, c, g, or t
tcagtcgatcacgtcacgaccggtgctcgatttagtgacatctcgcagttctttgggttttggggggaagaggaagactgacggtcctgccacaggtgcttgctggtacctggggcgctatggacgtcgtgggccaaggaccacggtcaccgtctcctcagcctccaccaacgggcccatccggtccttccccgtggccgccctgctccaggcgcacctcgagagcacaggccgccctgggctgcctggtacaaaggtcctacttccgacgtgatcgactggagccgggntggacaaggcnaatagnnnnnn

SEQ ID NO: 257154 - DNA, 776 bp, Homo sapiens
  misc_feature: GYAE6OF01C6F7G.38.39.D06.1.454.CMB.1.raw
  modified_base (167)..(167): a, c, t, g, unknown or other
  misc_feature (167)..(167): n is a, c, g, or t
  modified_base (203)..(203): a, c, t, g, unknown or other
  misc_feature (203)..(203): n is a, c, g, or t
  modified_base (242)..(242): a, c, t, g, unknown or other
  misc_feature (242)..(242): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctcgccctgactcagcctgccctcgtgtcgtgggtcctcctggacngtcgactcacctatcctcctgccacgtacggaaccngcctagtcggtacggtttggtaggtttaaataaacgttnttcgtccttcgttacggtaaccaacctataccaaccaaactactacccaacccgaggaaccctaaaccgtaccccctaaacttactaattaattttacgtaggacgttaccaaccgtaaccgcccgtagaacggtttacgtttacgtaacttccgtacttctacgtcgtcctacgacgtcgagaccaccgaccgtcctaccgtacgcctctccgtgtcggtccctacccgtaacgtgaccggtacgcgtcctacgtaacttattacgtagacgtactactacgtaacttactaacgtacgacgttaccgtcgtttaccgtacgggttgggttaccgggtacgggtacgggaccggtacccggtaccgttaaccggtacccgttacgtaccggtcccgtaaccgggtacccgaaccggttcccgtacccccgggccccgtttaacccggtcccgtccccggtttccccgtttacccccgtttcccccggttccccttacccgttacggtaaccccgtgttaccccggtacccggg

SEQ ID NO: 257155 - DNA, 762 bp, Homo sapiens
  misc_feature: GYAE6OF01EELU9.38.39.D06.1.454.CMB.1.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
tcagtcgatcacgtcacgaccggtgctcgatttagtgacatctcgcagttctttggggactttgcctgggctctgctgctcctcaccctcctcactcagggcacgagggtcctgggcccagtctgccctgactcagcctgcctcgtgtctggtctcctggacagtcgatcaccatctctgcacgtgaaccngcagtgtacgttggtagttaataaatntgtctcgtacgtaaccaanatacaacaacactccaccgaggacctaaaccgtaccccaaactctaattaaatttacgaggtaacggtacaaccgtaaaccggtcctagaaggttactttacgtaatccgttacttctacgtggtacctaccgtaaggttcgtacggaccgtaaaccgtacccggtccccttacccgtacgtaacccttacgttttcccggtgggtacccttccgaacggtcgtaacgggaacgggtacggacgggttacttaacgtttaagtttttacgtcggttacccttcccttagtaaacgttacgtaacccggacgggtacctagtacccgtaccctacccgtttaacccgtttagttaccggtttacgtaacccggtaacgtacgggtaacctaacgggttccctaacgttcccgtaacgtccgaacccgtaaccgaacccgacccctaacccgtgttaacccgtacctaccgttcccgttacccgttacccccgtccctaccgttaccgcggttaccgtctacccggg

SEQ ID NO: 257156 - DNA, 530 bp, Homo sapiens
  misc_feature: GYAE6OF01BEGQY.38.39.D06.1.454.CMB.1.raw
  modified_base (236)..(236): a, c, t, g, unknown or other
  misc_feature (236)..(236): n is a, c, g, or t
  modified_base (245)..(245): a, c, t, g, unknown or other
  misc_feature (245)..(245): n is a, c, g, or t
  modified_base (278)..(278): a, c, t, g, unknown or other
  misc_feature (278)..(278): n is a, c, g, or t
  modified_base (296)..(296): a, c, t, g, unknown or other
  misc_feature (296)..(296): n is a, c, g, or t
  modified_base (336)..(336): a, c, t, g, unknown or other
  misc_feature (336)..(336): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttggtaccaanatcaccaanatcacccaggcaaagtccccaaatcataattangaggtcactaacggcctnaggagtttcaatcgcttctctcgctccaagtctggcaacncgcctcctgacctatctcgcggcctccgaaacctgacggacgagtctcgtactattatgacagtctacatactacaagcagcgtcacgttgggtgtcgggacggacggaccgtaccgtcggtaccgtcgttaggtccacgtcccaaggcctcggcccctggccactctccgtcccacctcctacacgtgatccg

SEQ ID NO: 257157 - DNA, 648 bp, Homo sapiens
  misc_feature: GYAE6OF01DU93Z.38.39.D06.1.454.CMB.1.raw
  modified_base (219)..(219): a, c, t, g, unknown or other
  misc_feature (219)..(219): n is a, c, g, or t
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
  modified_base (279)..(279): a, c, t, g, unknown or other
  misc_feature (279)..(279): n is a, c, g, or t
tcagtcgatcacgtcacgaccggtgctcgatttagtgacatctcgcagttctttggggactttgcctggctctgctgctcctcaccctcctcactcagggcacagggtcctgggcccagtctgccctgactcagcctgcctccgtgtctggtctaccgtggacagtcgatccacctatctcctgcactggaaccagcagtgacgttgtagttaataatntntcttacgtagacaacntacacaacnctcaccagacaacgtacccaaatcaataattangacgtcaactaacgcctagaggtacttctaacgtctacgttactcgtacggtctaccgtacgtctcggaaccaacgaccggtccctaccctagtacccagttccgtacgtcggaccctacgaacgtcgaaggactcgactcgaacttacttagtcgtactcgtcgtactaagtaataacgaacgacgacgtactacgtacggttcggttacgggtcggaccgggtacggaccgtaccgtacggttaccgttacgttacggtaccgaccgtcccgaaaccggttcctacccggtacccccgttggtaccctaccttcccgtaccccttaccccgtaccctacccgtacgtacccgtagtaaccgtaccgg

SEQ ID NO: 257158 - DNA, 477 bp, Homo sapiens
  misc_feature: GYAE6OF01DF47T.38.39.D06.1.454.CMB.1.raw
  modified_base (458)..(458): a, c, t, g, unknown or other
  misc_feature (458)..(458): n is a, c, g, or t
  modified_base (465)..(477): a, c, t, g, unknown or other
  misc_feature (465)..(477): n is a, c, g, or t
tcagtcgatcacgtcacgaccggtgctcgatttagtgacatctcgcagttctttggggactttgcctgggtgacgttggtggttataaatatgtctcttggtaccaacatcaccaacatcacccaggcaaacgtccccaaactcataatttatgaggtcactaaaccggccctcaggtagtttctaatcgtcttctctggcctccaagtctggcaacacggccctccctgaccatctcgtgggcctaccaacctggacggacgacggctcactattattgcagctcaatactacaagcacgcgtctacgtttggggtgttccgggcgggacggggaccaccgttggacccgttgttaggtcacgacccgaaggcctcgcccccgtcggtcacttcgtcgttccccgccctcctcgcgtcgcgtccgacgtgacgggccgggcgtacggacgacgggcncaatcgnnnnnnnnnnnnn

SEQ ID NO: 257159 - DNA, 826 bp, Homo sapiens
  misc_feature: GYAE6OF01EWU54.38.39.D06.1.454.CMB.1.raw
  modified_base (219)..(219): a, c, t, g, unknown or other
  misc_feature (219)..(219): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctcgtgtctgggtctcctggacagtcgatcaccatctcctgcacgtggaaccagcagtgacgttggtagttaataaatntgttctcttacggaccaacatacaaccaacactccaacccgaggacctaaaaccgtacccccaaaacttcaaattaattttagtacggtaacgggttaccaaaccgttaaaacccgggtccccttacgtaaggggttaacttttacctaaacgttccggtccttttccgtcgttcgggtaccttacccgtaaacgttccgtacggtaccaaacccggtacccgggtccctaccccttaggaccctacttccgtaccggtcgggtaccctacccgtaacgtggaacgggaaccgtacggtacctaccgtaactttaacgtttagttacgacgtacgtacctacgtaactaactaacgaacgtctaacgtccgttaccgttacggtttcggggttacgggttccgggggtacggggtaaccgggtaaccccgtacccggttacggtacccggttacggttaacggtacccggaacgtacccccggtaaacggtccccggttaacccggtccccccggtttacggtacccgttacccgttacccgttacccccggttacccccgttaccccgttccccgttacgtacccggttaccgtaccgttacccgg

SEQ ID NO: 257160 - DNA, 708 bp, Homo sapiens
  misc_feature: GYAE6OF01CKE6R.38.39.D06.1.454.CMB.1.raw
  modified_base (196)..(196): a, c, t, g, unknown or other
  misc_feature (196)..(196): n is a, c, g, or t
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
  modified_base (277)..(277): a, c, t, g, unknown or other
  misc_feature (277)..(277): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctccgtggacagtcgatcaccatctcctgcacgtcggaaccngcagtgtacgttggtagttaataaatntgtctnttgtacaacatcacaanatcaccgagacaacgtcccaatcataattangagtacaactaacgcctagtagtagttacaatcctcttctcgtcggctacgaagtcgacgacaaccgccggtaccctcccgtactaacctacttccgtccgttacgggccctaacccgtaacgtacggaacggaccgtacggtcctacctaacgttactttacgtacggactaggtacccttaacaacgttacgtaacgaacggtaccgtacgtccgtttacggtacggtttggggtaccggttacggggaccgggtaccgggaacccgttccggttacgggtaccctttacgggttaccggtaccgtaaccggacccgtaaccgggtcccgttccccggtccccgtttacgggtcccttacccgttcccgtttaccccggttaccccccacccggtttcccgacccgttacggtaccgtacgtacccggg

SEQ ID NO: 257161 - DNA, 710 bp, Homo sapiens
  misc_feature: GYAE6OF01EBAL4.38.39.D06.1.454.CMB.1.raw
  modified_base (222)..(222): a, c, t, g, unknown or other
  misc_feature (222)..(222): n is a, c, g, or t
  modified_base (253)..(253): a, c, t, g, unknown or other
  misc_feature (253)..(253): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgtacgtttggtagttaataaagtntcgtctcgttgtaaccaatacgtcaaccaanactccacccgaggaccaaacgtccccaaaactctaataattatgacgtacaacgtaaacggcctagacggtactttacgaagtcgtcttctacgtcggactacctaagtccgtacgaccgtaacgaccgggtcccttaccgttacgaaccctaacgtttccgttaccggttcggggtacccctttaacccggaaaccgttagggaaaccgggtaacggtacggtccttaacgtaacgtttaacttagttacgacgtacgtactacaagttactaacgagctagtccgtacgttacggttgggttacgtcgggtacgggacgggtaccgtacggttcgaccgtttcgttacggccgtaaccgtaccggtacgcccgttaccggccccgttacggtcctacgtttccctacccggtttcccccacccgtttcgtacccgtacgtccggtacgtacccgg

SEQ ID NO: 257162 - DNA, 769 bp, Homo sapiens
  misc_feature: GYAE6OF01EMOU6.38.39.D06.1.454.CMB.1.raw
  modified_base (203)..(203): a, c, t, g, unknown or other
  misc_feature (203)..(203): n is a, c, g, or t
  modified_base (229)..(229): a, c, t, g, unknown or other
  misc_feature (229)..(229): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtcctccgtggacagtcgactccaccatcctcctgcctacgtacggaaccngcagtgtacgttggtagttaataatntgttctcgttacggaaccaactactaccaaccaactactaccaaccccgaggaacctaaaaccggtaccccctaaactacctaattaatttaactggtacggtacctaaacccgtaaaccggccccttagacgggttagtttactaacttccgtcctttcgtcgtcggtcctaccgtaaacgttctcggacaaccgaccggtcctcccgtacgtaacctctctcgtcgggtccctacccgtaacgtcgaacgggtacgacgtctacacttaattacgtctctaacgtctaatagtaactaacgaacgtacacggtccgtacgtttaggttacggggttcggttaccggggacgggtaacccggggtacccgtacccggttccggtaacccggtttcggtaccggtacctaacccgggacccgtacgggttccccttacccggtccccccgggttacgtacccgttacccttccggttccccgtttcccccccggtaccttacccgtacccgtaccggttaccggtcccgttaacccgggg

SEQ ID NO: 257163 - DNA, 683 bp, Homo sapiens
  misc_feature: GYAE6OF01AT01O.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatatgtctcttggtaccaacatcaccaacatccacccaggacaaacgtccccaaactcacttaatttatgacggtcactaaaccggccctcaggtactttctaattcgcctttctctcggcttaccaagttctggcaaccgaccggtaccctcccgtcgaccctatcctcgtcgggtcctacccgaaccgtgaacggacgacggcctctacttattattgccacgctactaactattaacaacggtaccacggtccgtacctacggtttcggggttcgtttccggggaccgggtaaccggggtacccgtacccggttacgtacccggtttaccggttaacggttccgacgtaccccgtaaacgggtccgttacccggccccccgttacgggtccctacccgttcccgttacccggttccccccggtacccccttcccggttacccgccgggttccgttacgtacccggg

SEQ ID NO: 257164 - DNA, 740 bp, Homo sapiens
  misc_feature: GYAE6OF01EXN57.38.39.D06.1.454.CMB.1.raw
  modified_base (195)..(195): a, c, t, g, unknown or other
  misc_feature (195)..(195): n is a, c, g, or t
  modified_base (222)..(222): a, c, t, g, unknown or other
  misc_feature (222)..(222): n is a, c, g, or t
  modified_base (237)..(237): a, c, t, g, unknown or other
  misc_feature (237)..(237): n is a, c, g, or t
  modified_base (245)..(245): a, c, t, g, unknown or other
  misc_feature (245)..(245): n is a, c, g, or t
  modified_base (303)..(303): a, c, t, g, unknown or other
  misc_feature (303)..(303): n is a, c, g, or t
tcagtcgatcacgtcacgaccggtgctcgatttagtgacatctcgcagttctttggggactttgcctgggctctgctgctcctcaccctcctcactcaggcacagggtcctgggcccagtctgccctgactcagcctgcctccgtgtctgggtctcctggacagtcgatccacctatctcctgcacgtggaaccngcagtgtacgttggtagttaataaatntgtctctggtaccanatcaccanatcaccgagacaaacgccccaaatcaattaacttatagagtacaactaaaccggcctnaaggttactttacgtaactcgtacttcttcgtcggtctaccgtaagtcgtacggcctaaacgccggtccctaccctaggaacctagttccctcggtaccgggtacccttaccccgtaaaccgtcgggaacgggtaccgtacgggtaccctttacgaacctttagttacgttgaccgtaacgtactacttaataactaaccgtacgtacacgggtaccgttccgtaggtttcggggtacgggttccgggaacggggtaccgggtacccttaaccgtcggttaacccgttacgttacggccgtaaccccggtaccgtaaaccgggtccttaccccccgggtccccggttacggtaacccgtcccggttcccgttaccccgttaccccccgttccccgttcccgttaaccggtaccggttcccgtaacgttacccccggg

SEQ ID NO: 257165 - DNA, 730 bp, Homo sapiens
  misc_feature: GYAE6OF01AHATV.38.39.D06.1.454.CMB.1.raw
  modified_base (181)..(181): a, c, t, g, unknown or other
  misc_feature (181)..(181): n is a, c, g, or t
  modified_base (201)..(201): a, c, t, g, unknown or other
  misc_feature (201)..(201): n is a, c, g, or t
  modified_base (233)..(233): a, c, t, g, unknown or other
  misc_feature (233)..(233): n is a, c, g, or t
  modified_base (543)..(543): a, c, t, g, unknown or other
  misc_feature (543)..(543): n is a, c, g, or t
tcagtcgatcacgtcacgaccggtgctcgatttagtgacatctcgcagttctttggggactttgcctgggctctgctgctcctcaccctcctcactcagggcacgagggtcctgggcccagtctgccctgactcagcctgcctccgtgtcgtgggtcctccgtggacagtcgactcacctntcctctgacacgtggaaccngctaggtcgtacggttggtagttaataaagtnttcggttcttccgttaggtaaccaactacttcccgaaccaacactcccgaacccgaggtaaccaaccgtacccctaaaactcttaaattaattttacgaggtacggtacctaaccgtaaaccggtccctagtacgtagtttactacgttcctactttctcgtcggccttacgagtccgtacggaccaaccggtcccggtacccttacccgcggtaacctcttccgtggtaccgggtccttaccctaacggtcggtacggaccggagtcctactaacttgttactacgcacgtcttactagtacaacgacncggtactaccgtcttacgggttcgggttcgtaccggggaccgggtacggacccgtaccggttcggtaccgttaccgggtactccgacccggaccgtacggtcccgtaccccgttcccggtacgttaccctccgtttcccgtccccgtaccccgtacccgttcgtaaccgtcggtgtcccggtaccgg

SEQ ID NO: 257166 - DNA, 730 bp, Homo sapiens
  misc_feature: GYAE6OF01BJIIM.38.39.D06.1.454.CMB.1.raw
  modified_base (193)..(193): a, c, t, g, unknown or other
  misc_feature (193)..(193): n is a, c, g, or t
  modified_base (225)..(225): a, c, t, g, unknown or other
  misc_feature (225)..(225): n is a, c, g, or t
  modified_base (319)..(319): a, c, t, g, unknown or other
  misc_feature (319)..(319): n is a, c, g, or t
tcagtcgatcacgtcacgaccggtgctcgatttagtgacatctcgcagttctttggggactttgcctgggctctgctgctcctcaccctcctcactcagggcacagggtcctcgggcccagtctgccctgactcagcctgcctcgtgtcgtggtctcgtggacagtcatcacatctcctgcacgtacggaccngcgacgtgtacggttggtacgttaataaagtnttgtccgttctacggtaaccaactactaccaacctaacactaccaacccgaggtaacctaaacccgttacccaaactactaaatttaattaagngtaacggtaaccaacccgtaacggtccctagaacggttacgtttactaactccgtctttacgtcgtcgcctacgtagttcgcgactacgccgtacctcctacgacctgtcctacggtcggtaccctaccgtacgtacgggacgtaccgtcgtacctagtaccttaattcgtacacgtaacgtccgtaactaacttagtaaccgtaacgtcgtaacgtaccgtttacgttaaggggttccggcgggtttaccgggaaccgggttaccgggacccgtaccggtaccgttaccgtacggttaccggtaacgaccgtacgtaccggtccctacccggtccccggttaacgtccctaccgttacctttacccgtaccccttacccggtacctaccgtacggttccgtacgtacggg

SEQ ID NO: 257167 - DNA, 705 bp, Homo sapiens
  misc_feature: GYAE6OF01EZ8EI.38.39.D06.1.454.CMB.1.raw
  modified_base (220)..(220): a, c, t, g, unknown or other
  misc_feature (220)..(220): n is a, c, g, or t
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
tcagtcgatcacgtcacgaccggtgctcgatttagtgacatctcgcagttctttgggggactttgcctgggctctgctgctcctcaccctcctcactcagggcacagggtcctgggcccagtctgccctgactcagcctgcctccgtgtctgggtcctctggacagtcgatcaccatctcctgcacgtggaaccagcagtgtacgttggtgttaataatntcgtctcttggaccantcacaacntccaccaggcaaacgtaccccaaactcaataactttatagacggtacaacgtaaccggccctcgtaggtacgtttctaactccgtcttcctcgtcggcctaccgtaacgtcgtcggacctaaaccgaccggtcccttcccgtacgacctacgtccgttaccggtcgggtaccctaacccgaaccggtggaaccgggaacggtacggtccctactaaccttacgttaacgttcggtactacgtcctaactaactaactaacgaacgtcgtacggtccgtcgttaaccggttggggtccggttccggggacgggtacgggaccccgtacgttacggtacccgttcggttacggtccgacggtccccgaaaggtcccgtaccccgtcccggtacgggtaccctccggttcccgttacccggttccccctccccgttccgtaacccgcgttcggtcctacccggg

SEQ ID NO: 257168 - DNA, 729 bp, Homo sapiens
  misc_feature: GYAE6OF01E2T6J.38.39.D06.1.454.CMB.1.raw
  modified_base (226)..(226): a, c, t, g, unknown or other
  misc_feature (226)..(226): n is a, c, g, or t
  modified_base (246)..(246): a, c, t, g, unknown or other
  misc_feature (246)..(246): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtcctcctggacagtcgatcacctatcctctgcacgtcggaaccagctaggtgtacgttggttagttaataatntcgtctcgttagtaaccaanactaccaaccaacactaccaccgaaggaccaaaaccgtaccccaaactctaattaattataggtacgtacaaccgtaaaccggtccctacgtaggtacttactaactccgtctttctcgtacgctaccgaagtctacgaccaaccgccgccctcccgtacgacctacttcgtcgtcgggtaccctaccgacgtcgaggacgtcggtaccacgtattactagtcgacacgtctactaactaactaacggaacacgtacgtccgttaacggtaccggttttaggggtcgggttaccggggaccgggtacgggtaccccgtaaccgttcggttaacccgttacgggtttacggcccggaaccggtaccccgtaaaccggtcccgtacccccggtccccggttacgttccccgtaacccgtttacccttcccccgttaacccccggtacccccttacccgttaccgaacccgttgaccgttaccggg

SEQ ID NO: 257169 - DNA, 782 bp, Homo sapiens
  misc_feature: GYAE6OF01EFXPI.38.39.D06.1.454.CMB.1.raw
  modified_base (565)..(565): a, c, t, g, unknown or other
  misc_feature (565)..(565): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctcgtgtctgggtctcctggacagtcgatcaccatctcctgcactggaaccagcagtgtacgttggtagttaataaatatgttctcgttacggtaaccaactactaccaacctaacactacccgaaccccaagggtaacccaaaaccgtaccccctaaaacttacctaattaaattttaacgtaggtaacggtacctaaaccgtaaaacccggccccgttacgtaagggttacgttttacctaaacgtccgttacctttaccgttcgtcggtacctacccgtaaggttccgtacggaccaaacccgtacccgggtccccttcccctacgaaccctacttcccgtccggtcgggtaccctacccgtaaaccgtacggaacgggaccggaggtcctaactaacttagtttactcggactacgtctanaactactaacgagtccgaagtcgtacttacgggttgggtacgtcggggaccgggtacggtacccgtaccgttacggtacccgttagttaccgggtacccaccggtaacccgtacggtcccgttacccgtcccccggttgttacccgtacccttcccggttaccccgttaaccccccttcccctacttaccccggaacgttccggtactaacccgggg

SEQ ID NO: 257170 - DNA, 649 bp, Homo sapiens
  misc_feature: GYAE6OF01BJ4HX.38.39.D06.1.454.CMB.1.raw
  modified_base (207)..(207): a, c, t, g, unknown or other
  misc_feature (207)..(207): n is a, c, g, or t
  modified_base (295)..(295): a, c, t, g, unknown or other
  misc_feature (295)..(295): n is a, c, g, or t
  modified_base (357)..(357): a, c, t, g, unknown or other
  misc_feature (357)..(357): n is a, c, g, or t
  modified_base (480)..(480): a, c, t, g, unknown or other
  misc_feature (480)..(480): n is a, c, g, or t
  modified_base (593)..(593): a, c, t, g, unknown or other
  misc_feature (593)..(593): n is a, c, g, or t
  modified_base (602)..(602): a, c, t, g, unknown or other
  misc_feature (602)..(602): n is a, c, g, or t
tcagtcgatcacgtcacgaccggtgctcgatttagtgacatctcgcagttctttggggactttgcctgggctctgctgctcctcaccctcctcactcgagggcacgagggtcctgggcccagtctgccctgactcagcctcgccgtccgtgtcgtgggtcctccgtggacagtcgatccacctagtcctcctgcctacgcggaaccnggcaaggtgcggttggtagttaataatgtcgtctcttacgacactctacaacacactccaccgacgacaacctacctacatatacttnagcgacaaccgtaacgtcctagacgttacgttactacgtcgtcttcgtctgacctacgtacncggtacgaccgaactccggtaccctccggtacaaccctgtccgtaccggttccgacctaccgtacggcggtaacgcggtaaccgtctaaccgtattagtacgtacgctacgtacctaacttanaacgttaacgacgtaaccgtatcgttaacgggttcggttacgggttacggggtcgaccggggtaacggacccggtacgtcgttaacggtctaccggctaccgccgacgtcccncgtacccgngtacctccgaccgttcccgtaccctccctacgtcgtctgaccgtcgg

SEQ ID NO: 257171 - DNA, 916 bp, Homo sapiens
  misc_feature: GYAE6OF01EQUJI.38.39.D06.1.454.CMB.1.raw
  modified_base (91)..(91): a, c, t, g, unknown or other
  misc_feature (91)..(91): n is a, c, g, or t
  modified_base (201)..(201): a, c, t, g, unknown or other
  misc_feature (201)..(201): n is a, c, g, or t
  modified_base (233)..(233): a, c, t, g, unknown or other
  misc_feature (233)..(233): n is a, c, g, or t
  modified_base (259)..(259): a, c, t, g, unknown or other
  misc_feature (259)..(259): n is a, c, g, or t
  modified_base (381)..(381): a, c, t, g, unknown or other
  misc_feature (381)..(381): n is a, c, g, or t
tcagtcgatcacgtcacgaccggtgctcgatttagtgacatctcgcagttctttggggactttgcctgggctctgctgctcctcaccctcncactcagggcacagggtcctgggcccagtctgccctgactcagcctgcctcgtgtctgggtctcctggacagtcgatccaacctattcctcctgaccacgtacggaaccngctaggtgacggtttggtgtttaaataaaatntgttccttacgtttggtaaacccaanataccaacccaaaactacctaccaacccgacggaccgaaaccgtaccccaaaactactaataactttacttgacggtaccaacttaaaaccggcccctacgtaggtaacgttttactaaacnttttaccgctttacggtccttcgggtactcccctaagggttccctaacggggtaccgtaaaccctaacccgggtaccgttaccccctggtaccccgtaacgtaccggtacctaccggggaaccctttaccggaaaccccggtttacggaaacggggtacccttaagggggaccctttaaccgtaaccgtttaaacgtttaaccgtttaacgtacccgttaacggtaccttaccctaaacgttaacgtaaacccgtaaaacggaaccggttaaccggtaccggtttaccgggttaaccgggtttaccgggggttaaccgggggttaccgggggtacccggggtaacggggttaacccgggttaaccccggttaaccggtttaaccgggttaccggtttaccggttacccggaaccggtaccccggaacccgggtaccccggttacccggtacccccgttccccgggttcccgttacccggttccccgttacccgtttccccgtaccccgttccccggttaccggtaccggtaacgg

SEQ ID NO: 257172 - DNA, 821 bp, Homo sapiens
  misc_feature: GYAE6OF01CJ66D.38.39.D06.1.454.CMB.1.raw
  modified_base (184)..(184): a, c, t, g, unknown or other
  misc_feature (184)..(184): n is a, c, g, or t
  modified_base (203)..(203): a, c, t, g, unknown or other
  misc_feature (203)..(203): n is a, c, g, or t
  modified_base (256)..(256): a, c, t, g, unknown or other
  misc_feature (256)..(256): n is a, c, g, or t
tcagtcgatcacgtcacgaccggtgctcgatttagtgacatctcgcagttctttggggactttgcctgggctctgctgctcctcaccctcctcactcgagggcacagggtcctgggcccagtctgccctgactcacgcctcgcctccgtgtcgtcgggtcctccgtaggacagtcatccaactntctcctgctacgcggaacngcgagtcgtaggttggttagtaaataatagttcgtcttacgtagtaaaccaanactaccgaaccaactaccgtacccgaacccgaacggaacctaaaaaccctaacccctaaaacttaccttaaatttaaagttttaacgaggtaaccggtaaacctaaacccggtaaaccggtacccgttagtaaggttaccttttactaaccgtccttaccttcgttccgtcggtacctacgtaacgtcgtaccggaccaaccgtccggtccctaccggtcacccgtatccgtacggtcggtaccttacccgaacgagggtacgacgggtacctacgttaacttaacgttaacgttacgttacggaccttaacggtcttaaaccgtaactaacgtaaacgtaccgtaacgtcgttaccggtaggtttacggtttcggggtacggttccgggggaaccgggtacccgggtaaccgtaccggtaccgttacggtacgggttaccgtaaccggacgaccccgggtacggtcccgtaccccgtccccgggttaccctacggttcctttccccccggtaccgggttccccctacccgttcccgtaacccgtaggtcgggtcccgtaccggg

SEQ ID NO: 257173 - DNA, 736 bp, Homo sapiens
  misc_feature: GYAE6OF01EC5A0.38.39.D06.1.454.CMB.1.raw
  modified_base (540)..(540): a, c, t, g, unknown or other
  misc_feature (540)..(540): n is a, c, g, or t
tcagtcgatcacgtcacgaccggtgctcgatttagtgacatctcgcagttctttggggactttgcctgggctctgctgctcctcaccctctcactcagggcacagggtcctggcccagtctgccctgacctcagcctgcccttcgtgtcgtggtcctaccgtggactagtcgatcacctatctcctgaccacgtcggaaaccagcaggtcggtacggtttggttagttaaactaaagttactcggttccttacgtttaccggaaccaaactacttaccaaaccctaacgacttaccaaccgaacggaacctaaaaccgtacccctaaactactaaagttaattactaggtaacgtaccaaaccgtaaccgtccgtagtaaggttacgttactaacgtcgttacttctcgtcgtactaccgtacttcgacgaaccaaccgtacgtcccctacctagacctatcctcgacggtacctaccgaacgtaggaacggaaccgacgtactactacgttattacgtacgacacgtactaataactanaactaacgacgagttacgtacgttaggttacgggtcggttacgggaccgggtaacgggtacccgtaacgtacggtaccgtttaacggtacggacctaacggaccgtaccggtcctccggtaccccgttacgtacccgtacctttaccgtcccgttaaccccttaccccgtacgtaccgtacggttagccgttacgg

SEQ ID NO: 257174 - DNA, 753 bp, Homo sapiens
  misc_feature: GYAE6OF01AMVKA.38.39.D06.1.454.CMB.1.raw
  modified_base (399)..(399): a, c, t, g, unknown or other
  misc_feature (399)..(399): n is a, c, g, or t
tcagtcgatcacgtcacgaccggtgctcgatttagtgacatctcgcagttctttgggggactttgcctgggctctgctgctcctcaccctcctcactcagggcacgagggtccctgggcccagtctgccctgactcagcctgccctccgtgtcgtgggtcctccgtgacagtcgatcaccatcctcctgcacgtacggaaccacgcgtaggtgtacggtttggtaaggttaattaaacttattcgttcttcgttacggtaaccaactactaccaacctaactacctaccaacccgtacggaacctaaaccgacccctaaactactaacttaatttagacggtaacgtaccaaaccgtaaaccggtcctacgaggttactttaccgtaactcgtccttcncgtcggtacctacgtacgtcgtacgacgaccgaccggtcctacccgtcgacctactccgtacgtccggtacctaccgtaccgaaggacggaacggcgtctaccgtaactttagttacgtacgacgtacgcctacgtaacttaacgactaaaccgacgtacggtctacggttacggttcgggttacgggtccggggaacgggtaccgggtaccggtaccgttacgtacccggttacgtacggaccggtaccgtaaccggcggtacccgtcccggtacccggtaccgtcccgttaccgttcccgtaccccgttccccgtacccgttcgtacccgttacggtccgtcggttacccgg

SEQ ID NO: 257175 - DNA, 1102 bp, Homo sapiens
  misc_feature: GYAE6OF01EHRDZ.38.39.D06.1.454.CMB.1.raw
tcagtcgatcacgtcacgaccggtgctcgatttagtgacatctcgcagttctttggggactttgcctgggctctgctgctcctccacccctcctcactcgacgggcacgacgggttcctcgggcccagtcctcgccctgacctcacgcctgcccgtcgtgtcgtcgggtcctccgtaggactaggtccgactaccacctattcctccgtgacctacgtacggaaccagtcgtacggtcggttacggtttaggttaagtttaaattaaattgttccgttacgttccgttaaccggtaaccaactacttaacccaaacctaacgtacctacccgaaccggaacgtaaacccctaaacccgtaaccccctaaaattaccgttaaattttaaacgtttacgtagggtaaccgtaaccccgttaaaccccggtaaaacccggttccctaaaccggggttaacgggtttaacctttttaacccggtaactttcccggtttccccgttttacgttaacccgggtttacccggtaccccgtttaaacccggttaacgttacccgggtaaacccggtaaccctaaaacccccggggttccccttacccccggtttacccggttaaccggaaaccccttttacggtttaccccggttaacgggttaccccgggtaaccccccgttttaaacccggaaccccggtttaagggggaaccgggggttaaccccggaacgggtttaccccttaacgttttaacgtttaacggtttacgtacggttaccgtacgtaacttaacgtaacgtaacgttaccggaacgacccggttacgttaccgttacgggtttacgggtttaccggggttacggtaaccgggggtacccggggtaaccggtaccccgggttaacccggtttaccgggttacccgttacgggtaacccggtaacccgacccggtaaccccggttaaccgggtccccggttccccccgggttacccccggtaccggttttaccccgacccgggttttcccccttacccccccgggtttccccctaccccggtttaaccccgggaccgttttacccggtccgggttacccctaaccggggg

SEQ ID NO: 257176 - DNA, 793 bp, Homo sapiens
  misc_feature: GYAE6OF01BVD1S.38.39.D06.1.454.CMB.1.raw
  modified_base (177)..(177): a, c, t, g, unknown or other
  misc_feature (177)..(177): n is a, c, g, or t
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctcgtgtcgtcggtctccgtggacagtcgatccaccntctcctgcactacggacagcagtgtacgttggtagttaataatntgtctctgtaaccantacacaactctcaaccagacaaccgtacccaaactctaattaattagtggacggtacaacgtaaccgcctagtaggtactttacgaagtcctcttcgtactggtcctacgtactcgtacgaccgtaacgaccggtaccctccgtacactacgtccgtacggtcgggaccctacccgtaacggtacggaacgggtaccgacgggtacctacggtaacctttagtacgttacggaccaacggttcctaacaacgtttaacgtaaccgaaaccgggtacctaaacgggttcccgtttaaacggttccgggtttacggggtttaaccgggttaccgggggtaacccggggttaaacccgggtaaccccggtaaccggtttaccggggttaaccccgggtttaaccggtttacggtcccgggtaaaacccgaccccggttaaaccgggtcccgtttacccccggtacccccggttacgtaccccgttacggttaccccgttccccggttaacccccgttcccgttacccgtacccggtacggttccgtaccggttacccggg

SEQ ID NO: 257177 - DNA, 881 bp, Homo sapiens
  misc_feature: GYAE6OF01BXEYG.38.39.D06.1.454.CMB.1.raw
  modified_base (186)..(186): a, c, t, g, unknown or other
  misc_feature (186)..(186): n is a, c, g, or t
  modified_base (202)..(202): a, c, t, g, unknown or other
  misc_feature (202)..(202): n is a, c, g, or t
tcagtcgatcacgtcacgaccggtgctcgatttagtgacatctcgcagttctttggggactttgcctgggctctgctgctcctcaccctcctcactcgaggcacgagggtccctgggcccagtctgccctgactcacgcctcgcctcgtgtcgtggtcctcctggacagtcgatcacctatcctcncgcacgtacggaaccngcaggtgacgtttggtaggttaaataaactgtcgttccgtaccgtacggtaaacccaaacgaacctacccgaacggaaccaaaacccgtaccccctaaaacgtctaacttacctaagttttaacgtcgaaccgttaccaccttcgtaaccgttccccgggtaccctttacgggttacggggttttccctaaccgttccggttccttccgttccgtacggtccttaaccggttaacggtttcgaaccgtaaaccgtcccgggttacccttaccccgtacgttaaccgttaccgtttccgggtaccggtacccgtccggtaacgggtccgtaacgggaacgggtacgggtaaacgttcgtttaaagtttaactttacggttccgttacccctactaacgtaacgttaacgtaacggacgtacgaaccgtaccctaacccgttacccgtttaaacccttacggtttcccggttaaccggttaacgggaacgttaacccgggaacgtaaaccggttcccgtaacccggttaccgtaaccgtacccgtaacgtaacccccgaaccggaccccttaaccctacggttaccctaccgttaacccgtttcccgtacccggttaccccctacccgttaccgtaccgtacggttaccgtacgtccgtaacgtcggtccgggtaaccggg

SEQ ID NO: 257178 - DNA, 846 bp, Homo sapiens
  misc_feature: GYAE6OF01A7X4Q.38.39.D06.1.454.CMB.1.raw
  modified_base (176)..(176): a, c, t, g, unknown or other
  misc_feature (176)..(176): n is a, c, g, or t
  modified_base (189)..(189): a, c, t, g, unknown or other
  misc_feature (189)..(189): n is a, c, g, or t
tcagtcgatcacgtcacgaccggtgctcgatttagtgacatctcgcagttctttggggactttgcctgggctctgctgctcctcaccctcctcactcaggcacagggtcctgggcccagtctgccctgactcagcctgcctcgtgtctgggtctcctggacagtcgatcaccatcnctgcatggaaccngcagtgacgttggtagttaataaatagtgttctcgttaggtaacccaaacgtactaccaaaccaaacctactaccgaaaccccgaacgggaacctaaaaaaccggtaacccccctaaaaacgttacctaaaactttaaaatttttaaacgtacggtaacgggttaaccctaaaacccgttaaaaaaccccgggggtcccccttaaccggtaaaggggtttaacggttttttaaccctaaaacgtttcccgtacccgtttttaccgtaccgttacgggtaccctttaaccccgttaaaagtccgtaacggtacccgtaaacccaaccgggtccccttaccccgtaccgtaaccctaacgttccgtacggtacggggtaccctaaccctaaaccccggttagggaaccggaacggtaacggtacgtactaaacttagttaacttacgacacgtactactaagtaactaacgaagtcgtacgacgtctacggttcgggtacggttcggaaccggggtaacggaaccgtacccgtagtaacccggttcgttaacgggtccaacggtacccgagtcccgtcccgtaccccgtcgttaccaccgtttccgtacccggttccccccgtacccttccgttacccgaagttccggtaccgtaccgg

SEQ ID NO: 257179 - DNA, 793 bp, Homo sapiens
  misc_feature: GYAE6OF01B7UXT.38.39.D06.1.454.CMB.1.raw
  modified_base (209)..(209): a, c, t, g, unknown or other
  misc_feature (209)..(209): n is a, c, g, or t
  modified_base (257)..(257): a, c, t, g, unknown or other
  misc_feature (257)..(257): n is a, c, g, or t
  modified_base (269)..(269): a, c, t, g, unknown or other
  misc_feature (269)..(269): n is a, c, g, or t
  modified_base (539)..(539): a, c, t, g, unknown or other
  misc_feature (539)..(539): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcacgcctgccttcgtgttcgtcggtcctccgtggactagtcgactaccacctactcctcctagccacgtacggaccngcaggtgtacggttggttagttaataaatgtcgttcgtactgaaccanactaccacaacnctaccaaccgacgacctaaaccgtaccccaaattactaaatttaacgttataacggtacgtaaccgtaaaccgtaacccggtccttaacggaggtttactttaacgtacgttcgtaccttccgtcgtcggtacctaaccgtacgttcgtaacggaccgtaaacccgtaccggtccctacccggacgtaaccgtaccttccgtccggtaaccggtacccgtaaccgtaaccggtaaggtaccggacggtacgtcctacgtactttaacgtnttacgactacgccttaataactacgtaacgacgtacgcgtacgtacggttacggttcgggttgacccgggtaggaccgggtaccgtaaccggtaccgttaccggttaccgtacggtaccggaccgtacccggtacccggtaccggttcccccgtcccgggttaccctcccggtttaaccccgttacccggtttcccccgtaccccggttccccgtacccccgttaaccggtaccgtagttaacccggtaccggg

SEQ ID NO: 257180 - DNA, 761 bp, Homo sapiens
  misc_feature: GYAE6OF01BO3K8.38.39.D06.1.454.CMB.1.raw
  modified_base (181)..(181): a, c, t, g, unknown or other
  misc_feature (181)..(181): n is a, c, g, or t
  modified_base (202)..(202): a, c, t, g, unknown or other
  misc_feature (202)..(202): n is a, c, g, or t
tcagtcgatcacgtcacgaccggtgctcgatttagtgacatctcgcagttctttggggactttgcctgggctctgctgctcctcaccctcctcactcgagggcacgagggtcctcgggcccagtcctgccctgactcacgcctgccctcgtgtcgtggtctccgtggacagtcgactcacnctcctctgctacgtacgaacngctaggtcgtacggttggttacgttaataaattgttcgtcttacgtacggtaccaatacaccaactacgtactccaaccgtaacggaacctaaacccgtacccccaaaacttacgttaaacttaaagttttagtacggaacggttaccctaaaacccgtaaaccgtccctaaggtacggttacgtttacgtaacgttccgtactttctcggtacgtcctacgtacggttcgtacgacgtaaccgtcccggtcctacccgtaccgaacctcgttcgtccgtacgggtaccctaaccgtacggtaggacgggtaacgaccggttccttaactttaaacgttcgtttaagtcgtacccgtagttaccctaaagttaacgtaaccgactaaggtccgtaacgtccggttacggttacggttcgggtccggttaacgggacggttacggacccgttaccgttcgacggtttccgtagtacgacccgacggttaccgccgtccccgttacgtacgtaccttcgtaccccgtcctaccccgtcgtacctagccgtcgtcggtaccg

SEQ ID NO: 257181 - DNA, 808 bp, Homo sapiens
  misc_feature: GYAE6OF01D03VO.38.39.D06.1.454.CMB.1.raw
  modified_base (237)..(237): a, c, t, g, unknown or other
  misc_feature (237)..(237): n is a, c, g, or t
tcagtcgatcacgtcacgaccggtgctcgatttagtgacatctcgcgagttctttggggactttgcctgggctctgctgctcctcacctcctcactcagggcacagggtcctgggcccagtctgcctgactcagcctgcctccgtgtcgtggtctccgtggacagtcgatcacatctctgctactggaaccagcagtgacgttggtaggttataaagtatgtctcttcggtaccaantacacaacataccaaccgtagactaacgtaccccaaacgtctaattaatttagtgaacggtcaactaaacggtccctagtacggtacgtttactaacgtccgtcgtttcctcgtacgctaccgtaaggtctcgacacgaccggtccctaccctacgaacctacttcgtacctcggggtacctaccgaccgttacgacgggaaccgtacgggtacttaccgtaacgtttacgtttacgttacggtacctacgttaccgtaccgttaaacttaacgtaaccggttaacggaaccgtaccgggttaccgttacccggttaaccggttttacgggggttacggtttacccggggaccgggggtaaaccgggttcccccgggaaaccgttcgggtaacccccgggttttaaggtttacccgggtacgttaacccgggtacccgtaaaccggggttacccgtaccccggtaccccccgttacgggttaccccgttaccctttaccccggtttacccggttacccccgttcccccgttaccctaccggtttaccccggtacggtccgtttaccccggg

SEQ ID NO: 257182 - DNA, 811 bp, Homo sapiens
  misc_feature: GYAE6OF01AUXY1.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctcgcactaggaaccagcacgtgtacgttggttaggttaataaattatcgttcttcttacgggtaaccaactattaccgaacaacacttccaaccccaggacctaaacgtaccccaaaactactaacttaatttagtacgtaacggtacaaccgttaaaacccgggcccttacgtaaggtacgttttacctaacgttccggtacctttacgtccgtcggtcctaccgtaacgtcgttcggaccaaacgaccggtccctacccgtacggaccctactacccgttcgtccgggtacctacccgaaccgtacgtacgggaaccggacgggtaccctactaaccttaagtttaacgttcgaccgtaacggtacctaacgtaaactaagttaacccgaaaggtaccgtacgggtaacccgttacgtttaccgggtttacgggttcggttaccggggtaccgggtaacggggtaccccgtaaccgttacggtacccgtttacgtacccgggttaacaccccggttaccggaaaccgttcccgtacccggtaccccccggttaggtcccgtaaccgttcccggtcctttaccccccgtacccgttcccgtaacccgtaccgtccggttaactacccggg

SEQ ID NO: 257183 - DNA, 510 bp, Homo sapiens
  misc_feature: GYAE6OF02JB1SC.38.39.D06.1.454.CMB.1.raw
  modified_base (507)..(507): a, c, t, g, unknown or other
  misc_feature (507)..(507): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaacctgaggacgaggctcactattatgcagctcatatacaagcagcgtcacttgggtgttcggcggagggaccgaccgtgaccgtctacggtcagcccagctcgcccctcggtcactctcgttcccgcctcctcacgtgntcg

SEQ ID NO: 257184 - DNA, 195 bp, Homo sapiens
  misc_feature: GYAE6OF02H88T0.38.39.D06.1.454.CMB.1.raw
  modified_base (162)..(195): a, c, t, g, unknown or other
  misc_feature (162)..(195): n is a, c, g, or t
tcagtcgatcacgtcacgaccggtgctcgatttagtgacatctcgcgagttcgtttgggggaagaggaagactgacgggtcctgccacagcggccctgggctgcctggtcaacggtactacttccacgtgatcgactggagcgggctggcaaggcgcatagnnnnnnnnnnnnnnnnnnnnnnnnnnnnnnnnnn

SEQ ID NO: 257185 - DNA, 569 bp, Homo sapiens
  misc_feature: GYAE6OF02H7I59.38.39.D06.1.454.CMB.1.raw
  modified_base (235)..(235): a, c, t, g, unknown or other
  misc_feature (235)..(235): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaanatcaccaacatcacccaggcaaagtccccaaactccataatttatgaggtcactaaacggccctcaggagtttctaatcgcttctctggctccaagtctggtcaacacggcctccctgaccatctctgggctccaacctcgaggacgaggctcactattatgcagctcatatacaagtcagcgtcacttcgggtgtttccgggcggtacggaccgacctcggtaccgttcgttaaggtcacgtcccaacgggtcctacggcccccgttacggttccacccgttccgtcgtttacccctaccccgttcccgttcccaccggttcggattacccgg

SEQ ID NO: 257186 - DNA, 419 bp, Homo sapiens
  misc_feature: GYAE6OF02H4VNC.38.39.D06.1.454.CMB.1.raw
  modified_base (407)..(407): a, c, t, g, unknown or other
  misc_feature (407)..(407): n is a, c, g, or t
  modified_base (412)..(419): a, c, t, g, unknown or other
  misc_feature (412)..(419): n is a, c, g, or t
tcagtcgatcacgtcacgaccggtgctcgatttagtgacatctcgcagttctttggggactttgcctgggtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaacctgaggacgaggctcactattattgcagctcatatacaagcagcgtcacttgggtgtttcggcggagggaccgacctgaccgtcttaggtcagcccaaggctgccccctcggtcactctgtccccgcctcctcacgtgactcgactgagcgggctggcaaggcncatgnnnnnnnn

SEQ ID NO: 257187 - DNA, 465 bp, Homo sapiens
  misc_feature: GYAE6OF02H58EK.38.39.D06.1.454.CMB.1.raw
  modified_base (403)..(403): a, c, t, g, unknown or other
  misc_feature (403)..(403): n is a, c, g, or t
  modified_base (429)..(429): a, c, t, g, unknown or other
  misc_feature (429)..(429): n is a, c, g, or t
  modified_base (433)..(435): a, c, t, g, unknown or other
  misc_feature (433)..(435): n is a, c, g, or t
  modified_base (437)..(465): a, c, t, g, unknown or other
  misc_feature (437)..(465): n is a, c, g, or t
tcagtcgatcacgtcacgaccggtgctcgatttagtgacatctcgcgagttcctttggggactttgccctgggtgagtgttggtggttataaatatgttctcttggtaccaacatcaccaacatcacccaggcaaagtccccaaacctcataatttatgaggtcactaaacggccctcaggagtttctaatcgcttctctggctccaagtctggcaacacggcctccctagacccgatctctgggctccaacctgaggacgaggtctcgacttattattgcagctcatatacaaggcagccgtcacgttggggtcgttcggcgggacgggaccgaccgtgaccgtcgttaaggtcagcccaaggctcgcccctcggtccactctcgtcccgccctctcacgtnactcgactgacgcggctggcaggcanatgnnncnnnnnnnnnnnnnnnnnnnnnnnnnnnnn

SEQ ID NO: 257188 - DNA, 516 bp, Homo sapiens
  misc_feature: GYAE6OF02ITI0M.38.39.D06.1.454.CMB.1.raw
tcagtcgatcacgtcacgaccggtgctcgatttagtgacatctcgcgagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtcccccaaaactcataatttatgaggtcactaaaacggccctcaggagtttcaatcgcttctctggctccaagtctggcaacacggcctccctgaccatctctggctccaacctgaggacgaggctcatattattgcagctcatatacaagcagcgtcactttgggtgttcggcggagggaccgactgaccgtcttaggtcagtcaggctacgcccctggtcactcttgttcccgccttcctcgaccgtgatccgg

SEQ ID NO: 257189 - DNA, 157 bp, Homo sapiens
  misc_feature: GYAE6OF02GUP0V.38.39.D06.1.454.CMB.1.raw
  modified_base (156)..(157): a, c, t, g, unknown or other
  misc_feature (156)..(157): n is a, c, g, or t
tcagtcgatcacgtcacgaccggtgctcgatttagtgacatctcgcagttctttgggggaagaggaagactgacgatcctgccacagcggccctgggctgcctggtcaaggactacttccacgtgatcgactgagcgggctggcaaggcgcatagnn

SEQ ID NO: 257190 - DNA, 298 bp, Homo sapiens
  misc_feature: GYAE6OF02IMC27.38.39.D06.1.454.CMB.1.raw
  modified_base (289)..(298): a, c, t, g, unknown or other
  misc_feature (289)..(298): n is a, c, g, or t
tcagtcgatcacgtcacgaccggtgctcgatttagtgacatctcgcagttctttgggtttgggggtaagaggaagacgtgacggtcctgccacaggtgcttgctggtacctggggcgctatggacgtctggggccaagggaccacggtcaccgtctcctcagcctcaccaaggcccatcggtctcccctggcgccctgctccaggagcacctccgagagcacagcgcctgggctgcctggtcaaggctacttccacgtgatcgactgagcggctggcaaggcgcatagnnnnnnnnnn

SEQ ID NO: 257191 - DNA, 300 bp, Homo sapiens
  misc_feature: GYAE6OF02HACHV.38.39.D06.1.454.CMB.1.raw
  modified_base (289)..(289): a, c, t, g, unknown or other
  misc_feature (289)..(289): n is a, c, g, or t
  modified_base (295)..(300): a, c, t, g, unknown or other
  misc_feature (295)..(300): n is a, c, g, or t
tcagtcgatcacgtcacgaccggtgctcgatttagtgacatctcgcagttctttgggttttgggggaagaggaagactgacggtcctgccacaggtgcttgctggtacctggggcgctatggacgtctggggccaagggaccacggtcaccgtctcctcagcctccaccaagggcccatcggtcttcccctggcgccctgctccaggagcacctccgagagcacagcggccctgggctgcctggtcaaggactacttccacgtgatcgactgagcgggctggcaaggcncatagnnnnnn

SEQ ID NO: 257192 - DNA, 300 bp, Homo sapiens
  misc_feature: GYAE6OF02F7XIC.38.39.D06.1.454.CMB.1.raw
  modified_base (293)..(300): a, c, t, g, unknown or other
  misc_feature (293)..(300): n is a, c, g, or t
tcagtcgatcacgtcacgaccggtgctcgatttagtgacatctcgcagttctttgggtttgggggaagaggaagactgacggtcctgccacaggtgcttgctggtacctggggcgctatggacgtctggggccaagggaccacggtcaccgtctcctcagcctccaccaagggcccatcggtcttccccctggcgccctgctccaggagcacctccgagagcacagcggccctgggctgcctggtcaaggctacttccacgtgatcgactgagcggctggcaaggcgcatagnnnnnnnn

SEQ ID NO: 257193 - DNA, 513 bp, Homo sapiens
  misc_feature: GYAE6OF02FWBWX.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaaacggccctcaggagtttctaatcgcttctctggctccaagtctggcaacacggcctccctgaccatctctgggctccaacctgaggacgaggctcactattattgcagctcatatacaagcagcgtcacttgggtgttcggcggagggaccgacctgaccgtcttaggtcagcccaggctcgcccctcggtcactctgttcccaccttcctcacgtgatccg

SEQ ID NO: 257194 - DNA, 524 bp, Homo sapiens
  misc_feature: GYAE6OF02FV9QJ.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaaacggccctcaggagtttctaatcgcttctctggctccaagtctggcaacacggcctccctgaccatctctgggctccaacctgaggacgaggctcactattattgcagctcatatacaagcagcgtcacttgggtgttcggcggagggaccgaccgtgaccgtcttaggtcagcccaggcctcgccccctcggtccaccgttctcgttcccaccctcctcaccgtcgatccgg

SEQ ID NO: 257195 - DNA, 521 bp, Homo sapiens
  misc_feature: GYAE6OF02INGKQ.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtccctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctcctgaccatctctgggctccaactgaggacgaggctcactattattgcagctcatatacaagcagcgtcacgttgggtgttcggcggacgggaccgaccgtcgaccgttcgttacggtcagcccgaggcctcgcccctcggtcactctcgttcccaccctcctcacgtgatccg

SEQ ID NO: 257196 - DNA, 609 bp, Homo sapiens
  misc_feature: GYAE6OF02IW82Q.38.39.D06.1.454.CMB.1.raw
  modified_base (245)..(245): a, c, t, g, unknown or other
  misc_feature (245)..(245): n is a, c, g, or t
  modified_base (446)..(446): a, c, t, g, unknown or other
  misc_feature (446)..(446): n is a, c, g, or t
tcagtcgatcacgtcacgaccggtgctcgatttagtgacatctcgcagttctttggggactttgcctgggctctgctgctcctcaccctcctcactcgagggcacagggtcctgggcccagtctgccctgactcagcctgcctccgtgtctgggtctcctggacagtcgatcaccatctcctgcactggaaccagcagtgacgttggtggttaataaatatgtctcttggaccaacatcaccaanatcaccaggacaaacgtaccccaaactcaataatttatgagtacaactaaacggccctacaggtacgtttactaatcgtcttctctcggctaccaagtctggcaacgacgcctccctgaaccatcctcgtcgggtacctcccaaaccgtggacggaacgaggcctctaacttatttaacttgcgacgctacatataacaancaacgcgtactacgttgggtcgttcggagggacggaccgacgtacgtaccgtcgttacggtacacgacccgaacggtccgtaccgcccccggtcggtacctaacccgttccgttccgttaccccctaccccttcccgtcgtaccggttacgtacgttacccgg

SEQ ID NO: 257197 - DNA, 304 bp, Homo sapiens
  misc_feature: GYAE6OF02IAO93.38.39.D06.1.454.CMB.1.raw
  modified_base (296)..(304): a, c, t, g, unknown or other
  misc_feature (296)..(304): n is a, c, g, or t
tcagtcgatcacgtcacgaccggtgctcgatttagtgacatctcgcagttctttgggttttggggggaagaggaagactgacggtcctgccacaggtgcttgctggtacctggggcgctatggacgtctggggccaagggaccacggtcaccgtctcctcagcctccaccaagggcccatcggtcttccccctggcgccctgctccaggagcacctccgagagcacagcggcctgggctgcctggtcaaggactacttccacgtgatcgactgagcgggctggcaaggcgcatagnnnnnnnnn

SEQ ID NO: 257198 - DNA, 504 bp, Homo sapiens
  misc_feature: GYAE6OF02HF1XS.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgagtcactaaacggccctcaggagtttctaatcgcttctctggctcaagtctggcaacacgcctcctgaccatctctggctccaactgagacgagctcactattatgcagctcatatacaagcagcgtcacgttggtgttcggcggagggaccgacctgaccgttcgttaggcacgcccagctcgcccctcggtcactctcgttcccgcctcctcacgtcgatcg

SEQ ID NO: 257199 - DNA, 531 bp, Homo sapiens
  misc_feature: GYAE6OF02IJGLP.38.39.D06.1.454.CMB.1.raw
  modified_base (278)..(278): a, c, t, g, unknown or other
  misc_feature (278)..(278): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtcccaaactcataatttangagtcaactaaacggcctcaggagtttctaatcgcttctctggctccaagtctggcaacacggcctccctgaccatctctgggctccaactgaggacgaggctcgactattatgctagctcaatataacaagcagcgtcacgttgggtgttcgggcggacgggaccgaccgtcgaccgtcgttaggtccagacccgaaggctacggcccctcggtcacctcgtcgttcccgccctcctccacggtcataccgg

SEQ ID NO: 257200 - DNA, 297 bp, Homo sapiens
  misc_feature: GYAE6OF02HVPB3.38.39.D06.1.454.CMB.1.raw
  modified_base (295)..(297): a, c, t, g, unknown or other
  misc_feature (295)..(297): n is a, c, g, or t
tcagtcgatcacgtcacgaccggtgctcgatttagtgacatctcgcagttctttgggttttgggggaagaggaagactgacggtcctgccacaggtgcttgctggtacctggggcgctatggacgtctggggccaagggaccacggtcaccgtctcctcagcctccaccaagggcccatcggtcttccccctggcgccctgctccaggagcacctccgagagcacagcggccctgggctgcctggtcaaggactacttccacgtgatcgactgagcggctggcaaggcgcatagnnn

SEQ ID NO: 257201 - DNA, 531 bp, Homo sapiens
  misc_feature: GYAE6OF02FFTCR.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtcccaaactcataatttatgaggtcactaaacggccctcaggtagtttctaatcgcttctctggctccaagtctggcaacacggcctccctgaccatctctgggctccaacctgagacgaggctcactattattgcagctcatatacaagcagcgtcacttgggtgttcggcggagggaccgaccgtgaccgtcttacggtcacgcccaggcctcggccccctcggtcctactcctcggttccccgcccttcctccaccggttcgactcccgg

SEQ ID NO: 257202 - DNA, 533 bp, Homo sapiens
  misc_feature: GYAE6OF02G0CLM.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaaacggccctcaggagtttctaatcgcttctctggctccaagtctggcaacacggcctccctgaccatctctgggctccaactgaggacgagctcactattatgcagctcatatacaagcaagcgtcacttgggtgttcgggcggagggacccgaccgtggacccgtcgtttacggcacgcccgaaggcctcggcccccgtcggtccacctcctcgttccccgccctcctccacgtgactccgg

SEQ ID NO: 257203 - DNA, 310 bp, Homo sapiens
  misc_feature: GYAE6OF02IWN0D.38.39.D06.1.454.CMB.1.raw
  modified_base (294)..(310): a, c, t, g, unknown or other
  misc_feature (294)..(310): n is a, c, g, or t
tcagtcgatcacgtcacgaccggtgctcgatttagtgacatctcgcagttctttgggttttgggggaagaggaagactgacggtcctgccacaggtgcttgctggtacctggggcgctatggacgtctggggccaagggaccacggtcaccgtctcctcagcctccaccaagggcccatcggtcttcccctggcgccctgctccaggagcacctccgagagcacaggcggccctgggctgcctggtcaaggctacttccacgtgatcgactgagcggctggcaaggcgcatagnnnnnnnnnnnnnnnnn

SEQ ID NO: 257204 - DNA, 532 bp, Homo sapiens
  misc_feature: GYAE6OF02G5P7O.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaatcataatttatgaggtcactaaacggccctcaggagtttctaatcgcttctctggctccaagtctggcaacacggcctcctgaccatctctgggctccaacctgaggacgaggctcactattatgcagctcatatacaagcagcgtcacttgggtgttcggcggagggacccgaccgtgaccgttcgttaggcacgcccaggcctcggcccccgttcggtccacttcctcgttccccacccgttcctccaccggttcgactccgg

SEQ ID NO: 257205 - DNA, 557 bp, Homo sapiens
  misc_feature: GYAE6OF02HDIYF.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaatcataatttatgaggtcactaaacggccctcaggagtttctaatcgctttctctggctccaagtctggcaacacggcctccctgaccatctctggcctccaacctgaggacgaggctcactattatgcagctcatatacaagcagcgtcacgtttgggtgttcgggcgggacgggacccgaccgtcgacccgttcgttacggtcacgcccgaacggtcctccggcccccgttcggtccaccgttccgtccgtttcccccgcccttcccgtccgtaccgttcgacttccgg

SEQ ID NO: 257206 - DNA, 514 bp, Homo sapiens
  misc_feature: GYAE6OF02GKXWB.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataattatgaggtcactaaacggccctcaggagtttctaatcgcttctctggctccaagtctggcaacacggcctccctgaccatctctgggctccaacctgaggacgaggctcactattattgcagctcatatacaagcagctcacttgggtgttcggcgggagggaccgaccgtgaccgtcttacggtcagcccagctcgcccctcggtcactctcgttcccgccctcctcacgtcgatccg

SEQ ID NO: 257207 - DNA, 544 bp, Homo sapiens
  misc_feature: GYAE6OF02F93RE.38.39.D06.1.454.CMB.1.raw
  modified_base (279)..(279): a, c, t, g, unknown or other
  misc_feature (279)..(279): n is a, c, g, or t
  modified_base (299)..(299): a, c, t, g, unknown or other
  misc_feature (299)..(299): n is a, c, g, or t
  modified_base (377)..(377): a, c, t, g, unknown or other
  misc_feature (377)..(377): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttangaggtcactaaacggccctnaggtagtttcagtcgcttctctggctccaagtctggcaacacggcctccctgaccatctctggctccaactgagacgngctcactattattgcagctcatatacaagcagccgtcacgtttgggtgttccgggcgggacgggacccgaccgtgtacccgttcgttaaggtccaggccccaggcctcggccccctggtccaccgtccgttcgttccccacccttccctcaccggttcgactaccgg

SEQ ID NO: 257208 - DNA, 519 bp, Homo sapiens
  misc_feature: GYAE6OF02IMWXO.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataattatgaggtcactaaacggccctcaggagtttctaatcgcttctctggctccaagtctggcaacacggcctccctgaccatctctgggctccaacctgaggacgaggctcactattattgcagctcatatacaagcagcgtcactttgggtgttcgggcggacgggaccgaccgtgacccgttcgttaggcagcccaggctcgcccctcggtcactctcgttcccgccctcctcacgtcgatccg

SEQ ID NO: 257209 - DNA, 532 bp, Homo sapiens
  misc_feature: GYAE6OF02IAWN5.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcaactaaacggccctcaggagtttctaatcgcttctctggctccaagtctggcaacaccggcctcctgaccatctctgggctccaacctgaggacgaggctcactattatgcagctcatatacaagcagctcacttgggtgttcggacgggtaggacccgaccgtcgaccgttcgttaggtccagcccgaaggcgtgccacccgtcggtccacttccttcgttccccgcccttcctcgtacgtgtacg

SEQ ID NO: 257210 - DNA, 551 bp, Homo sapiens
  misc_feature: GYAE6OF02IN86V.38.39.D06.1.454.CMB.1.raw
  modified_base (341)..(341): a, c, t, g, unknown or other
  misc_feature (341)..(341): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaacgtccccaaactcaataattatgaggtcactaaacggccctcaggtagtttcaatcgtcttctctggctcaagtctggcaacncggcctcctgaccatctcgtgggcctccaacctgacggacgaggctcactattatgcngctnatatacaagacacgcgtctacgttgggtcgttcgggacggacgggacccgaccgtgaccgttcgttacggtctacgcccgaggcctcgccccctcggtcctacgtccttcgttccccacccgttcctccgtaccggtcgtatacccgg

SEQ ID NO: 257211 - DNA, 515 bp, Homo sapiens
  misc_feature: GYAE6OF02F4BGR.38.39.D06.1.454.CMB.1.raw
  modified_base (297)..(297): a, c, t, g, unknown or other
  misc_feature (297)..(297): n is a, c, g, or t
  modified_base (510)..(510): a, c, t, g, unknown or other
  misc_feature (510)..(510): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaatcataattatgaggtcactaaacggccctnaggagtttcaatcgcttctctggctccaagtctggcaacacggcctcctgaccatctctgggctccaacctgaggacgaggctcactattattgcagctcatatacaagcagcgtcactttgggtgttcgggcggagggaccgacctggaccgttcttaggtctagcccaggcctcgcccctggtccactctcgttcccaccctcctcacgtnatccg

SEQ ID NO: 257212 - DNA, 511 bp, Homo sapiens
  misc_feature: GYAE6OF02FVNFA.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaacctgagacgaggctcactattattgcagctcatatacaagcagcgtcactttgggtgttcggcggagggaccgaccgtgaccgtctaggtcagcccaggctcgcccctcggtcactctgttcccacctcctcacgtgactcg

SEQ ID NO: 257213 - DNA, 555 bp, Homo sapiens
  misc_feature: GYAE6OF02HY2X3.38.39.D06.1.454.CMB.1.raw
  modified_base (235)..(235): a, c, t, g, unknown or other
  misc_feature (235)..(235): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaanatcaccaacatcacccaggcaaaagtccccaaaactcaataatttatgaggtacaactaaacggccctcaggagtttctaatcgctttctctggctccaagtctggcaacacggcctccctgaccatctctgggctccaacctgacggacgaggctcactattattgcagctcatataacaagcagcgtcacgttgggtgttcgggcgggaagggacccgaccgtggaccgttcgttaaggtccagcccgaaggcctcggccccctcggtccaccttccgtccgttccccgccccttccctccgtaccgtcgtactccgg

SEQ ID NO: 257214 - DNA, 570 bp, Homo sapiens
  misc_feature: GYAE6OF02FYFOW.38.39.D06.1.454.CMB.1.raw
  modified_base (361)..(361): a, c, t, g, unknown or other
  misc_feature (361)..(361): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcaccaggcaaagtccccaaaactcataatttatgaggtcactaaacggccctcaggagtttctaaatcgcttctctggctccaaagtctggcaaacacggcctccctgaccatcnctggctccaacctgagacgaggctcactatattgcagctcaatataacaagcagcgtcactttgggtgtttcgggacgggtacgggaacccgaccgtcggaacccgttcgtttaaaggtcaaggccccgaagggcctacggtcccccctcgggtccaacgttcctacgttccccaaccccgttccctccgtaaccggttcgattaccgg

SEQ ID NO: 257215 - DNA, 532 bp, Homo sapiens
  misc_feature: GYAE6OF02I34I4.38.39.D06.1.454.CMB.1.raw
  modified_base (299)..(299): a, c, t, g, unknown or other
  misc_feature (299)..(299): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaacggccctnaggagtttcaatcgcttctctggctccaagtctggcaacacgcctccctgaccatctctggctccaacctgagacgagctcactattatgacagctcatatacaagcagcgtcacgttgggtgttcggacggaggacccgaccgtgaccgttctacggtcacgcccgaggcctcggcccccgttcggtacaccttccgtcgttccccacccttccctcaccgttcgactccgg

SEQ ID NO: 257216 - DNA, 522 bp, Homo sapiens
  misc_feature: GYAE6OF02GKOPD.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaaacggccctcaggagtttctaatcgcttctctggctccaagtctggcaacacggcctcctgaccatctctgggctccaacctgaggacgaggctcactattattgcagctcatatacaagcagcgtcacgttgggtgttcgggcgggacgggaccgaccgtgaccgttcttacggtcagcccaggctcggcccctcggtcacctctcgttcccgccctcctcacgtgatccg

SEQ ID NO: 257217 - DNA, 417 bp, Homo sapiens
  misc_feature: GYAE6OF02IOO6K.38.39.D06.1.454.CMB.1.raw
  modified_base (404)..(404): a, c, t, g, unknown or other
  misc_feature (404)..(404): n is a, c, g, or t
  modified_base (410)..(417): a, c, t, g, unknown or other
  misc_feature (410)..(417): n is a, c, g, or t
tcagtcgatcacgtcacgaccggtgctcgatttagtgacatctcgcagttctttggggactttgcctgggtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaacctgaggacgaggctcactattattgcagctcatatacaagcagcgtcacttgggtgttcggcggagggaccgacctgaccgtcttaggtcagcccaaggctgccccctcggtcactctgttcccgccctctcacgtgatcgactgagcggctggcaaggcncatagnnnnnnnn

SEQ ID NO: 257218 - DNA, 420 bp, Homo sapiens
  misc_feature: GYAE6OF02I9M7B.38.39.D06.1.454.CMB.1.raw
  modified_base (407)..(407): a, c, t, g, unknown or other
  misc_feature (407)..(407): n is a, c, g, or t
  modified_base (412)..(420): a, c, t, g, unknown or other
  misc_feature (412)..(420): n is a, c, g, or t
tcagtcgatcacgtcacgaccggtgctcgatttagtgacatctcgcagttctttggggactttgcctgggtgatgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaacctgaggacgaggctcactattattgcagctcatatacaagcagcgtcacttgggtgttcggcggagggaccgacctgaccgtctaggtcagcccaaggctgccccctcggtcactctcgttcccgccctcctcacgtgactcgactgagcgggctgggcaggcncatgnnnnnnnnn

SEQ ID NO: 257219 - DNA, 516 bp, Homo sapiens
  misc_feature: GYAE6OF02HROR3.38.39.D06.1.454.CMB.1.raw
  modified_base (480)..(480): a, c, t, g, unknown or other
  misc_feature (480)..(480): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacattggtacttataaccatgtctcctggtaccaacatcaccagacaaggcccccaaactcataattatgacgtcagtagtcggccctcaggggtttctgatcgcttctcaggctccaagtctggcaacacggcctccctgaccatctctgggctccgaggttgaggacgaggctgactattattgcgcctcacatggaatcaggtagggttttcggcggtagggacaaagtcgaccgtcgtaggtcagccgaagctcgcccctcgtcactctcgttcccncctcctcacgtcgatcgactcggaggcggctggacg

SEQ ID NO: 257220 - DNA, 628 bp, Homo sapiens
  misc_feature: GYAE6OF02IJ3VO.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaatcataatttatgaggtcaactaaacggccctacaggtagtttactaatcgcttactctggctccaagtctggacaacacggcctccctgacctatctctcgggacctaccaaccgtgaagggaccgaggcctacgaacttatttaatcgacaagtctacaattaactaacaaaggccaaggtccgttacacgtttggggttgttccgggacgggaacgggacccgaccgtgaacccgttcgtttaaggccgacgaccccgaaggccctaccggcccccgttacggtcctaacccgttccgttcccggtttccccccggtaccccttaccccggtacctaacggttccgaacgttacccggg

SEQ ID NO: 257221 - DNA, 518 bp, Homo sapiens
  misc_feature: GYAE6OF02JSBTK.38.39.D06.1.454.CMB.1.raw
  modified_base (390)..(390): a, c, t, g, unknown or other
  misc_feature (390)..(390): n is a, c, g, or t
  modified_base (403)..(403): a, c, t, g, unknown or other
  misc_feature (403)..(403): n is a, c, g, or t
  modified_base (504)..(504): a, c, t, g, unknown or other
  misc_feature (504)..(504): n is a, c, g, or t
  modified_base (515)..(515): a, c, t, g, unknown or other
  misc_feature (515)..(515): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcaccaggcaaagtcccaaactcataattatgaggtcactaatcggccctcgagggtttctaatcgcttctctggctcaagtctggcaacacggcctcctgaccatctcgtgggctccaggctgacggacgaggctgattatacngcagtctacttanagaagaagtagcaactcgtaggtcgttcggcggaggtaccaagtctagacccgtactaagtcacgaccaaggtccgtcgacccctggccactctcgtcccncctctcacgtnacg

SEQ ID NO: 257222 - DNA, 599 bp, Homo sapiens
  misc_feature: GYAE6OF02G556T.38.39.D06.1.454.CMB.1.raw
  modified_base (400)..(400): a, c, t, g, unknown or other
  misc_feature (400)..(400): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctcctgaccatctctgggctccaactgacggacgaggctcactattattgcagctnatatacaagcagcgtctacttgggtacgttcggacgggacgggtaccgaccgtcggtaccgttcgttacggtaccgacgtacccgaaggtcccgtccggtacccccccgttccgggttaccctaacccgttccgttacccggtttccccccgtccccgttccccgttacccggtaaccggtttccgaccgttaccccgg

SEQ ID NO: 257223 - DNA, 176 bp, Homo sapiens
  misc_feature: GYAE6OF02JPCNO.38.39.D06.1.454.CMB.1.raw
  modified_base (162)..(176): a, c, t, g, unknown or other
  misc_feature (162)..(176): n is a, c, g, or t
tcagtcgatcacgtcacgaccggtgctcgatttagtgacatctcgtcgacgttcgtttgggggaagaggaagactgacggtcctgccacagcggccctgggctgccgtggttcaaggactacttccacgtgatcgactgagcggactggcacggcgcatagnnnnnnnnnnnnnnn

SEQ ID NO: 257224 - DNA, 527 bp, Homo sapiens
  misc_feature: GYAE6OF02IJTQ1.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaacctgaggacgaggctcactattatgcagctcatatacaagcagcgttcacgttgggtgttcgggcggacgggaccgaccgtgaccgttcgttaggccagacccgaggcctcgccccctcggtctacgtctcgttccccacctcctcgacgtcgatccg

SEQ ID NO: 257225 - DNA, 604 bp, Homo sapiens
  misc_feature: GYAE6OF02IJGCX.38.39.D06.1.454.CMB.1.raw
  modified_base (280)..(280): a, c, t, g, unknown or other
  misc_feature (280)..(280): n is a, c, g, or t
  modified_base (598)..(598): a, c, t, g, unknown or other
  misc_feature (598)..(598): n is a, c, g, or t
tcagtcgatcacgtcacgaccggtgctcgatttagtgacatctcgcaggttctttgggactttgcctgggactctgctgctcctcaccctcctcactcagggcaccagggtcctgggcccagtctgccctgactcagcctgcctccgtgtctgggtctcctggacagtcgatcaccatctcctgcactggaaccagcagtgacgttggtggttaataaatatgtcttcttggtaccaacatcacaacatcaccaggcaaagtccccaaactcataatttntgagtcaactaaaccggccctacaggtatttctaatcgtcttctctggctaccaagtcttggacaacgacccgggccttccctacgaccattccgtacgtgggaccctcgaaccttggaagggtaccgacggtcttactacttaagttacgtttcgctaagtctacctaatactaacaacgtacgacggacgttactacgtttcggggttcgtttccgggaccggtgggaacccgtccgttacgaccgttcttacggtcacgtcccagcgtcgccccgtaggtccactccttcgttcccacccgttccgtctcgtagngtaccg

SEQ ID NO: 257226 - DNA, 422 bp, Homo sapiens
  misc_feature: GYAE6OF02G3B4R.38.39.D06.1.454.CMB.1.raw
  modified_base (375)..(375): a, c, t, g, unknown or other
  misc_feature (375)..(375): n is a, c, g, or t
  modified_base (405)..(422): a, c, t, g, unknown or other
  misc_feature (405)..(422): n is a, c, g, or t
tcagtcgatcacgtcacgaccggtgctcgatttagtgacatctcgcagttctttggggactttgcctgggtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctggctccaacctgagacgaggctcactattattgcagctcatatacaagcagcgtcacttgggtgttcggcggagggaccgacctgaccgtctaggtcagcccaaggctgccccctggtcactctgtcccgcctcctcacgtnatcgactgagcgggctggcaaggcgcatgnnnnnnnnnnnnnnnnnn

SEQ ID NO: 257227 - DNA, 679 bp, Homo sapiens
  misc_feature: GYAE6OF02JG3CR.38.39.D06.1.454.CMB.1.raw
  modified_base (216)..(216): a, c, t, g, unknown or other
  misc_feature (216)..(216): n is a, c, g, or t
  modified_base (244)..(244): a, c, t, g, unknown or other
  misc_feature (244)..(244): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgtaataatntgtctcttggtaccaacatcaaccaacntaccaccaggacaaacgtccccaaatctaataattatgaggtctaactaaacggccctcgaggtacgtttactaagtcgtacctttcgtactcggcctacctaacgtcgtcggacctaaccgaccggtcccttaccctagtacccacttccgtcgtacgggccttaccctaacgtcggaacggaccggacgtcctactaacgttaatttacgtcgactaacgctactaagtacttaagaacgtacaacgtccgttacgtacggttgggttacggttccgggacggtaaccgggaacccgtccgttaccggaccgttaccgttacggtccgtaacgcccgtaacggtccgtacccggtccccggttaggtaccctaccgtttccgttacccgttccccgtcccttaccgttaccgtaccgtacgtacgtaacccgg

SEQ ID NO: 257228 - DNA, 580 bp, Homo sapiens
  misc_feature: GYAE6OF02G2MF7.38.39.D06.1.454.CMB.1.raw
  modified_base (235)..(235): a, c, t, g, unknown or other
  misc_feature (235)..(235): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttaataaatatgtctcttggtaccaanatcaaccaacatccacccaggacaaaacgtccccaaactcaataatttatgaggtcaactaaacggccctcaggtagtttctaatcgtcttctctgctcaatctgcaacacgcctcctgaccatctcgtgggcctaccaacgtggacggacgaggctacacttattacttgacagtctactataactaacaacgacacgcgtactacgtttgggtcgttcgggacggacgggacccgtaccgtcgtaccgttcgttacggtcgacgccgacggcttaccggccccgtacggtcctaccttccgttcgttccccgcccgttcctccgtacggttcgacgtacccgg

SEQ ID NO: 257229 - DNA, 562 bp, Homo sapiens
  misc_feature: GYAE6OF02GO57P.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaaccaacatcacccaggcaaagtccccaaaactcataatttatgaggtcactaaaacggccctcaggagtttactaatcgcttctctggctccaagtctggcaacacggcctccctgaccatctctgggctccaacctgacggacgaggctcactattatgcagctcatataacaagcagcgtctacgttgggttgttcgggagggtacgggacccgaccgtgtaaccgtcgttaggtcacgcccaagggctaccggccccctccgggtcctaccgtcgttccgttccccaccccgttccctaccgaccggttcgattacccgg

SEQ ID NO: 257230 - DNA, 544 bp, Homo sapiens
  misc_feature: GYAE6OF02GWE1U.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatttgtctcctggtaccaacagcacccgggcaatgcccccaaaatcatgatttatgaggtcactcatcggccctcgaggggtttctaatcgcttctctgcatcaagtctgcaacacggcctccctgaccatctcgtgggcctccgaggtctggaggacgaggtcttaattatttctagtctagttcatataacaaccagacaaacactactgtctagttcggacggacggaccaagcgtacgaccgtcctaagtcacgcccaagcctacgccccgtacggtccacctctccgttacccctaccctcctacctacgtacgtactcgtacg

SEQ ID NO: 257231 - DNA, 591 bp, Homo sapiens
  misc_feature: GYAE6OF02GK0HZ.38.39.D06.1.454.CMB.1.raw
  modified_base (339)..(339): a, c, t, g, unknown or other
  misc_feature (339)..(339): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcaccaggcaaagtccccaaactcataattatgaggtcactaaacggccctcaggtagtttctaatcgcttctctggctccaagtctggcaacncggcctcctgaccatctctcgggctaccaacctgacggacgaggctcactattattcgcagctcatatacaagcagtcgtctacgttgggtcggttcgggacgggacgggtaccgaccgttcggacccgttcgttacggtccacggtacccgaacgggtccgttacccggcccccgttacgggttacctaccgttccgttccgttacccccctacccgttccccgttccgtaaccggttcggacttacccgg

SEQ ID NO: 257232 - DNA, 599 bp, Homo sapiens
  misc_feature: GYAE6OF02HJC5U.38.39.D06.1.454.CMB.1.raw
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
  modified_base (280)..(280): a, c, t, g, unknown or other
  misc_feature (280)..(280): n is a, c, g, or t
  modified_base (360)..(360): a, c, t, g, unknown or other
  misc_feature (360)..(360): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttggtaccaantcaccaanatcacccaggcaaacgtccccaaactcataatttangaggtcaactaaaaccggcccctacagggtacgtttactaatccgtctttctcgtggacctccaaagttctgggcaaacnccggccctccctgacccatcctcgtcgggcctacccaaccgtggaacgggacgacggcctcacttattattcgcagctacatactaacgaacgacacgccgtactacgtttgggttcgttccgggacgggacgggacccgaccgtcgtaccgttcgttacggtcacgacccgaggctccgcccctaggtccactccgttccgttccccgtcccctccgtccgtacggtcgacgtaccgg

SEQ ID NO: 257233 - DNA, 703 bp, Homo sapiens
  misc_feature: GYAE6OF02JFKZD.38.39.D06.1.454.CMB.1.raw
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
tcagtcgatcacgtcacgaccggtgctcgatttagtgacatctcgcagttctttgggactttgcctgggctctgctgctctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacntcaccaacgntcaccaggcaaacgtccccaaactcaagtaattatgaggtcaacgtaaacggccctacaggtacgtttctaaatcgacctttcgtctgggaccttccgaaagttcctagggtaccaaaccgtaaccgggtccccttacccctggaaaccccattccctacgtcggggtacctttacccgaaacccgttggaaacgggtaccgacggggaccttaccaaccttattttactttacggactaacggcttacaattactaaccgtaagacaacgtccgttacaaccgtttggggttacgttcgggtacgggacgggtacccgtaccgtcggtaacccgttcgttaacggccgtacggaccccgtaacgggtctccgtaccccccgttgggtacctacccgtttccgtacggttttccccccgacctttcccgtaccgtaacccggttcggtaccttacccgg

SEQ ID NO: 257234 - DNA, 340 bp, Homo sapiens
  misc_feature: GYAE6OF02IY36G.38.39.D06.1.454.CMB.1.raw
  modified_base (333)..(340): a, c, t, g, unknown or other
  misc_feature (333)..(340): n is a, c, g, or t
tcagtcgatcacgtcacgaccggtgctcgatttagtgacatctcgcagttctttgggttttggggggaagaggaagactgacggtcctgccacaggtgcttgctggtacctggggcgctatggacgtctggggccaagggaccacggtcaccgtctcctcagcctccaccaagggcccatcggtcttccccctggcgccctgctccaggagcacctccgagagcacagcggccctgggctgcctggtcaaggactacttccacgtgatcgactgcgggctggtcaaggactacttccacgtgatcgactgagcgggctggcaaggcgcatagnnnnnnnn

SEQ ID NO: 257235 - DNA, 424 bp, Homo sapiens
  misc_feature: GYAE6OF02GOI75.38.39.D06.1.454.CMB.1.raw
  modified_base (409)..(409): a, c, t, g, unknown or other
  misc_feature (409)..(409): n is a, c, g, or t
  modified_base (415)..(424): a, c, t, g, unknown or other
  misc_feature (415)..(424): n is a, c, g, or t
tcagtcgatcacgtcacgaccggtgctcgatttagtgacatctcgcagttctttggggactttgcctgggtgatgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaacctgaggacgaggctcactattattgcagctcatatacaagcagcgtcacttgggtgttcggcggagggaccgaccgtgaccgtcttaggtcagcccaaggctcgccccctggtcactctcgttcccgccctcctcacgtgactcgactgacgcgggctggcaggcncatagnnnnnnnnnn

SEQ ID NO: 257236 - DNA, 830 bp, Homo sapiens
  misc_feature: GYAE6OF02JT97H.38.39.D06.1.454.CMB.1.raw
  modified_base (213)..(213): a, c, t, g, unknown or other
  misc_feature (213)..(213): n is a, c, g, or t
  modified_base (248)..(248): a, c, t, g, unknown or other
  misc_feature (248)..(248): n is a, c, g, or t
  modified_base (259)..(259): a, c, t, g, unknown or other
  misc_feature (259)..(259): n is a, c, g, or t
  modified_base (788)..(788): a, c, t, g, unknown or other
  misc_feature (788)..(788): n is a, c, g, or t
tcagtcgatcacgtcacgaccggtgctcgatttagtgacatctcgcagttctttgggactttgcctgggctctgctgctcctcaccctcctcactcacggcacagggtcctgggcccagtctgccctgactcagcctgcctccgtgtctgggtctccgtggaccagtcgatccaccatccgtcctgacactggaaccagcacgtgacgttggnggttaactaaagtactgtcgtcttggtacccaaantcaaccgaacntaccaccaggcaaacgtaccccaaacttaccaattaactttactagtacggtactaacgtaaaacggccctacgtaacgggacttttacctaaagttccgccttttacttccgtacggtaccttacccgtaaacgttccgtgggtaccaaaacgtcccggtaccttcccttacggacctaacgtccttacgttcggggacctttaccccgaaaccgttcggaacgggaccgtaacgggtccttacgaacctttaacgttaacgttcgaccggtaacgccttacccaagttactaaccgtaaagaccttaacggaccgttctaaaccggttttcggggtaggtttacccgggttacgggggaaacgggtccccgttaaccggtacggttaaaccccgttcggtttttaaacgggggaccttaacgggttaccccccggaaaggtccccgttttccggggacccccccgttaccgggttaccttaaaccggtccccgttttaaccccgggtcccccggttttaaccccccnccccggtttaaccgtaccccgggttacgtaaccggtacccgg

SEQ ID NO: 257237 - DNA, 535 bp, Homo sapiens
  misc_feature: GYAE6OF02IINT5.38.39.D06.1.454.CMB.1.raw
  modified_base (282)..(282): a, c, t, g, unknown or other
  misc_feature (282)..(282): n is a, c, g, or t
  modified_base (302)..(302): a, c, t, g, unknown or other
  misc_feature (302)..(302): n is a, c, g, or t
  modified_base (341)..(341): a, c, t, g, unknown or other
  misc_feature (341)..(341): n is a, c, g, or t
  modified_base (360)..(360): a, c, t, g, unknown or other
  misc_feature (360)..(360): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactgaaccagcagtgacgttggtggttaataaatatgtctcttggtaccaacatccaccaacatccaccaggacaaacgtccccaaactcataatttangaggtcactaaacggccctnaggtagtttctaatcgcttctctgctcagtctggcaacncggcctcctgaccatctcnggctccaactgagacgagctcactattatgcagctcaatatacaagacagtcgtctacgttgggtgttcggacgggacggacccgacgtcgtaccgtcgttacggcacgcccgaggtcctcggccccttcggcctacttcgtcgttacccaccctcctaccgacgttcgatccgg

SEQ ID NO: 257238 - DNA, 558 bp, Homo sapiens
  misc_feature: GYAE6OF02H0GUW.38.39.D06.1.454.CMB.1.raw
  modified_base (237)..(237): a, c, t, g, unknown or other
  misc_feature (237)..(237): n is a, c, g, or t
  modified_base (347)..(347): a, c, t, g, unknown or other
  misc_feature (347)..(347): n is a, c, g, or t
  modified_base (411)..(411): a, c, t, g, unknown or other
  misc_feature (411)..(411): n is a, c, g, or t
tcagtcgatcacgtcacgaccggtgctcgatttagtgacatctcgcagttctttggggactttgcctgggctctgctgctcctcacccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttggtaccaanatcaccaacatcacccaggacaaacgtccccaaactcataatttatgaggtcactaaacggccctacgaggtagtttctaatcgcttctctggctccaagtctggcaacncgcctcctgaccatctctgggcctaccaaccgtgaggacgaggctacacttattatgcagtctnatatacagcagctcagttgggtgttcggcggacgggaccgtaccgtcgaccgttcgttaggcacgcccgtagcctaccggcccccgttcggtacctaccgttccgttccgttcccccacccttcctaccgtaccgtacgactaccgg

SEQ ID NO: 257239 - DNA, 697 bp, Homo sapiens
  misc_feature: GYAE6OF02IT9OQ.38.39.D06.1.454.CMB.1.raw
  modified_base (164)..(164): a, c, t, g, unknown or other
  misc_feature (164)..(164): n is a, c, g, or t
  modified_base (213)..(213): a, c, t, g, unknown or other
  misc_feature (213)..(213): n is a, c, g, or t
  modified_base (313)..(313): a, c, t, g, unknown or other
  misc_feature (313)..(313): n is a, c, g, or t
tcagtcgatcacgtcacgaccggtgctcgatttagtgacatctcgcagttctttggggactttgcctgggctctgctgctcctcaccctcctcactcaggcacagggtcctgggcccaatctgccctgactcagcctgccctccgtgtctgggtctcctggacngtcggtcgccatctcctgcactggaaccagcagtgacattggtacttanaaccatgtctccgtgtaaccaacatccgacccagaccaacggcccccaaactcaataatttatagacgttacagtagtccggccctacgtagggttttcnggactcgtcttctcaggcctccaagtcgtggacaacgccggcctccgtacgacctatccgtcgtcgggctcgtaggtgacggacgtaggcctagtacttactttagttcgccgtcccttacaacgtacgtacgggtaactcggtaacggggttaaggggttttccggaacggggtaaccgggtaaccgtaaaacgggttcgtaacccgggttacggttaaccggttaccgaccgggtaccccgtaagggtcccgtacccgtaccccccggttcggtaccctaaccgttccgtacccgtttacccacccccgttccttaccgaccggttacgaaccttccgggtacttacgggaccggttccggggcgttaccggacggtaccgg

SEQ ID NO: 257240 - DNA, 718 bp, Homo sapiens
  misc_feature: GYAE6OF02I6EZM.38.39.D06.1.454.CMB.1.raw
  modified_base (196)..(196): a, c, t, g, unknown or other
  misc_feature (196)..(196): n is a, c, g, or t
tcagtcgatcacgtcacgaccggtgctcgatttagtgacatctcgcgagttctttggggactttgcctgggctctgctgctcctcaccctcctcactcagggcacagggtcctgggcccagtctgccctgactcagcctgcctccgtgtctgggtctcctggacagtcgatcaccatcctctgcacgtacgaaccngcgtagtgtacgttggtagttaataatagtgtctcgttacggaaccaactactaccaaccaacactccaaccgaggacaaaccgtaccccaaactctaattaatttagtagtacggtactaaaccgtaaaccggtcctagaggtacttctaactcgtcttctacgtcggtacctacgtaagtcgtcggacaaccgacgtccctaccgtacgacctagtccgtcggtacgggtaccctaccgaacccgtaggaacggacgtacggtcctaactacttaagttactacgctacgtctactaactaacgtaactaacgtctaacgtccgtaccgtacggttcgggttacggttccggggaccggtaaccgggtacccgtaccgtaccgggttacccgttacggttacggtaccgtaccggtacccgtacggtcccgtcccggtacccccggttacggtaccgtacccgttccggtacccgttccccgtcccgttaccgtcccgtaccggtacgtaccgtacccgg

SEQ ID NO: 257241 - DNA, 552 bp, Homo sapiens
  misc_feature: GYAE6OF02GGMHC.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcaccaggcaaagtccccaaactcataattatgaggtcactaaacggccctcaggagtttctaatcgcttctctggctccaagtctggcaacacggcctccctgaccatctctgggcctccaacctgacggacgaggctcactattatgacagctcatatacaagcagccgtcacgttgggtgtttcgggcggtacgggaccgaccgttcggacccgttcgttacggtacacgcccaagggctccggcccccgttcggtccaccttccgttcgttccccaccctcccgttccaccggtcgacttccg

SEQ ID NO: 257242 - DNA, 596 bp, Homo sapiens
  misc_feature: GYAE6OF02IKTTN.38.39.D06.1.454.CMB.1.raw
  modified_base (276)..(276): a, c, t, g, unknown or other
  misc_feature (276)..(276): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatatgtctcttggtaccaacatcaccaacatcaccagcaaacgtccccaaatcaataattangaggtcaactaaaccggccctacgaggtacgtttactaatccgtcttctacgtcgccttaccaagtctggaccaacgaccggcctccctcgaccactctcgtgggcctaccaacgtgacggacgagctacgactattacgttgctacgctcaatacacaagcagtcgtctacgtgggttcgtcgggcggacgggacccgacgtcgaccgttcgttacggtcacgtacccaggtcctcccggtacccccgtcggtacctacccgttccgttaccgttaccccctacccttcccgtaccgtaccgttacggtacctacccgg

SEQ ID NO: 257243 - DNA, 762 bp, Homo sapiens
  misc_feature: GYAE6OF02JN82W.38.39.D06.1.454.CMB.1.raw
  modified_base (209)..(209): a, c, t, g, unknown or other
  misc_feature (209)..(209): n is a, c, g, or t
  modified_base (226)..(226): a, c, t, g, unknown or other
  misc_feature (226)..(226): n is a, c, g, or t
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
  modified_base (281)..(281): a, c, t, g, unknown or other
  misc_feature (281)..(281): n is a, c, g, or t
  modified_base (303)..(303): a, c, t, g, unknown or other
  misc_feature (303)..(303): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctccgtggacagtcgatcaccatctcctgcactggaaccagcagtgacgtttggnggttaataatatgtctnttcggaccaanatcaccaanatcaccaggcaaagtccccaaactcaataatttangagtacaacgtaacggccctanaggatttactaatcgactttctgtcggtcctaccgtaagttccgtagggaccctaaacgaccgggtccctttcccgtgaaccctacgttccgtccgttcgggggaacccttaccccgaaaccttgggaacggggaaccgttacggggtacctaccgtaaccgtttaacgtttacgtttacggaccgttaacgtccttaccgtaacgttaacttaaacgtaaacggtaccgtaacggtccggttacgtaccggtttagggttaccggttccggggtaaccgggtaacgggaacccgttaccgtacggttacccgttacggtttacggtacgtaccgtacccgaacggtccggtcccggttcccccgttagggttacccctaacggtttacccgtttccgggttaccccccgttccccgttacccggttacccgttacccggtacgtacccgttacccggg

SEQ ID NO: 257244 - DNA, 601 bp, Homo sapiens
  misc_feature: GYAE6OF02J1YQE.38.39.D06.1.454.CMB.1.raw
  modified_base (216)..(216): a, c, t, g, unknown or other
  misc_feature (216)..(216): n is a, c, g, or t
  modified_base (220)..(220): a, c, t, g, unknown or other
  misc_feature (220)..(220): n is a, c, g, or t
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (276)..(276): a, c, t, g, unknown or other
  misc_feature (276)..(276): n is a, c, g, or t
  modified_base (353)..(353): a, c, t, g, unknown or other
  misc_feature (353)..(353): n is a, c, g, or t
  modified_base (387)..(387): a, c, t, g, unknown or other
  misc_feature (387)..(387): n is a, c, g, or t
  modified_base (438)..(438): a, c, t, g, unknown or other
  misc_feature (438)..(438): n is a, c, g, or t
  modified_base (450)..(450): a, c, t, g, unknown or other
  misc_feature (450)..(450): n is a, c, g, or t
tcagtcgatcacgtcacgaccggtgctcgatttagtgacatctcgcagttctttggggactttgcctgggctctgctgctcctcaccctcctcactcagggcacagggtcctggcccagtcctgccctgactcagcctgcctccgtgtctgggtctcctggacagtcgatcaccatcctcctagcacgtggaaccagcagtgacgttggtgttaanaatntgtctcgtagtaccaantcaccantccaccagacaacgtcccaatcattaattagngagtaccttaaccgaaccggtcctataggttacttactaagtccgtctttcgtacgttcgaccttaccgaggttccncggtaccaaccgcccgtaccctcctagtaacctntccgtgcgtcctacccgaaccgtggacggacgtagactacgatttattacncgacacgtctanatacaacacgtcaggtcctagtcggtcgggtgtccggacggtaccgacgtacgtcgtacgttcgtacgccgaccgaccgtacgccgtacccgccccgttgccctacgttccgtacccgttccccgcccttcgaccgtacgtcgcgtaccgg

SEQ ID NO: 257245 - DNA, 557 bp, Homo sapiens
  misc_feature: GYAE6OF02FQZ95.38.39.D06.1.454.CMB.1.raw
  modified_base (402)..(402): a, c, t, g, unknown or other
  misc_feature (402)..(402): n is a, c, g, or t
  modified_base (440)..(440): a, c, t, g, unknown or other
  misc_feature (440)..(440): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatttgtctcctggtaccaacagcacccgggcaactcgacccccaaaatcatgtatttatgaggtcactcatcgccctcgagggtttcaatcgcttctctgcatccaagtctggacaacgaccggcctccctgaccctatcctcgtcggcctccgaggctaggacggacgtaggcttaatttattcgngtctagttcaagtactaaccaaccagcaaactctactnctagtcggcggtacggaccagctacgaccgttactaagtcaacgcccaagtccgtaccgcccccgtggtcctaccgtcttccgttccccacccttccgtccacgtcgactcgtacgg

SEQ ID NO: 257246 - DNA, 595 bp, Homo sapiens
  misc_feature: GYAE6OF02H1XXY.38.39.D06.1.454.CMB.1.raw
  modified_base (217)..(217): a, c, t, g, unknown or other
  misc_feature (217)..(217): n is a, c, g, or t
  modified_base (235)..(235): a, c, t, g, unknown or other
  misc_feature (235)..(235): n is a, c, g, or t
  modified_base (343)..(343): a, c, t, g, unknown or other
  misc_feature (343)..(343): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcacatctcctgcactggaaccagcagtgacgttggtgttaataaatntgtctcgttagtaccaanatcaaccaacatcacccaggacaaacgtccccaaatcaattaattatgacgtacaacgtaaccgtcctacgaggtattcaatcgtcttctctgctacagtctgacacncgcctccagacctatctacgtcggcctaccaacgtgaacggacgacgtactacgtatattactgacacgtctacgtataatacaagcagtccgtacgtacgtgggtcggttacggcgggtaacggaccgtaccgtcggtaccgttcgttaacgcgaaccgaccgacggtccgtcccgtaccccgttacggtcctaaccgttccgtaccgttcccccgtcccgttacccgtccgtaacggtccgtactaccgg

SEQ ID NO: 257247 - DNA, 547 bp, Homo sapiens
  misc_feature: GYAE6OF02H5W98.38.39.D06.1.454.CMB.1.raw
  modified_base (278)..(278): a, c, t, g, unknown or other
  misc_feature (278)..(278): n is a, c, g, or t
  modified_base (297)..(297): a, c, t, g, unknown or other
  misc_feature (297)..(297): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcttgcctccgtgtctgggtctcctggacagtcgatcaccatctcctgcactggaaccagcagtgacgttggtggttataaatatgtctcttggtaccaacatcaccaacatcacccaggcaaagtccccaaatcataatttangagtcactaaacggccctnaggatttctaatcgcttctctggctccaagtctggcaacacggcctccctgaccatctctgggctccaacctgaggacgaggctcactattatgcagctacatatacaagcagtcgtcacgttgggtgttcggcgggacggacccgacgtcgaccgttcttacggacacgacccaaggtcctacgcccccgttacggtcctaaccgtccttccggttccccgcccttcccgttcacggttcgattaccgg

SEQ ID NO: 257248 - DNA, 528 bp, Homo sapiens
  misc_feature: GYAE6OF02FIMWW.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaatcataatttatgaggtcactaaacggccctcaggagtttcaatcgcttctctggctccaagtctggcaacacggcctcctgaccatctctgggctccaacctgacggacgaggctcactattattgcagctcatatacaagcagcgtacacgttgggtgttcggcgggacggaccgaccgtgtaccgtcttacggtcacgcccgagctcgccccctcggtccactctccgttcccacccgttccctccacgtcgataccgg

SEQ ID NO: 257249 - DNA, 524 bp, Homo sapiens
  misc_feature: GYAE6OF02F977Z.38.39.D06.1.454.CMB.1.raw
  modified_base (235)..(235): a, c, t, g, unknown or other
  misc_feature (235)..(235): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaanatcaccaacatcacccaggcaaagtccccaaactcataattatgaggtcactaaacggccctcaggagtttctaatcgcttctctggctccaagtctggcaacacggcctcctgaccatctctgggctccaacctgaggacgaggctcactattattgcagctcatatacaagcagcgtcacgttgggtgttcgggcggagggaccgaccgtgaccgtcgttaggtcacgcccaggctcggcccctcggtccactccgtcgttccccacccgtcctccacgtgactccg

SEQ ID NO: 257250 - DNA, 559 bp, Homo sapiens
  misc_feature: GYAE6OF02GEF0Q.38.39.D06.1.454.CMB.1.raw
  modified_base (281)..(281): a, c, t, g, unknown or other
  misc_feature (281)..(281): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttggtaccaacatcaccaacatccacccaggcaaacgtccccaaactcataattangagtcactaacggcctgaggtattctaatcgcttctctggctcaagtctggacaacacggcctcctgacctatctcgtggcctaccaacctggacggacgaggctctacttattatgcagctcatacacaagcagtcgtctacgttgggtcggttccgggacgggacgggacccgtaccgtcggaacccgttgttacggtccacgcccgtaggcctccggccccgtacggtccacgttcctccgttccccgcccttccgtacctacgttactcgtacg

SEQ ID NO: 257251 - DNA, 666 bp, Homo sapiens
  misc_feature: GYAE6OF02GS0L4.38.39.D06.1.454.CMB.1.raw
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
  modified_base (589)..(589): a, c, t, g, unknown or other
  misc_feature (589)..(589): n is a, c, g, or t
  modified_base (595)..(597): a, c, t, g, unknown or other
  misc_feature (595)..(597): n is a, c, g, or t
  modified_base (615)..(615): a, c, t, g, unknown or other
  misc_feature (615)..(615): n is a, c, g, or t
  modified_base (617)..(617): a, c, t, g, unknown or other
  misc_feature (617)..(617): n is a, c, g, or t
  modified_base (619)..(619): a, c, t, g, unknown or other
  misc_feature (619)..(619): n is a, c, g, or t
  modified_base (621)..(621): a, c, t, g, unknown or other
  misc_feature (621)..(621): n is a, c, g, or t
  modified_base (628)..(628): a, c, t, g, unknown or other
  misc_feature (628)..(628): n is a, c, g, or t
  modified_base (630)..(630): a, c, t, g, unknown or other
  misc_feature (630)..(630): n is a, c, g, or t
  modified_base (632)..(633): a, c, t, g, unknown or other
  misc_feature (632)..(633): n is a, c, g, or t
tcagtcgatcacgtcacgaccggtgctcgattttagtgacatctcgtcgtagggttctttggggactttaagaccctgggtgtaccgtttcggtggtttaaataaaatacctggtctcttggtaccaacatcaccaacatcgacccaggcaaaggtccctaaactctataagtttatgaggtcaactaaaccggccctcgaggacgtttctaactcggtccttcgttcgtggctacctaagttcgtggcaacgacggacctcccgtcgaccgacttccgttcgtgggggtccttcccaaccgtcggaacgggaccgtacggtcgtaccgaccttaactttactttggcaacgcttcgtataatttacgaaggccaaggccgttcacgtttcgggtaggtttccgggtcggaggggtaccggaccgttgggaaccggttctttacgggtcctaggtccccgtaaagggcctacggaccccccttacgggtccacctccttagttaccccgaccctccgtcacggtcactccgaacttcggacggacgggtacttagggaccaacgggcgtaactagttaaggntnagacngctgcnnngcgacgcgtctctctcgngngngntatatananannctctcttctctctctctcgtcgcgcgtcgacgc

SEQ ID NO: 257252 - DNA, 553 bp, Homo sapiens
  misc_feature: GYAE6OF02GKECI.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaacggccctcgagagtttctaatcgcttctctgctcaagtctggcaacacggcctccctgaccatctctggcctccaacctgaggacgaggctacactattattgcagctcatatacaagcagcgtcacgttgggtcgttcggcggacgggaccgaccgtcgaccgttcttaggtcacgcccaggtcctaccgtcccccgtcggtaccaccgttccgtccgtttcccctacccttcccgtaccgtaccggttcgacgttaccgg

SEQ ID NO: 257253 - DNA, 539 bp, Homo sapiens
  misc_feature: GYAE6OF02FKB83.38.39.D06.1.454.CMB.1.raw
  modified_base (235)..(235): a, c, t, g, unknown or other
  misc_feature (235)..(235): n is a, c, g, or t
  modified_base (279)..(279): a, c, t, g, unknown or other
  misc_feature (279)..(279): n is a, c, g, or t
  modified_base (398)..(398): a, c, t, g, unknown or other
  misc_feature (398)..(398): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaanatcaccaacatcacccaggcaaagtccccaaactcataatttangaggtcactaaacggccctcaggtatttcaatcgctttctctggctccaagtctggcaacacggcctccctgaccatctcgtgggctaccaacctgaggacgagctcactattattgcngctcatatacaagcagctctacgttgggtgttcgggacggacgggaccgtcctagaccgtcttacggtcacgacccaggcctcggcccccttcggtccacttccgtcggttccccgccctccgtccacggttcgagtcccg

SEQ ID NO: 257254 - DNA, 484 bp, Homo sapiens
  misc_feature: GYAE6OF02JZXG7.38.39.D06.1.454.CMB.1.raw
  modified_base (125)..(125): a, c, t, g, unknown or other
  misc_feature (125)..(125): n is a, c, g, or t
  modified_base (191)..(191): a, c, t, g, unknown or other
  misc_feature (191)..(191): n is a, c, g, or t
  modified_base (264)..(264): a, c, t, g, unknown or other
  misc_feature (264)..(264): n is a, c, g, or t
  modified_base (459)..(459): a, c, t, g, unknown or other
  misc_feature (459)..(459): n is a, c, g, or t
  modified_base (463)..(484): a, c, t, g, unknown or other
  misc_feature (463)..(484): n is a, c, g, or t
tcagtcgatcacgtcacgaccggtgctcgatttagtgacatctcgcagttctttggggactttgcctgggtgacgttggtggttataaatatgtctcttggtaccaacatcaccaacatcacccnggcaaagtccccaaactcataatttatgagtcactaaacggccctcaggagtttctaatcgcttcnctggctccaagtctggcaacacggcctccctgaccatctctgggctccaacctgaggacgaggctcactattntgcagctacatatacaagcagcgtcacgttgggtgtcggcggagggaccctactcggaaccgttgttaacggtcgaagccccgaaggcctcggcccccccttgggtcctaacccgtcgtccgtttcccccgaccccttcctcgacgtgaacttccgacgtgtacgcgggtctgggaccagggccactacaggtcngcannnnnnnnnnnnnnnnnnnnnn

SEQ ID NO: 257255 - DNA, 422 bp, Homo sapiens
  misc_feature: GYAE6OF02F6X6T.38.39.D06.1.454.CMB.1.raw
  modified_base (408)..(408): a, c, t, g, unknown or other
  misc_feature (408)..(408): n is a, c, g, or t
  modified_base (414)..(422): a, c, t, g, unknown or other
  misc_feature (414)..(422): n is a, c, g, or t
tcagtcgatcacgtcacgaccggtgctcgatttagtgacatctcgcagttctttggggactttgcctgggtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaacctgaggacgaggctcactattattgcagctcatatacaagcagcgtcactgggtgttcggcggagggaccgactgaccgtcttaggtcagcccaaggctcgccccctggtcactctcgttccccgccctcctcacgtgatcgacctgacgcgggctggcaaggcncatagnnnnnnnnn

SEQ ID NO: 257256 - DNA, 636 bp, Homo sapiens
  misc_feature: GYAE6OF02IWEAO.38.39.D06.1.454.CMB.1.raw
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (280)..(280): a, c, t, g, unknown or other
  misc_feature (280)..(280): n is a, c, g, or t
tcagtcgatcacgtcacgaccggtgctcgatttagtgacatctcgcagttcttttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataatatgtctcttggtaccaanatcaccaacntcacccaggacaaagtccccaaactcataatttangaggtcactaaacggccctcgaggtagtttactaatcgtcttctcgtggccttccaagttctcggcaacgaccggccctccctagacccattccgtctgggcctaccaaccgtggacggacggacggcctacgtaacttattacgttcgacagtcctacaatactaacaagcacgtccgtacgtacgttcgggttgttccgggacgggtacgggacccgtaccgtacggtaccggttacgttacgggtccgaccggacccgtacggcctcccgggccccccgttcgggtaccctaccgttccgttcccggttccccgtccccgttcccgttccgtaccggttcgtaccgtacccgg

SEQ ID NO: 257257 - DNA, 574 bp, Homo sapiens
  misc_feature: GYAE6OF02F26XF.38.39.D06.1.454.CMB.1.raw
  modified_base (276)..(276): a, c, t, g, unknown or other
  misc_feature (276)..(276): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcacaacatcaccaggcaaagtcccaaactcataatttangaggtcactaaacggcctcaggagtttctaatcgcttctctggctccaagtctggcaacacggcctcctgaccatctctcgggctccaacctgacgacgagctcactattattgcagctacatatacaagcagcgtctacgtttgggtcgttcgggcggtacgggaccgtacctggaccgttcgttacggtcacggtcccgaggtcctccggtccccctcgggttaccctaccgttcccgttaccggtttacccccgtcccgttacccgttccgtaccggtacgtaccgttacccggg

SEQ ID NO: 257258 - DNA, 418 bp, Homo sapiens
  misc_feature: GYAE6OF02F8KJ2.38.39.D06.1.454.CMB.1.raw
  modified_base (410)..(418): a, c, t, g, unknown or other
  misc_feature (410)..(418): n is a, c, g, or t
tcagtcgatcacgtcacgaccggtgctcgatttagtgacatctcgcagttctttggggactttgcctgggtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaacctgaggacgaggctcactattattgcagctcatatacaagcagcgtcacttgggtgttcggcggagggaccgacctgaccgtcttaggtcagcccaaggctgccccctggtcactctgttcccacctcctcacgtgatcgactgagcgggctggcaaggcgcatagnnnnnnnnn

SEQ ID NO: 257259 - DNA, 627 bp, Homo sapiens
  misc_feature: GYAE6OF02GNVA5.38.39.D06.1.454.CMB.1.raw
  modified_base (312)..(312): a, c, t, g, unknown or other
  misc_feature (312)..(312): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttggtaccaacatccaaccaacatccacccaggacaaacgtccccaaaactcaataaatttatgaggtacaactaaaccggcccctnaggtagtttactaatccgctttctctggctccaagtctggcaacacggcctccctgaccatctcgtcgggcctaccaacctggacgacgaggctacacttattatgacagctcaatataacaagcagtccgtactacgtttgggtcgttcgggacgggtacgggaacccgtaccgtacgtacccgttacgttaaggtccaacgccccgtaaggtcccgtaccggtaccccccgttcggtaccctaccggttccgttcccgttacccccctaccccgttacccgtacccgtaaccggttcgtaaccgttaacccgg

SEQ ID NO: 257260 - DNA, 571 bp, Homo sapiens
  misc_feature: GYAE6OF02GYV7Y.38.39.D06.1.454.CMB.1.raw
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatccacccaggcaaacgtccccaaactcaataatttatgaggtcaactaaacggccctcaggtatttctaatcgacttctctggctccaagtctggcaacacggcctccctgaccatctctgggcctccaacctgacggacgaggctcactattatgcngctnatatacaagcagctctacgttgggtcgttcggcgggacgggacccgacgtcgaccgttcgttacggaccacgacccgacggtccgtaccggtcccccgtcgggtacctaccgttccgttccgttacccccacccttcccgtacctaccggttcgacttacccgg

SEQ ID NO: 257261 - DNA, 428 bp, Homo sapiens
  misc_feature: GYAE6OF02JHBCD.38.39.D06.1.454.CMB.1.raw
  modified_base (382)..(382): a, c, t, g, unknown or other
  misc_feature (382)..(382): n is a, c, g, or t
  modified_base (398)..(398): a, c, t, g, unknown or other
  misc_feature (398)..(398): n is a, c, g, or t
  modified_base (410)..(410): a, c, t, g, unknown or other
  misc_feature (410)..(410): n is a, c, g, or t
  modified_base (412)..(428): a, c, t, g, unknown or other
  misc_feature (412)..(428): n is a, c, g, or t
tcagtcgatcacgtcacgaccggtgctcgatttagtgacatctcgcagttctttggggactttgcctgggtgatgttggtggttataaatatgtctcttggtaccaacatcaccaacatcacccaggcaaagtccccaaactcataatttatgaggtcactaaacggccctcaggagtttctaatcgcttctctgctccaagtctggcaacacggcctccctgaccatctctgggctccaacctgaggacgaggcctcactattattgcagctcatatacaagcagcgtcacttgggtgttcggcggagggaccgacctgaccgtcttaggtcagcccaaggctgccccctggtcactctcgttcccaccctccgtcacgtnactcgactgagcgggntggcaggcgcangnnnnnnnnnnnnnnnnn

SEQ ID NO: 257262 - DNA, 578 bp, Homo sapiens
  misc_feature: GYAE6OF02FRNLW.38.39.D06.1.454.CMB.1.raw
  modified_base (235)..(235): a, c, t, g, unknown or other
  misc_feature (235)..(235): n is a, c, g, or t
  modified_base (298)..(298): a, c, t, g, unknown or other
  misc_feature (298)..(298): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaanatcacaacatcaccaggcaaacgtccccaaactcataatttatgaggtcactaaacggccctnaggtagtttctaatcgcttctctggctccaagtctggacaacacgcctcctgaccatctcgtcgggcctccaacgtgacggacgaggctacactattatgctagctcatataacaagcagcgtctacgttgggtgttcgggcgggacgggaccgtccgtacgtaccgtcgttacggtacgacgtacccgacggtcctccggtcccccgttcggtaccctaccgttccgttcccggttaccccgccccttacccgtacgtaccggttacgacgttacccgg

SEQ ID NO: 257263 - DNA, 606 bp, Homo sapiens
  misc_feature: GYAE6OF02JDF9V.38.39.D06.1.454.CMB.1.raw
  modified_base (298)..(298): a, c, t, g, unknown or other
  misc_feature (298)..(298): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcaccaggcaaagtccccaaactcataatttatgaggtcactaaacggccctnaggtagtttctaatcgcttctctggctccaagtctgacacacggctccctgaccatctctgggcctaccaacctgacggacgacggtctcacgttatttagttcgcacgtctcaataactacaagcaagtcgtactacgttggggttacgttcgggacgggtacgggacccgtaccgtacgacccggttcttaacgggtcaacggtacccgacggtccgttccggacccccgtttcggtacctacccgttccgttcccggttaccccctacccgttcccgtacccgtaccggttcgaacgttacccgg

SEQ ID NO: 257264 - DNA, 778 bp, Homo sapiens
  misc_feature: GYAE6OF02GGLAY.38.39.D06.1.454.CMB.1.raw
tcagtcgatcacgtcacgaccggtgctcgatttagtgacatctcgcggagttctttggggactttggcctcgggtctcctggctcgacgtccttcaccttcgtcactcaggcacagggtcctcggccagtcgtcgcctcgactcgagtccgtgcctcgtgtcgttcggttctcgtggtactagtcgatcactatctcgtgcacgtcggaaccgagcgtaggtgggacggtttggttacggttaactaaagtcgggttctcgttacgttacggtaccaactatccgaacctaactctaccaccgaacggtacctaaacgttccctaaacgtacgtaatttaatttagtagtacggtacgtaaccgtaaccggtccctacggtacggttaacggtttacgtaacggtcgttacgtttctcggttcggccgttaaccaaagttcgtacggactaaacgccgggtaccttccgtacggaacctactttccgtcggttacggtactaaccctaaccggttagggacgggaacggtacgtacttacaacgtttacttacgtacgacaacgtacctaacgaactaacgtaacctaacggacgttacgtaccgttcgttaacggtttcgggttaacggtaccgggaacgggtaacggtacccgtacggtacgggttaccggtcgtacggtacgacggaccgtagggtccttaccggtccggtacgttcgaccgttcggttacccgtacccgtccttcggtaccggtacggtacttacgttaaccgg

SEQ ID NO: 257265 - DNA, 663 bp, Homo sapiens
  misc_feature: GYAE6OF02HWGX7.38.39.D06.1.454.CMB.1.raw
  modified_base (244)..(244): a, c, t, g, unknown or other
  misc_feature (244)..(244): n is a, c, g, or t
  modified_base (283)..(283): a, c, t, g, unknown or other
  misc_feature (283)..(283): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttaataaatatgtctcttggtaccaacatcaccaanatccaccaggacaaacgtccccaaactcaattaatttangaggtcaactaaccggcctacgaggtactttctaatcgtcttctctggcctacaagtctaggaccaacgaccggccctccgtacgacctatccgtacgtcggccttaccaaaccgttggacgggacgagcgtactaacttacttattgacagtacctctaattaactaaccgtaagccagtccgttacgtacgttggggttaggtttccgggacgggaccgggtacccgtaccgtaccggtaccgttccggtaggtaccgacggacccgtaacgggtccgtacccggtccccgttaccggtccgtaacccgttcccgttacccgttacccccgtaccccgtttcccgtacccggtaccggttaccggtaccgttacccgg

SEQ ID NO: 257266 - DNA, 544 bp, Homo sapiens
  misc_feature: GYAE6OF02GQ3TV.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcacaacatcacccaggcaaagtccccaaactcataatttatgaggtcactaaaacggccctcaggtagtttctaatcgcttctctggctccaagtctggcaacacggcctccctgaccatctctgggctccaacctgaggacgagctcactattatgcagctcatatacaagcagctcacgttgggtgttcgggcggacgggacccgaccgtgacccgttcttacggtccacgcccgaacggcctcggccccctggtcctacttccgttccgttcccaccccttccctacgaccgtcgtatacccgg

SEQ ID NO: 257267 - DNA, 563 bp, Homo sapiens
  misc_feature: GYAE6OF02GY7I2.38.39.D06.1.454.CMB.1.raw
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
  modified_base (403)..(403): a, c, t, g, unknown or other
  misc_feature (403)..(403): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcgttaggtaccaacatccaaccaacatccacccaggcaaaacgtcccaaatcataattangagtcaactaacgcctnagagttctaatcgcttctctgctcaagtcnggcaacncgcctcctgaccatctctggcctaccaactgacggacgagctcacttattactgacagctacatntaacagcagcgtctacgttgggcgttcgggacggacgggtaccacgtgtacccgttcgttacggtaccgacgaccccgtaggccctccggtcccccgtacggtctacccttccgtacccgttccccgtcccttcccgtacgtacggttcacgttacccgg

SEQ ID NO: 257268 - DNA, 541 bp, Homo sapiens
  misc_feature: GYAE6OF02HF2A9.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcaccaggcaaagtccccaaatcataatttatgaggtcaactaaacggccctcaggagtttctaatcgctttctctggctccaagtctggcaacacggcctcctgaccatctctgggcctccaactgaggacgaggctcactattatgcagctcatatacaagcacgcgtcacgttgggtgttcgggacggagggaccgaccgtcgaccgtcgttaggtcacgcccgaggctccggcccctggtccaccgttccttccgttcccccacccttccctaccgtacgtcgacttaccgg

SEQ ID NO: 257269 - DNA, 625 bp, Homo sapiens
  misc_feature: GYAE6OF02HZU2L.38.39.D06.1.454.CMB.1.raw
  modified_base (237)..(237): a, c, t, g, unknown or other
  misc_feature (237)..(237): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactcggaaccagcagtgacgtttggtgttataaatatgtctcttaggtaccaanatcacaacatcaccagacaaacgtccccaaactcataatttatgagtacactaaacggccctacgaggtagtttactaactcgtcttctctcggctaccaagttctacggcaaccgacggcctccctgacctatctcgtcggctaccaaccgtgacggacgaggcctcacttattattgcacgctacattactaacaagcagtccgtctacgtttgggtcgttcgggacggacgggaccgtaccgtcgtacccgttcgttacggtccacggcccgtaacgggccttcccggccccccgttacgggtaccctaacctttcccggttaccggttcccccccgtccccgtttaccccgttacccggtaccgttacggtaccgttaacccgg

SEQ ID NO: 257270 - DNA, 526 bp, Homo sapiens
  misc_feature: GYAE6OF02HPWS4.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaactgacggacgaggctcactattatgcagctcatatacaagcagcgtcacttgggtgtcggcggagggaccgaccgtcgaccgttcttaggtcacgcccgaggcgtaccggccccctcggtcaccgtcctcgttcccgccctcctccacgtgactccg

SEQ ID NO: 257271 - DNA, 645 bp, Homo sapiens
  misc_feature: GYAE6OF02GEFFQ.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacggttggtggttataactatgtctactggtaccaacaacacccaggcaaacgcccccaaactcatgatttatgaggtcactaatccggccctcgaggggtttctaatcgcttctctggctccaagtctggacaacaccggcctccctgacctatctcgtcgggcctccgaggctgaggacgaggctagtatttatacgtgacagtcttacgttagtaaggaaagtaagtacgacctacgttcgttagggttcggttccgggacgggtaacgggaccctaaggtccgtacggtacccgttaccgtaagtccgaaccggacccgtaaagggtcccttacccggtccccccgttacgggtaccctaaccgtttcccgttcccggttaccccctaccccgttcccgttaccgtaccggttcgaccgttcccgtacgtcgggaacccggg

SEQ ID NO: 257272 - DNA, 733 bp, Homo sapiens
  misc_feature: GYAE6OF02H223T.38.39.D06.1.454.CMB.1.raw
  modified_base (226)..(226): a, c, t, g, unknown or other
  misc_feature (226)..(226): n is a, c, g, or t
  modified_base (243)..(243): a, c, t, g, unknown or other
  misc_feature (243)..(243): n is a, c, g, or t
  modified_base (253)..(253): a, c, t, g, unknown or other
  misc_feature (253)..(253): n is a, c, g, or t
  modified_base (293)..(293): a, c, t, g, unknown or other
  misc_feature (293)..(293): n is a, c, g, or t
tcagtcgatcacgtcacgaccggtgctcgattttagtgacatctcgcgtaggttctttggggacttttgcctgggctctgctgctcctcaccctcctcactcagggcacagggtccctgggcccagtctgccctgactcagcctgcctccgtgtctgggtctcctggacagtcgatcgaccatctcctgcactggaaccagcagtgacgtttggtgttaataaatntgtctcttgtaaccaanatcaaccaantacaaccaggacaaacgtccccaaactcaataagtttagngaggtactaacgtaaaaccggtcctagacggttatttactaatccgctttcctctcggaccttaccgaagttccgtaggaccaaccgaccggtcccttcccgagacctaacttctacgtacgggtacctaaccgaaaccgttagaacgggtaccgtacggcttaccgtaactttaacttacgttcgaccgtagtcctacctaagttaacctaacgaaacgtcgtaacgtaccgttacgtacggttcggggttaggttccggggaacggggtaaccggtacccgtaccgttacgggtaccgtttacggtaacggtcgaaccggtacccgaacggttccccgttccggtaccccccggttacggtaccctaacccgttccgtttaccccgttaccccctaacccgttccccgtaacggtaacccgttcggtaccttacccgg

SEQ ID NO: 257273 - DNA, 574 bp, Homo sapiens
  misc_feature: GYAE6OF02IOHJY.38.39.D06.1.454.CMB.1.raw
  modified_base (341)..(341): a, c, t, g, unknown or other
  misc_feature (341)..(341): n is a, c, g, or t
  modified_base (396)..(396): a, c, t, g, unknown or other
  misc_feature (396)..(396): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataattatgaggtacactaaacggccctcaggtagtttctaatcgcttctctggctccaagtctggcaacncggcctccctgaccatctctgggcctccaacctgaggcgaggctcactattatgnacgctacatacacaagcacgcgtactacgttgggttcgttcgggacggtacgggacccgtaccgtacggaccgttcgttacggtcgacgtacccgacggcctccggtcccccgtcggtccgtaccttccgttccgttccccaccccgttcccttaccgacgttccgtacgttacccgg

SEQ ID NO: 257274 - DNA, 673 bp, Homo sapiens
  misc_feature: GYAE6OF02J14CB.38.39.D06.1.454.CMB.1.raw
  modified_base (219)..(219): a, c, t, g, unknown or other
  misc_feature (219)..(219): n is a, c, g, or t
  modified_base (247)..(247): a, c, t, g, unknown or other
  misc_feature (247)..(247): n is a, c, g, or t
  modified_base (281)..(281): a, c, t, g, unknown or other
  misc_feature (281)..(281): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatntgtctcgttggtaccaacatcaccaacntcacccaggacaacgtccccaaactcataattangagtcactaacggccctacaggtagttctaatcgtcttctctaggtctccaagtctcggtacaacgaccggcctccgtcgaccatctactcggggcctaccgaacctcggacgaccggtacggtcttaccgtaccttaatttaacgttcgtacgacgtaccttcgaattaactaacgaacgtacacggtccgttacgtacggtttgggtcggtttccgggacgggtaccggggaccgtaccgtacggttacccgttcgttacggtccaaggtccccgaagggtccgttaccggtccccccgttacgggtaccctaacccgtttccgttcccggtttaccccccgtccccgttacccgttaccccggtaaccggttccgtaacgttacccggg

SEQ ID NO: 257275 - DNA, 575 bp, Homo sapiens
  misc_feature: GYAE6OF02GHVEE.38.39.D06.1.454.CMB.1.raw
  modified_base (278)..(278): a, c, t, g, unknown or other
  misc_feature (278)..(278): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaatcagcagtgacgttggtgttataaatatgtctcttggtaccaacatcaccaacatcacccaggcaaagtccccaaactcataatttangagtcactaaacgcctcaggagtttcaatcgctttctctggactcaagttctggacaacgacggcctcctgacctatctctcgggcctaccaactgaggacgaggcctacacttattaattcgactagcctcaattactaacagcagcgtctacgttgggtcgttcgggacgggtacgggacccgtacgtagtacccgttgtacggtcacgacccgaacggtccgtcccggtaccccgtcggtaccaccgttccgttccggttcccccgcccttccccgtcgtacccgtgtaacccg

SEQ ID NO: 257276 - DNA, 738 bp, Homo sapiens
  misc_feature: GYAE6OF02GNVK5.38.39.D06.1.454.CMB.1.raw
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
  modified_base (279)..(279): a, c, t, g, unknown or other
  misc_feature (279)..(279): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatntgtctcttggtaccaanatcaccaacatcacccaggcaaacgtccccaaatcataattangagtcactaaacgccctgaggtatttcaatcgtacttctctcggctaccgaagtctggaccaacgacggtccctccctagaccctattccgtcgtcgggacctaccgaaaccctggaacggacggacggtcctacgtaacttaagtttagttcggactacgtcttacaacttaaactaaccgaaacgtacctagggtacccttacgtacggttttacggggtaacgtttccgggggacggggtaacccggggtaaccctaacccggttaccgggttaccccgtttaccgtttaaacgggtcccgaaccggtacccccggttaacgggcccttaccccggggtacccccccgtttcggggttacccctaccccggtttcccgtttacccggtttacccccccgttaaccccccgttcccgttacccggtaacccggtttccggaccctttaaccccgggg

SEQ ID NO: 257277 - DNA, 573 bp, Homo sapiens
  misc_feature: GYAE6OF02IVMX3.38.39.D06.1.454.CMB.1.raw
  modified_base (275)..(275): a, c, t, g, unknown or other
  misc_feature (275)..(275): n is a, c, g, or t
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
  modified_base (351)..(351): a, c, t, g, unknown or other
  misc_feature (351)..(351): n is a, c, g, or t
  modified_base (477)..(477): a, c, t, g, unknown or other
  misc_feature (477)..(477): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataatatgtctcttgtaccacatcacaacatcaccaggcaaacgtccccaaactcaataatttangaggtacaactaaaccggccctagaggtagtttactaatcgtcttctctggcctcaagtcnggacacncgcctccngaccatctgtggctaccgaactgacggacgaggctactactattatgactagtctacaatactaacgaagctacgctcgtacggtttgggacgttcgggacggacgggaccctacgtcgaccgttntacggtacacgtaccgagtcctccggtccccgtacgtcctaacgttccgtaccgttcccccgtcccttccgtaccgtacggttacgactacccggg

SEQ ID NO: 257278 - DNA, 756 bp, Homo sapiens
  misc_feature: GYAE6OF02I9F5W.38.39.D06.1.454.CMB.1.raw
  modified_base (209)..(209): a, c, t, g, unknown or other
  misc_feature (209)..(209): n is a, c, g, or t
tcagtcgatcacgtcacgaccggtgctcgatttagtgacatctcgcgtaggttctttggggactttcgcctgggctctgctgctcctcaccctcctcactcagggcacagggtcctggcccagtctgccctgactcagcctgcctcgtgtctgggtctcctggacagtcgatcaccatctcctgcactggaaccagcagtgacgttggnggttaataaatatgtctcttggtaaccaacatcaaccaacatcacccaggacaaaacgtcccctaaaatcaattaatttatggaaggtacaacgtaaaacggccctcaagggtactttacctaatcgtaccttctctcggtacctacctaagttcttggacctaaccgaccgggtcccttcccgacgtaaccgtataccgtcgtcgggccttacccgaaacgtggaacggtacgtacggtacctttaacctaacttaagttttaacgtttcggacctaggtaccttacgtaaattacgttaaaccgaacggacctaacggtacccgtacgttaacggttttcggggttaggtttacccggggacggtaaacggggtacccttaaccgtcgggttaaccgtttaccgttacgggtacctaaccggtacccgttaaccggggcccgttaccgggtccccccgttaacgggttaccgtaccgttacccgtttacccggtacccccgtcccggttacccttaccggtaaccgttcggtaacccttaccggg

SEQ ID NO: 257279 - DNA, 603 bp, Homo sapiens
  misc_feature: GYAE6OF02FFY7E.38.39.D06.1.454.CMB.1.raw
  modified_base (234)..(234): a, c, t, g, unknown or other
  misc_feature (234)..(234): n is a, c, g, or t
tcagtcgatcacgtcacgaccggtgctcgatttagtgacatctcgcagttctttggggactttgcctgggctctgctgctcctcaccctcctcactcagggcacagggtcctggcccagtctgccctgactcagcctgcctccgtgtctgggtctcctggacagtcgatcaccatctcctgcactggaaccagcagtgacgttggtggttataaatatgtctcttggtaccaantcaccaacatcaccagcaaacgtcccaaactcataatttatgagtcactaaacggccctcaggtagtttctaatcgcttctctggtcctccaagttctggacaacgacggtccctcctcgacccatcctctgggcctccaacctgagcgaggctcacttatacttgacagctacataattacaagcaagccgtctacgtttgggttacgttcggacgggtacgggtacccgtaccgtcggttaacccggtcttaaacgggtccacggaccctaacgggtccgtccccggtacccccgtcggttaccccgtaccttacccgttcccggtttccccgcccttcccgttccgaccgttacggtacctaccgg

SEQ ID NO: 257280 - DNA, 674 bp, Homo sapiens
  misc_feature: GYAE6OF02HORGS.38.39.D06.1.454.CMB.1.raw
  modified_base (285)..(285): a, c, t, g, unknown or other
  misc_feature (285)..(285): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttggtaaccaacatcaccaacatcacccaggacaaacgtaccccaaactcaataatttangtaggtcaacgtaaaaccggccctacgtaaggtacgtttactaactcgtctttctcgtggtctaccaagtcgtggacaacgtaccggccctcccgtacgacctacttctacgtcggcctacccgaaccgtggaacggacgacggtacctaccgtaactttagttaagttcgacgtacgtctacaattaactaacgaacgtcacgtccgtactaacggtttgggtacgttccgggacgggtacggtacccgtacgtacgtaccggttcgttacggctaaccggacccgtagggtcccgttacccggtccccccgttcggttaccctaccgttcccgttacccgttacccctaccccgttaccctacggttaccgttcgaccgttacccgg

SEQ ID NO: 257281 - DNA, 606 bp, Homo sapiens
  misc_feature: GYAE6OF02IUZE7.38.39.D06.1.454.CMB.1.raw
  modified_base (217)..(217): a, c, t, g, unknown or other
  misc_feature (217)..(217): n is a, c, g, or t
  modified_base (223)..(223): a, c, t, g, unknown or other
  misc_feature (223)..(223): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatntgtctnttaggtaccaacatcaccaacatcacccaggcaaacgtaccccaaactcaataatttatgaggtcaactaacggccctcaggtagttctaatcgtcttctctgctcaagtctggcaacacggcctccctgaccatctcgtcgggcctccaacctgacggacgacggctacacttaatttatcgactacgctacatactaacgaagcacgtcgtcacgtttgggttcggttcgggcgggacgggacccgtaccgtcgtacccgttacgttacggtaccgtacgacccgacggtaccgtccggtacccccgttcggtacctaccgttacccgttccgtttacccccggcccgttacccgttccgtaccgttcgtacgttacccgg

SEQ ID NO: 257282 - DNA, 889 bp, Homo sapiens
  misc_feature: GYAE6OF02G6JR7.38.39.D06.1.454.CMB.1.raw
tcagtcgatcacgtcacgaccggtgctcgatttagtgacatctcgcggagttcgttggggacgtttgccctgggctctggcttcgcgtcttccaccttccgtcactcagggcacagggtacctggcccaggtctcgccctgacgtcttaggcctggcctccgtgggtttccttggggttcctccttggaaacgtaggttccgatcgtaccagttctcctaggctacgtgggaaccagtcgaggtgacgtttggtaggttactaaacgtgggtccgtcgtacgttacggtaccctaacctagttccgaaccgtaacctacttccggtaaccccaacgggtccaaaaaccggttaccccctaaaaaccttcctaatttaaacgttttaacgtcgtaacggggttacccaacccgttaaaaccggggccccttaccggaagggggtaaaccggggttttccttaaaggtaccgggttccggttttaccgttaccgttacgggggttaccttttacccgtaaaggggtttccggttaggggtaccggtaaaccgaccggggtaccccgttacccttacggaaccctaagttcccttacccggtggggaacccgttacccaaaccgttcggaaccggaccggtacggtacctacgaacgttaacttaacgttcgacctaggaccttacgacttacgtactaacgtacaagtcgtacctacggttcgggtacgttaccggggacggaccgggtaacccgaccgtacgggtacccgttacgttacggttacgacggtcccggaacggtccggtaccggtcccccggtacgggtccggaaccgttcgttaccgttccccggaccctttaccgtccgaccggttggaccggtacccgg

SEQ ID NO: 257283 - DNA, 696 bp, Homo sapiens
  misc_feature: GYAE6OF02JVN8Q.38.39.D06.1.454.CMB.1.raw
  modified_base (236)..(236): a, c, t, g, unknown or other
  misc_feature (236)..(236): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatcctcctgcactggaaccagcagtgacgttggtgttaataaatatgtctcttgtaccaacntcaccaacactcaccagacaacgtccccaaactcaattaattatgagtacaactaaccgccctacgtagtacgttactaatcgtcttctacgtcgcctacgaagtcgtacggaccaacgaccggtccctaccgtcgaacctcttaccgtcgtcggtacctacccgtaacgtcggacgggacgtacggtacctacgtaacgtttaacttagttcgacgtacgtcctactaaagttaactaacgaacggtacctaggtcccgttacttaccgggttggggttaccggttccggggaccgggtaccgggtaacccgtaccgtaccggttaccgttaggtaccggtaccgaccgtacccgtacggcccgttccccggaccccggttccggttaccctaccttcccggttacccgttccccccgtacccgttcccgttacccgacccggttacgaccgtacccgg

SEQ ID NO: 257284 - DNA, 740 bp, Homo sapiens
  misc_feature: GYAE6OF02JRZUO.38.39.D06.1.454.CMB.1.raw
  modified_base (171)..(171): a, c, t, g, unknown or other
  misc_feature (171)..(171): n is a, c, g, or t
  modified_base (187)..(187): a, c, t, g, unknown or other
  misc_feature (187)..(187): n is a, c, g, or t
  modified_base (212)..(212): a, c, t, g, unknown or other
  misc_feature (212)..(212): n is a, c, g, or t
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
  modified_base (274)..(274): a, c, t, g, unknown or other
  misc_feature (274)..(274): n is a, c, g, or t
tcagtcgatcacgtcacgaccggtgctcgatttagtgacatctcgcagttctttgggactttgcctggctctgctgctcctcaccctcctcactcaggcacagggtcctgggcccagtctgccctgactcagcctgcctccgtgtctgggtctcctggacagtcgatcacntctctgcactgaaccngcagtgacggttggtagtaataatntgtctcgttagaccaanctacgaacaactntccaccgagacaacgacccaactcactattangtagtacaacgtaaccgcctagaacgtacttacaactcgctttctcgtaggtcctacgtaacgttcgtacggtaccaaacgtacccggtcccttacccgtacgtaacctcttaccggtcggtttacgggaacccttaccgaaacccgtcggtaaacggaccggtacgacccgttacgtaaccgtttaagtttacgttacgaacccgtcggtaacctactaaacgttaacctaacggaaccgtacggtaaccgtacgtaccttacggttaacgggttccgggtttaccgggaacggtacggggaacccgtacgttaccggtaccgttacggttaggttacccgacggtaccccgaacggttccgcccggtaacccccggttcgtaacccgtaacccgtttccggttcccggtttcccccgtaccccgttcccgttaaccgtaccgggtttaccgaccgttaacccgg

SEQ ID NO: 257285 - DNA, 544 bp, Homo sapiens
  misc_feature: GYAE6OF02GUI00.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggaccaacatcaccaacatcacccaggcaaagtccccaaactcataatttatgaggtcactaaacggccctacaggagtttctaatcgcttctctggctccaagtctggcaacacggcctccctgaccatctctgggctaccaacctgacggacgaggctcacttattattgcagctcatatacaagcagccgtcacgtttcgggtgttccggacgggacgggacccgaccgtggtacccgttgtacggtcacgcccgagcctccgccccgtcggtctacttcctccgttcccgccctcccgtcaccgtgacgtaccg

SEQ ID NO: 257286 - DNA, 748 bp, Homo sapiens
  misc_feature: GYAE6OF02H1W8V.38.39.D06.1.454.CMB.1.raw
  modified_base (236)..(236): a, c, t, g, unknown or other
  misc_feature (236)..(236): n is a, c, g, or t
  modified_base (245)..(245): a, c, t, g, unknown or other
  misc_feature (245)..(245): n is a, c, g, or t
  modified_base (281)..(281): a, c, t, g, unknown or other
  misc_feature (281)..(281): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttaataaatatgtctctaggtaccaanatcaccaanatccaacccaggacaaacgcccaaatcaataattangacgtacaactaaaccggcctacgaggtagtttactaactcgtcttctcgtcggaccttaccaagttcgacggtacaaaccgtacccggtcccttaccctaggtaaccctacgttccgtccgtcgggtaccttacccaaaccgttggaaaccgggacgacggtactaccgtaactttagtttaacgtcgacgtaacgtacttacaattaacgtaaacaacggtacgtaacgtacccgttacgttaacgggtttggggtttaacgggttaccggggacgggtaacccgggtaacccgttacccggttacgggttaaccccgttcgggttaaacggtcccgtaacgggaccccgaacggttcccggttccccgtaacccccggttcggttaacccgtacccgtttacccgttccccgttaccccctaccccgtttaccgtacccgtacggttaccgtacgttaccccgg

SEQ ID NO: 257287 - DNA, 518 bp, Homo sapiens
  misc_feature: GYAE6OF02F7IWJ.38.39.D06.1.454.CMB.1.raw
  modified_base (508)..(508): a, c, t, g, unknown or other
  misc_feature (508)..(508): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggtttataaatatgtctcttggtaccaacatcaccaacatcacccaggcaaagtccccaaactcataatttatgaggtcactaaaacggccctcaggagtttctaatcgcttctctggctccaagtctggcaacacggcctccctgaccatctctgggctccaacctgaggacgaggctcactattatgcagctcatatacaagcagcgtcactttgggtgttcggcgggacgggaccgacctgaccgtcttaggtcagcccaggctcgcccctggtccactctcgttcccgccctcctcncgtcgatccg

SEQ ID NO: 257288 - DNA, 563 bp, Homo sapiens
  misc_feature: GYAE6OF02IFED9.38.39.D06.1.454.CMB.1.raw
  modified_base (193)..(193): a, c, t, g, unknown or other
  misc_feature (193)..(193): n is a, c, g, or t
  modified_base (236)..(236): a, c, t, g, unknown or other
  misc_feature (236)..(236): n is a, c, g, or t
  modified_base (245)..(245): a, c, t, g, unknown or other
  misc_feature (245)..(245): n is a, c, g, or t
  modified_base (421)..(421): a, c, t, g, unknown or other
  misc_feature (421)..(421): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccngcagtgacgtttggtgttaataaatatgtctcttggtaccaanatcaccaanatcaccaggcaaagtccccaaactcataatttatgaggtcaactaaaccggccctacaggtagtttactaactcgcttctctggctaccaagtctggactaacacggtcctccgtgaccatctcgtaggctccaactgacggacgagctcactattatgcagctacagtacacgancagcgtcacgtttgggtgttcgggacggacggaccgtacgtcgaccgttacgtacggtcacggacccaaggtcccgtcgcccccggttcggtcctaccttccgtacgttccccgcccttccgtccgacgttcgtactaccgg

SEQ ID NO: 257289 - DNA, 598 bp, Homo sapiens
  misc_feature: GYAE6OF02G229X.38.39.D06.1.454.CMB.1.raw
  modified_base (238)..(238): a, c, t, g, unknown or other
  misc_feature (238)..(238): n is a, c, g, or t
  modified_base (352)..(352): a, c, t, g, unknown or other
  misc_feature (352)..(352): n is a, c, g, or t
  modified_base (368)..(368): a, c, t, g, unknown or other
  misc_feature (368)..(368): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttaataaatatgtctcgttaggtacccaanatccaaccaacactaccacccgaggacaaaacgtccccaaactcaattaatttatgagtacaacgtaaccggccctagaggtagtttctaatcgtcttctctggctccaagtcnggcaacgccgcctccngacctatctcgtggcctaccaaccgtggacggacgacgctactacttattatcgacagtctactataacacgaagcgacgtccgtactacggttgggtcgttccgggacgggtacggacctacgtcgtaccgttcgttaggccacgtacccgaggtcctccggccccgttacggtacctaccgttccgttaccggttccccgacccttcgaccgtacggttcacgtccgg

SEQ ID NO: 257290 - DNA, 716 bp, Homo sapiens
  misc_feature: GYAE6OF02HLT91.38.39.D06.1.454.CMB.1.raw
  modified_base (193)..(193): a, c, t, g, unknown or other
  misc_feature (193)..(193): n is a, c, g, or t
  modified_base (694)..(694): a, c, t, g, unknown or other
  misc_feature (694)..(694): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccngcaggtgacgtttgggtaggttaataaagtatgttctcgtttagggtaccaaacactcaacctaaacatccaaccccaggaccaaaaacgtccccaaaactctaattaaactttaataggtaagttaccaaactaaaaccggtccctacgaaggtactttacgtaaatccgactttcgtcgttacggactcctaaagttcttcggacaaacccgaacggtcccttaccccgtgaaccctaattccgtacggttcgggtaccctacccgtaaaccgtgaacgggaacgtagggacctacgtaacctaatttattacgcgtaacgccttacaataactaaccgtaaagaccgacgtaccgtactaacggttcgggttacggtttaccgggggacggtaacggggacccgtaaccgttacgggtaaccgtttcgtacggttaccacgtacccgacggtcgtacccgccccgtcgtaccgtaccgttccgtccgttaccctcccnccttcgaacgttcgactaccgg

SEQ ID NO: 257291 - DNA, 846 bp, Homo sapiens
  misc_feature: GYAE6OF02JYIHB.38.39.D06.1.454.CMB.1.raw
  modified_base (196)..(196): a, c, t, g, unknown or other
  misc_feature (196)..(196): n is a, c, g, or t
  modified_base (253)..(253): a, c, t, g, unknown or other
  misc_feature (253)..(253): n is a, c, g, or t
  modified_base (369)..(369): a, c, t, g, unknown or other
  misc_feature (369)..(369): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctaggacagtcgatcaccatctcctgcacgtcggaaccngctaggtgaccggttgggtcggttaataaagtatggttcctacgttggtaccaaacntacgaaccaactatcaccaggctaaacgtcccaatcaagtaattcagaggttccaacgtaaacggccctagaggtagttactatccgtactccgttctcggcttaccgaacggttnacgggacctaaaccgtaacgggtcccttccccgtccgaaccgtaaccttccttccggtacggggtaccctacccggtaacccttacgggacggtaaaccgggtacggtacctacccgttaaaccgttaaattttaacggttacggacccgtacggttacgttacccctaagttaaaccttaaaccgtaacgtaaacccgcgggtacccgttaaacgttcggttaccggggggtttaacggtttaccggggacccgggaacggggggtaacccccgtaccggttaacccgggtaaccgtttccggttttacgggaccggtaaacgggtaacccccgtacgggtacccgttacccggggtacccccccgtaacgggttcccgtaacccgttttaaccgggtaacccccgttttccccggttcccccgggtacccccttacccggggtaaaccgggtttctaaccgggggtttaaccccc

SEQ ID NO: 257292 - DNA, 679 bp, Homo sapiens
  misc_feature: GYAE6OF02IC93L.38.39.D06.1.454.CMB.1.raw
  modified_base (238)..(238): a, c, t, g, unknown or other
  misc_feature (238)..(238): n is a, c, g, or t
  modified_base (289)..(289): a, c, t, g, unknown or other
  misc_feature (289)..(289): n is a, c, g, or t
tcagtcgatcacgtcacgaccggtgctcgatttagtgacatctcgcagttctttggggactttgcctgggctctgctgctcctcacccctcctcactcagggcacagggtcctgggcccagtctgccctgactcagcctgcctccgtgtctgggtctcctggacagtcgatcaccatcctctgcactggaaccagcagtgacgttggtaggttaataaatatgtctcttggtaaccanatacaccaacatccacccaggaccaaacgtccccaaactcaattaatttangaggtacaactaaaccggccctagaggtactttactaacgtcgcttctacgtcgctaccaagtcgtaggacaaccgccgtcctccctagacctatctcgtcggacctaccaaccgtgacggacgacgtctacgtaacttacttatcgacgtacgccttaataacgttactaaacgtaacgcgtaacgtccgttacgtacggtttcggggttacggttcggggaccgggtaacgggtacccgtaaccggttaccgttaaccggttcgttacgggaccaccggacccgtaggtccgtaccccggtcccccggttaccggtaccttcccgttacccgttcccggttcccccgttcccgtacccgttaccgacggtttaccgccgttacccggg

SEQ ID NO: 257293 - DNA, 610 bp, Homo sapiens
  misc_feature: GYAE6OF02ILS9E.38.39.D06.1.454.CMB.1.raw
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (269)..(269): a, c, t, g, unknown or other
  misc_feature (269)..(269): n is a, c, g, or t
  modified_base (411)..(411): a, c, t, g, unknown or other
  misc_feature (411)..(411): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtgatcaccatctcctgcacgtggaaccagcagtgtacgttggtggttatgactatgtctcctgaccaacaccncccgaccaaacnccccaaatcatgtatttangagtcagtaacgtccggtcccgttggggtttactaagttcggttctcgtcggtctccgtaagtctggaccaacgaccgtccctccgtgacctatcgtcgtcggcctcgagtctggacgacgtaggtctagtatttactacgngcacgtctactattactacagcacgtctacttcgtaggttgggtcggtaccggggacgggacaaggtcctacgggtacccgttcgtacgtccgacgtacccgagtcccgtccgcccgtgtacctccgttcttccccgttaccctaccgttcccgtacgtaccgttacgtacgtaccggtacgtacgggtacggtccggg

SEQ ID NO: 257294 - DNA, 755 bp, Homo sapiens
  misc_feature: GYAE6OF02J2PSC.38.39.D06.1.454.CMB.1.raw
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctccgtggacagtcgatcgaccatctctgcactggaaccagcagtgacgttgtggttaanaatntgtctcgtgtaccaacatcaccaactatccaccagacaaacgtaccccaaacgtctattaactttagtcgacggtacctaaccgtaaacggccctacgacggtactttacgtaactccggtacttccgtacgtcggtccttacccgtaaaggttcctaggtacctaaccgaccgggtccctttaccccgtaggaacccctagttccctcggtacgggtaccctacccgaaaccgtggtaccggacggtacgtacccgtactaactttaacgtttacgtcgtacgtacgtcctacgtaatacaacgaacgtacgacgtccgttacgtacggtttcggggttacgttaccgggaccgggtaaccgggtaccgtaccggttacgttacccggtttacggtaccggttaccgaccgtacccgtaacggtcccggttacccgggtacccccgttaccggtaccgttaccccgttcgttaccccgggttccccctacccggttaccccttacccggtaccggttacgtacccgttaacccggg

SEQ ID NO: 257295 - DNA, 656 bp, Homo sapiens
  misc_feature: GYAE6OF02G2QA6.38.39.D06.1.454.CMB.1.raw
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctccgtggacagtcgatcaccatcctcctgcactcggaaccagcagtgacgttggtgttaataatntgtctcttacgtaccaanatcaaccaacactccacccgaggacaaacgtaccccaaactctaataatttacagtacggtactaaccgtaaaccggcccctacgtacggtacgtttactaactccgtccttctccgtcggtacctacctaagtccgtacggaccaaaccgtaccgtcccctccgtacgaacctactccgttcgtcggtcctacccgacgtagacggacggagtctacctacttattactacgtcacgtctactaactactacgacgacgacgtccgtactacggttcggttcggtcgggacgggtacgggacccgtccgtacgtaccggtcgttacggacgaccgaccgacgtccgtcccggtcccgtccgtacgtaccttcccgttcctacccgtaccctacccgtccgtaccgtacgacctacgg

SEQ ID NO: 257296 - DNA, 834 bp, Homo sapiens
  misc_feature: GYAE6OF02FVV52.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtaggttaataaatatgtctcgttggtaccaacatccaaccaactactcacccagacaaacgtccccaaactcaattaatttatgaggtacaactaaaccggccctacgaggtagtttactaactccgtctttcctcgtcggtccttacctaaggttcctcgggaccaaccggaaccggtccccttacccgtacgaccctacgttcccgttcgtccggggtacccttacccgtaaacccgtcgggtaaccgggaacccggtacgggcctttacctaaaccgttttaagtttacgtttacggaccgtaacggtacccttactaacttaaacgttaaccgaaacggtaccgtacggtacccggttacgtttaaccggttttcgggggtttaccggtttaccgggggaccggggtaaccgggggtaccccgaacccggttacggtaaccccgggttacggttttaaaccggtaccgtaccgggtaccccggttaacgggtcccgttcccgggtacccccccggtttccggggttccccttaaccggtttcccccgtttccccgggtttccccccgttcccccgttacccggttacccggtaaccgggtttaccgtacccggtttaacccggg

SEQ ID NO: 257297 - DNA, 709 bp, Homo sapiens
  misc_feature: GYAE6OF02H15TK.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctctttggaccaacatccaaccaacatccaccaggcaaacgtccccaaatcataatttatgagtcaactaaacggccctcaggtagtttactaatcgtacttctctcggcttaccaagtcgtacggcaaaccgaccgggacccttcccgtcgaacccaatttcctcggttcggggtaccttaccccgtaaacccgttggaaccggggaccgtaacgggtcccttacgtaaacctttaatttacgtttacggcctaacgtccgttactaacttaacgtaaccgtaaacgacctaacggtcccgttacgtaccgttttaggggttcggttccggggaccgggtacggggaacccgtacccgtcggtaacccgtttacgtacgggttaccaccggtcccgaacggtcccgtaccggtccccccgtcggtaccctaccgtaccgttccgttccccgaccccttcccgtaccgaccgttacgacgttaccgg

SEQ ID NO: 257298 - DNA, 663 bp, Homo sapiens
  misc_feature: GYAE6OF02I17DQ.38.39.D06.1.454.CMB.1.raw
  modified_base (216)..(216): a, c, t, g, unknown or other
  misc_feature (216)..(216): n is a, c, g, or t
  modified_base (281)..(281): a, c, t, g, unknown or other
  misc_feature (281)..(281): n is a, c, g, or t
  modified_base (353)..(353): a, c, t, g, unknown or other
  misc_feature (353)..(353): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctctgcactggaaccagcagtgacgttggtgttataaatntgtctcttggtaccaacatcaccaacactcacccaggacaaacgtccccaaatcaattaatttangaggtcaacctaaaccggccctcgaggtagtttactaactcgtcttctcgtgcctccaagtctcggacaacnccggtccctccctagacctatcgtcgtcggtcctacccaacctggacgggtacgacggtacctacgtaacttacgtttacttggacctagccttactaactaactaacgaacgacgacggtaccgttacgttacggtttggggttacgggttccgggaccggggtacggacccggtaccgtacggtaccgttacgttacggtccacggacccgtaagggcccgttacccggcccccgttacggtacctaccgttcccgttacccgttacccctacccggttaccctaccggtacgtcgtacccgtaccgg

SEQ ID NO: 257299 - DNA, 635 bp, Homo sapiens
  misc_feature: GYAE6OF02HDS0D.38.39.D06.1.454.CMB.1.raw
  modified_base (220)..(220): a, c, t, g, unknown or other
  misc_feature (220)..(220): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatcctcctgcactggaaccagcagtgacgttggtagttaataaatntgtctcttcggtaccaacatacaccaacactccacccagacaaacgtccccaaactcaactaatttatgaggtctaactaaaccgccctcgaggtacgttctaatcgtcttctctggctcatcgtgcaacacgcctccctcacctactctcgtcgggtcctaccctaaccgtggacggacgtaacggtacctacgtaacttaatttacgttagcctacgtctactaacgtaactaacaaacgtcaacgtccgtactaacggtttgggttcgttaccggggacgggaccgggtacccgtaccgtcgtaaccgttcgttacggacctaacgccgacggtcctcccggtccccggtccgtaccgtaccgttcctccgttaccccctaccctacccgtacctccgtacgtaccgtaccg

SEQ ID NO: 257300 - DNA, 512 bp, Homo sapiens
  misc_feature: GYAE6OF02H7ZEX.38.39.D06.1.454.CMB.1.raw
  modified_base (235)..(235): a, c, t, g, unknown or other
  misc_feature (235)..(235): n is a, c, g, or t
  modified_base (299)..(299): a, c, t, g, unknown or other
  misc_feature (299)..(299): n is a, c, g, or t
  modified_base (340)..(340): a, c, t, g, unknown or other
  misc_feature (340)..(340): n is a, c, g, or t
  modified_base (349)..(349): a, c, t, g, unknown or other
  misc_feature (349)..(349): n is a, c, g, or t
  modified_base (390)..(390): a, c, t, g, unknown or other
  misc_feature (390)..(390): n is a, c, g, or t
  modified_base (415)..(415): a, c, t, g, unknown or other
  misc_feature (415)..(415): n is a, c, g, or t
  modified_base (496)..(496): a, c, t, g, unknown or other
  misc_feature (496)..(496): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaanatcaccaacatcacccaggcaaagtccccaaatcataatttatgaggtcaactaaacggccctnaggtagtttctaatccgcttctctggctcaagtctgcaacncggcctccngaccatctcgtggcctccactgaggacgagctcactatttntgctagcctcatatacaagcagctnacgttggtgttcggacggtcggaccgactgaccgttcgtaggcagaccgagcctcggccccttcgcaccttctacgtcccncctcctcacgtcatcg

SEQ ID NO: 257301 - DNA, 685 bp, Homo sapiens
  misc_feature: GYAE6OF02I7UED.38.39.D06.1.454.CMB.1.raw
  modified_base (250)..(250): a, c, t, g, unknown or other
  misc_feature (250)..(250): n is a, c, g, or t
  modified_base (384)..(384): a, c, t, g, unknown or other
  misc_feature (384)..(384): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgtacgttggtagttaataaatatgtctcgttagtaccaactatacaaccaanactccaaccaggacaaacgtccccaaactcaattaattatgagtaccaactaaaccggccctacgaggtagtttacaatccgtacttctcgtcggcctcaagtctaggacaacaccggccctccctagaccctnttctcgtcgggcctacccaaccgtggaacggacgagtctacgtaactttagttatcgaccgaagtcctactaataacgtacaaacggcctaacggtaccgtccgttaacgggtttcgggttacgggttacggggtaccgggtaccggggtaaaccccgtacggttccgtaccgtttaccggttacggaaccaccgggtacccgtacgggtccgtaccccggtccccgtttaccggtacctaccgttcccgttaccccgttacccctaccccgttcctacccggtacgtacgtacgtaccgg

SEQ ID NO: 257302 - DNA, 722 bp, Homo sapiens
  misc_feature: GYAE6OF02HJ1I5.38.39.D06.1.454.CMB.1.raw
  modified_base (219)..(219): a, c, t, g, unknown or other
  misc_feature (219)..(219): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatntgtctccgtaggtaccaaacaaccaccaggaccaaacgacccccaaactcatactattatcgacgtcactcacgtccggtcctacgtacggggtttctaccgtcgtcctttctcgtcggtaccttaccgtaaggtttcggacctaacgaccggtcccctcccgtacgtacctacgttttcgtacgggtcctaccgaggtcgtacggaacgggtacggacggtacgttagtttaatttttacgtacgtccttaccgtactaataactacgaggccaggacctacgtacccttaacccgttagttccgttaccgttaccgggaacgtccgggtaaccgtaaccggtccctaacccgttaccgtaccgtacgacccgtaacccgaaccgtaaccccaacccgtacgtaccgtacctacccgttccgttaccccgttaccccgtaccccttaccgtacccgtaacggttacgtacccgtaccggtaccgtcggtaccggtacccggg

SEQ ID NO: 257303 - DNA, 716 bp, Homo sapiens
  misc_feature: GYAE6OF02JUOJ6.38.39.D06.1.454.CMB.1.raw
  modified_base (129)..(129): a, c, t, g, unknown or other
  misc_feature (129)..(129): n is a, c, g, or t
  modified_base (164)..(164): a, c, t, g, unknown or other
  misc_feature (164)..(164): n is a, c, g, or t
  modified_base (217)..(217): a, c, t, g, unknown or other
  misc_feature (217)..(217): n is a, c, g, or t
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
  modified_base (462)..(462): a, c, t, g, unknown or other
  misc_feature (462)..(462): n is a, c, g, or t
  modified_base (654)..(654): a, c, t, g, unknown or other
  misc_feature (654)..(654): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctnactcagcctgcctccgtgtctgggtctcctggacngtcgatcaccatctcctgcactggaaccagcagtgacgttggtagttataatntgtctnttgaaccanctcacanatcacccaggacaacgtaccccaatccaagttacttatcgagtccaactaaaccggcctacaggtaactttactaatccgtctttaccgtcgtggacccttaccgaaggtctcgggaacctaacggtaccggccctttcccgacgtaccctaacttcgtcggtcgggtacctacccgtaacggtgaaacgggaccgtacgggccttaccacgttaatttacgngtaccctaggacctactaacggttaacaaccgaagtacgacgtaccgttaacgtcgggtttacggggttaccggtttacgggaccgggttaacgggaacccctacgggtaccgttaaccggttcggtttaaaccggccgttaacgggaaccccgagggttccctcccggtaacccccggttcgttaaacccnccggttttaccctacccgttacccccgtacgttcccgacgttacggtccggtaacctccggg

SEQ ID NO: 257304 - DNA, 769 bp, Homo sapiens
  misc_feature: GYAE6OF02HV0TQ.38.39.D06.1.454.CMB.1.raw
  modified_base (230)..(230): a, c, t, g, unknown or other
  misc_feature (230)..(230): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctcgtgtctgggtcctcctggacagtcgatcaccatcctcctgacactcggaaaccagtcaaggtgacgtttggtaggttaataaaactntggtctacgttacggtaaaccaactattccaaaccccaaataactacccgaaacccccgaagggaacctaaaaccgtaccccctaaaactcctaaagtttaaatttactaggaacggtacctaaaccgtaaaacccggtccctacgtaaggtacgtttacctaaagtccgtactttctacgtcggacttaccgaagtcgtacggtacaaaccgaccggtcctacccgtcgaacctacgtctcgtacggtcctacccgaaacgtcggaacgggacgacggtacctctaacttaaacgtttagtcgacctaagccttaacaattaacaacgaaacgctaacgtccgttacgtagtttcggggttgttaccggggaccggtaacgggtacccgtaccgtaccgtaccgttaccggttacggaacacggtacccgacggtacctcccggtaccccccgttacggtcctaaccgttccccgttcccgtttccccccggtacccccttcccgtaacccggttacggtccgtaacccgttacccgg

SEQ ID NO: 257305 - DNA, 625 bp, Homo sapiens
  misc_feature: GYAE6OF02GZZ7I.38.39.D06.1.454.CMB.1.raw
  modified_base (220)..(220): a, c, t, g, unknown or other
  misc_feature (220)..(220): n is a, c, g, or t
  modified_base (240)..(240): a, c, t, g, unknown or other
  misc_feature (240)..(240): n is a, c, g, or t
tcagtcgatcacgtcacgaccggtgctcgatttagtgacatctcgcagttctttggggactttgcctgggctctgctgctcctcaccctcctcactcagggcacatggtcctgggcccagtctcgccctgactcagcctgcctccgtgtctgggtctcctggacagtcgatcaccatctcctgcactggaaccagcagtcgacgttggtgttaataaatntgtctcgttcggtaaccaanactcaaccaacactacacccaggacaaacgtaccccaaactcaattaatttatgaggtaccaacgtaaaccggtccctacgtaaggtacgtttactaacgtcgtacttctcgtggtcctaccaagtcgtggaccaacgacggtccctacctacgaccattccgtcgtcgggtcctaccaaccgtcgaacggacgacggacctactacttacttatgacagctacatacacacgacagtctctaggttggtcggtcggcggacgggacccgaccgtcgtaccgttacgttacggactaccggaccgtaacggtccgtccggtcccccgttcggtacccgtacgttccgtccgttaccccgtcccgttacctccgtacgtctaccgg

SEQ ID NO: 257306 - DNA, 569 bp, Homo sapiens
  misc_feature: GYAE6OF02FZ9RS.38.39.D06.1.454.CMB.1.raw
  modified_base (333)..(333): a, c, t, g, unknown or other
  misc_feature (333)..(333): n is a, c, g, or t
  modified_base (341)..(341): a, c, t, g, unknown or other
  misc_feature (341)..(341): n is a, c, g, or t
  modified_base (351)..(351): a, c, t, g, unknown or other
  misc_feature (351)..(351): n is a, c, g, or t
  modified_base (393)..(393): a, c, t, g, unknown or other
  misc_feature (393)..(393): n is a, c, g, or t
  modified_base (416)..(416): a, c, t, g, unknown or other
  misc_feature (416)..(416): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttaggtaccaacatcacaactactcacccagcaaagtccccaaactcataattatgaggtcactaacggccctacaggtatttctaatcgcttctcgtggctacagtntggcaacncggcctcctnaccatctctggctcacgtggagacgagctcactattatgacngctacatatacaagcagtccgtntacgttgggtacgttcgggcggtacgggaccgtaccgtgtaccgttcgtacggttacgacgacccgtaggccttaccggccccgttcggtacctaccgttccgttaccggttccccgtaccttccccgtacgtaccggttcgacgttacccgg

SEQ ID NO: 257307 - DNA, 683 bp, Homo sapiens
  misc_feature: GYAE6OF02IX0W0.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccacatcacaacatcaccaggcaaacgtccccaaactcataattatgaggtcaactaaacggccctcaggtagtttcaatcgcttctctggctacagtctggcaacacggcctcctcgacctagtctcgtcgggcctacccaaccgtcggacgggaacgacggccttactaaccttattaatttgaccgtaacgtctactaaacgttataaaccgaagccgtaacggtcctacgtaccggttttggggtcggtttaccggggaccgggtaacgggtacccccgtaccggttacggtaccccggttttacgtttacgggtaccaacgggttaccccgaacgggtacccgtccccggttaccccccggtacgttaccctaacccgttcccggttccgttttacccccccggccccgtttcccttacccggaccgtttcggtacccttaacccggg

SEQ ID NO: 257308 - DNA, 587 bp, Homo sapiens
  misc_feature: GYAE6OF02GO3SA.38.39.D06.1.454.CMB.1.raw
  modified_base (236)..(236): a, c, t, g, unknown or other
  misc_feature (236)..(236): n is a, c, g, or t
  modified_base (351)..(351): a, c, t, g, unknown or other
  misc_feature (351)..(351): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttggtaccaanatcaccaacatcacccaggacaaacgtccccaaaactcaataatttatgaggtcactaaaacggcccctacaggtagtttactaatcgtcttctctggctccaagtctggcaacncggcctcctgaccatctcgtcgggcctcccgaacctgacggacgaggctcactattatgcagctcatatacaagcagcgtctacgttgggtgttccgggacggtacgggacccgtaccgtcgtaccgttcgttacggtaccgacgacccgaaggccgtaccggcccccgttacggtaccctaccgttccgttccgttcccccggcccttcccgtctacccggttcgacgtacccgg

SEQ ID NO: 257309 - DNA, 436 bp, Homo sapiens
  misc_feature: GYAE6OF02F9IR0.38.39.D06.1.454.CMB.1.raw
  modified_base (416)..(416): a, c, t, g, unknown or other
  misc_feature (416)..(416): n is a, c, g, or t
  modified_base (423)..(436): a, c, t, g, unknown or other
  misc_feature (423)..(436): n is a, c, g, or t
tcagtcgatcacgtcacgaccggtgctcgatttagtgacatctcgcagttctttggggactttgcctgggtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgacccatctctgggctccaacctgaggacgaggctcactattattgcagctcatatacaagcagcgtcacttgggtgttcggcggagggaccgacctggaccgtcttaggtcagcccaaggctcgccccctcggtccactctcgttccccgccctcctcacgtgactcgactgacgcgggctgggacagggcncatacgnnnnnnnnnnnnnn

SEQ ID NO: 257310 - DNA, 893 bp, Homo sapiens
  misc_feature: GYAE6OF02ICDSE.38.39.D06.1.454.CMB.1.raw
  modified_base (200)..(200): a, c, t, g, unknown or other
  misc_feature (200)..(200): n is a, c, g, or t
  modified_base (245)..(245): a, c, t, g, unknown or other
  misc_feature (245)..(245): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatccaccatcctcctgcactggaaccagcagngtacgtttggtggttaataaatatgtctcttacggtaaccaactntaccaaccaacactaccaaccccagggaccaaaacgtacccccaaaactccaattaaactttatggaacggtaccaaacgttaaaacccggccccttacgtaacgggtaagtttacttaactccggtacctttccttacgtcggtaccctaccgtaacgttccgtacgggtaccaaaccgacccggtacccttaccccgtagtaccctaagtccgtaccgtcggggtacccttacccgtaaacccgtggaacgggtacccggacgggtactacccgtaaacgtttaacgttttaacgtaccgtacgtacgtccgttaacctaaattaactaaaccgtaaacgtaccaacggttaccgttaaccgttaccggttttgggggttaccgggttttaccggggaaccgggggtaaccggggtaaaccccgggttaaccccggtaccgggtaaccccggttttaaccggtttaaaccgggtaacccgtaacccgggaccccgtaaacccgggtacccgtttacccccggtaccccccggtttacccgggtacccttaaccccggtttaccccgtttaccccggtttaccccccgtacccccgttacccccggttacccgtttaacccggttaccggtacccgttaaccccggg

SEQ ID NO: 257311 - DNA, 790 bp, Homo sapiens
  misc_feature: GYAE6OF02J06YC.38.39.D06.1.454.CMB.1.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctccgtggacagtcgatcaccatctcctgcactggaaccagcagtcgacgttggtgttataatntgtctcgttgaccanatcaaccaacatccaaccgagacaacgtcccaactcataattatgacgtacaacgtaaccggcctacgaaggtacgtttactaactcgtccttactcgtggacctcgtaacgtcgtcggacaaccgccggtccctccgtacgtaccactccgtcgtcgggccctaacccgtacgtaggacggaacgacggtcctacgtacctttagttactaccggacgtacgtccttaacgaacctttaagaaaccgtaaacggtacccggtaggtacccgttacccggttaaacgggttttacggggttaacgggtttccgggggaaccggggtaaaccggggtcccccgggtttaaaccgtccggggtttaaccccgttaaccggggtttttaaccggacccgggttaaacccggaccccggtaaacgggtcccgtttaccccccgggtaccccgggttacccgtttacccgtaacccgttttcccggttaaccccgtttaccccccgtacccccggttaacccgtttccccggtaaccggttttaccggaacccggtttccgg

SEQ ID NO: 257312 - DNA, 591 bp, Homo sapiens
  misc_feature: GYAE6OF02GL3YJ.38.39.D06.1.454.CMB.1.raw
  modified_base (241)..(241): a, c, t, g, unknown or other
  misc_feature (241)..(241): n is a, c, g, or t
  modified_base (460)..(460): a, c, t, g, unknown or other
  misc_feature (460)..(460): n is a, c, g, or t
  modified_base (518)..(518): a, c, t, g, unknown or other
  misc_feature (518)..(518): n is a, c, g, or t
  modified_base (530)..(530): a, c, t, g, unknown or other
  misc_feature (530)..(530): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcacgtggaaccagcagtgacgttggtaggttaataagtatcgtcttcttggtaaccaanatccacaacatccacccaggaccaaacgtacccaaactcaataatttagtagtaggtacaacgtaaaccgcctacgaggtacgttactaactcgtcttctctcggtcctaccgaagtcgtacggtacaacgaccggccttcctacgaacctagtcctagtcggtcctaccaactcggacgacggagtctacacttagttatgcagtctacagtactaanagcagtctctaggttggtggttaccggaggacggtaccactacgcgttactaggtacncgacccgagtcncccgtacccgtcggtctaccgttcgtaccggtcccctcctccgacgtcgtacgactaccgg

SEQ ID NO: 257313 - DNA, 741 bp, Homo sapiens
  misc_feature: GYAE6OF02I85LH.38.39.D06.1.454.CMB.1.raw
  modified_base (220)..(220): a, c, t, g, unknown or other
  misc_feature (220)..(220): n is a, c, g, or t
  modified_base (338)..(338): a, c, t, g, unknown or other
  misc_feature (338)..(338): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtcctgggtctcctggacagtcgatcaccatctcctgcactggaaccagcagtgacgttggtggttaataaatntgtctcgttggtaaccacatacaccaacactcaccagacaaacgtccccaaactcactaattactgacgtcaactaaccggcctacgaggtagttactaatcgtcttctactcgtccncaatccgtaggaccaacgtaccggccctaccgtcgtaccctatccgtcgtacgggtcctacccgaaaccgtggaacgggaacgacgggtccttaccgaactttacgtaacgtttcgaccgtagaccttacaattaacgtaaacctaacggtaccgacgttaccgttacccgtaacggttttcggggttccggttacggggaccgggttaacggggacccgtttaacccgggtccgttaaccggttacggtttaaacccggtccgtaaacccgggtaaccgtaaccgggtccgttcccccggtacccccgggtttaccgggtaccctaacccgtttcccggtttccggttacccccgtacccgtttacccgtaccggtaacccttcggtaacccgttaacccgg

SEQ ID NO: 257314 - DNA, 727 bp, Homo sapiens
  misc_feature: GYAE6OF02HWN6T.38.39.D06.1.454.CMB.1.raw
  modified_base (687)..(687): a, c, t, g, unknown or other
  misc_feature (687)..(687): n is a, c, g, or t
tcagtcgatcacgtcacgaccggtgctcgatttagtgacatctcggacgagttctttgggggactttgacctgggctctcgctgctcctcaccctcctcacgtcagggcacagggtcctagggccctaggtctcgccctgactcagcctgcctccgtgtcgtgggtctcctggacagtcgatcgacattctcctcgcacgtcggaaccagcagtgtacgttggtagttaagtaaattgtcgtctcgttacggtaaccaacgtactaccaaccaacaccgtaccaaccccgaggaacctaaaaccgtacccccaaactcgtaaacttaattacgtaggaacggttaccaaaccgtaaaacccgggtcccctaggtacgggttacgttttacctaacgttccgtaccttttccgtacgttcggtaccttaccggaacgttccgtacggaccgaacccgtccgtacccttaccgtacgtacccttacgttccggtacgtccggggtacctacccgaccgttacgggacggtaccgacgtccgtacgtacttacgttagtaccgcgtactctacattacacgacgtacgacgacgttccacggtttcgggtcgtcccgggtacgggaccggaccctcggtacgtccgttacgtcggtaccgacgaccgacgcgtaccggccgtacccggtncctccgtccgtaccctacgtcctacggtctacgcgtaccg

SEQ ID NO: 257315 - DNA, 573 bp, Homo sapiens
  misc_feature: GYAE6OF02FVB5A.38.39.D06.1.454.CMB.1.raw
  modified_base (241)..(241): a, c, t, g, unknown or other
  misc_feature (241)..(241): n is a, c, g, or t
  modified_base (294)..(294): a, c, t, g, unknown or other
  misc_feature (294)..(294): n is a, c, g, or t
  modified_base (368)..(368): a, c, t, g, unknown or other
  misc_feature (368)..(368): n is a, c, g, or t
  modified_base (376)..(376): a, c, t, g, unknown or other
  misc_feature (376)..(376): n is a, c, g, or t
  modified_base (409)..(409): a, c, t, g, unknown or other
  misc_feature (409)..(409): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcaggtgacggtttggtggttaataaatatgtctcttaggtaaccaanatccaaccaacatccacccaggacaaacgtccccaaaactacaataaatttangaaggtcaactaaacggccctacgaggtagtttactaatcgcttctctggcctcagtctgcaacacgcctcctnacatctcnggctaccaactgagacgagctcactattatgcngctcatatacaagcagcgtctacgttgggtcggttcgggcggtacgggaccgtaccgtcgtaccgtcgttacggtcgacgacccgaggcctccggtcccccgtacggtacctaccgttcctccgttcccctaaccctacccttaccgcggttagtacgtaccgg

SEQ ID NO: 257316 - DNA, 728 bp, Homo sapiens
  misc_feature: GYAE6OF02FZX8W.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttcggtaccaacataccaccaacactccacccaggacaaacgtaccccaaactcaattaatttatgagtcaacgtaaaccggccctagaggtagttactaagtccgtctttctcgtcgcctaccaagttcgtacggaccaaccgtacccggtccctacccgtcgaaccctacgttccttccggtcgggtcccttacccgtaaaccgtaggaacgggaacggtacggtaccttactaactttacgtttacgttacgctaacgtccttaacgaacttaacttaaacgaacggtaccacggtaccgttaccgttacggtttcggggtcggtttaccggggacggggtacgggtaacccgtacgtaccgggttaccgttacggtacggttacgaccggaacccgcggtccctcccggtcccccgttcggtacctacccggtttaccctttcccggttacccccgcccgtttaccgtacccggtccggtttaccgaccgttaacccgg

SEQ ID NO: 257317 - DNA, 841 bp, Homo sapiens
  misc_feature: GYAE6OF02H9XI9.38.39.D06.1.454.CMB.1.raw
tcagtcgatcacgtcacgaccggtgctcgatttagtgacatctcgcagttctttggggactttgcctgggctctgctgctcctcacccctcctcactcagggcacagggtcctgggcccagtctgccctgactcagcctgcctccgtgtctgggtctcctggacagtcgatcaccatctcctgcactggaaccagcagtgtacgttggtagttaataaatatgtctacgttcggtaaccaatactacaaccaacatccaacccaggaccaaacgtaccccaaactcaattaatttatgacggtacaactaaaccggccctcgaggtagttactaatccgtacttctctcgctacctacgtcgtggacaaccgaccggtccctacctcgacctacttctacgttcgggacctacccgaacccgttaggaacgggtaaccggacgggtaccttaccgtaaacctttaacgttttaacgtttcggacccgttaacgtccgttaactaacgtttaaacgtaaacccgtaaacggtaccgtaacggtacccgtttaccgttaaccggtttcggggggtttacgggtttacccgggggaacgggggtaccggggtaaccccgggttacccggttacgggtttaaaccccggttttaccggtttaaacggggttacccggtaaccggaacccccgggtaaccggggtacccgtttaccccgggtacccccccggtttaccgggttaccccgtaccccgttttacccggttcccccggtttaccccccggttccccgttacccccgtttacccggtacccggtttacccggtacgtttaacccccgggg

SEQ ID NO: 257318 - DNA, 701 bp, Homo sapiens
  misc_feature: GYAE6OF02HP9ND.38.39.D06.1.454.CMB.1.raw
  modified_base (232)..(232): a, c, t, g, unknown or other
  misc_feature (232)..(232): n is a, c, g, or t
  modified_base (240)..(240): a, c, t, g, unknown or other
  misc_feature (240)..(240): n is a, c, g, or t
  modified_base (294)..(294): a, c, t, g, unknown or other
  misc_feature (294)..(294): n is a, c, g, or t
  modified_base (314)..(314): a, c, t, g, unknown or other
  misc_feature (314)..(314): n is a, c, g, or t
  modified_base (328)..(328): a, c, t, g, unknown or other
  misc_feature (328)..(328): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatatgtctcttgtaccanatcacaantcacccagcaaacgtccccaaactcaataatttatgagtacaactaacggcctnaggtattctaatcgtctctntcggctccaagtcncggtacaaccgccggtccctccctagaccaattccgtcgtcgggaccttacccaacccggtgaacggggtaccgacgggcctaaccgtaccttaatttaacgttcgaccaggtccttacaattacgtaacaaacggtcaacggtccgttaccgtacggttttgggggtttcggttacccggggaccggggtacgggtaccccgggtaaccgtccgggttaaccccgtttcggtttaacggtacccgaacgtaccccggaacgggtcccgttaccccggcccccggtttccggtacccttacccgttcccgtttcccgttacccccgtacccccgtcccgtttcccgaaccggtttccgtaaccttaccccggg

SEQ ID NO: 257319 - DNA, 919 bp, Homo sapiens
  misc_feature: GYAE6OF02ILLN8.38.39.D06.1.454.CMB.1.raw
  modified_base (174)..(174): a, c, t, g, unknown or other
  misc_feature (174)..(174): n is a, c, g, or t
  modified_base (195)..(195): a, c, t, g, unknown or other
  misc_feature (195)..(195): n is a, c, g, or t
tcagtcgatcacgtcacgaccggtgctcgatttagtgacatctcgcagttctttggggactttgcctgggctctgctgctcctcaccctcctcactcagggcacagggtcctggcccagtctgccctgactcagcctgcctcgtgtctgggtctccgtggacagtcgatcaccntcctcctgcacgtcggaaccngctagtggtacgtttgggtagttaactaaattcgttgttccttacgtttacggtaaacccaagtctaccaaccaaaacacttaccgaacccgaggaacctaaaaccgtaccccctaaaactacgtaatttaaatttacgtacggtaacggttaacctaaaccgttaaaaccgggtccccgttacggtaaacgggttagttttaccgttaaacttccggtacttttaccgttaccgtacgggtaccttacccgtaaacgttcgtacgggtaccaaccgtaccggtccccttacccgtacgtaacctaacgttccttacggtcgggtacccttaacccgtaaaccgtacggtaacgggtaaccggtaccggttaccttaaccgttaaacccgttaacgtttttaacgtacggtaccgtaacggtttaccttaccctaaagtttaaaccgttaaaccgaacggtaccgttaaccggttaccgtttaaccggttaccgggtttttacgggggttacggtttacccgggggaaacggggttaaccggggtacccgttaaccggttacccggttaacccgggtttaacggtttaaccggaaccgtacccggtaacccggtaaccgggtccgttacccccggtccccggttaccggttacccgtaaccgtttcccgtacccggttttaccccacccgtcccgttaccggtacgttaccgtaccgttaccgg

SEQ ID NO: 257320 - DNA, 635 bp, Homo sapiens
  misc_feature: GYAE6OF02JYV21.38.39.D06.1.454.CMB.1.raw
  modified_base (237)..(237): a, c, t, g, unknown or other
  misc_feature (237)..(237): n is a, c, g, or t
  modified_base (248)..(248): a, c, t, g, unknown or other
  misc_feature (248)..(248): n is a, c, g, or t
  modified_base (375)..(375): a, c, t, g, unknown or other
  misc_feature (375)..(375): n is a, c, g, or t
tcagtcgatcacgtcacgaccggtgctcgatttagtgacatctcgcagttctttgggactttgcctggctctgctgctcctcaccctcctcactcaggcacagggtcctgggcccagtctgccctgactcagcctgcctcgtgtctgggtctccgtggacagtcgatccaccatctcctgcactggaaccagccaagtgacgttggtgttataaagtatgtctgttcggaccaactntccaccaaacngtccacccgaggacctaaacgtccccaaatcattaagttctggacgtctaaccgtaaaccgggccctagaaggtactttacgtaactcgtactttctcgtggacctacgacgttcgtcggactaacnccggtcctaccctgaccctagtccgtacgtcggtacctacccgtagtcggaacgggtcgacggacctcgtacttagtagtcgcctaagtccttacgattaacgacgacgtcgaacgtccgttagtcggttcgggtacgttcgggacggtacgggaacctcggacgtaccggtctaaaggtccgaacgtccgagtccgtccgtacccgttggacctacgttccgtccgtaccctccgtacctcggtacctgacgttaccgg

SEQ ID NO: 257321 - DNA, 546 bp, Homo sapiens
  misc_feature: GYAE6OF02HJO3Y.38.39.D06.1.454.CMB.1.raw
  modified_base (272)..(272): a, c, t, g, unknown or other
  misc_feature (272)..(272): n is a, c, g, or t
  modified_base (406)..(406): a, c, t, g, unknown or other
  misc_feature (406)..(406): n is a, c, g, or t
  modified_base (411)..(411): a, c, t, g, unknown or other
  misc_feature (411)..(411): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcanaatttatgaggtcactaaacggcctcaggagtttctaatcgcttctctgctccaagtctggcaacacgcctcctgaccatctctgggctccactgagacgaggctcactattatgcagctcatatacaagcagngtacncttgggtgttcgggcggaggggtaccgaccgtgacccgttgttacggtcacgcccgaaggccttcggccccctccgggtactaccgttaccttcgttccccctacccttccctaccgtaccgttcgattacccgg

SEQ ID NO: 257322 - DNA, 698 bp, Homo sapiens
  misc_feature: GYAE6OF02GS8HY.38.39.D06.1.454.CMB.1.raw
  modified_base (233)..(233): a, c, t, g, unknown or other
  misc_feature (233)..(233): n is a, c, g, or t
  modified_base (360)..(360): a, c, t, g, unknown or other
  misc_feature (360)..(360): n is a, c, g, or t
  modified_base (405)..(405): a, c, t, g, unknown or other
  misc_feature (405)..(405): n is a, c, g, or t
  modified_base (470)..(470): a, c, t, g, unknown or other
  misc_feature (470)..(470): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatatgtctcttgtaccaanatacaccaacatcacccaggacaaacgtaccccaaatcaattaacttatgagtcacgtaacgccctacaggtagtttctaagtcgtaccttctctcgctaccagtctggcaaccgtacggcctcccncggacctatctcgtcgggcctacccaaccgtacggagggaaccgngggacctacgtaaaccttacgttttaatccggtactacgtcttacctaatactaacgaacgtacncgtaccgtactacgtttcggggtcggttaccgggacgggtacggggaaaccccgttcggttaaccgtaccggttaccggtttacgggtaccgtaaccggtaccccgaacgggttccccgtaccggtacccccccgttacggggttacccctaaccgtttcccgtacccggttttaaccccctccccgttcccttaacccggtacccgtccggttaacgtacccccggg

SEQ ID NO: 257323 - DNA, 749 bp, Homo sapiens
  misc_feature: GYAE6OF02FVU9S.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatcctcctgcacgtggaaccagcagtgtacgttggtagttaataaatatgtctcttaggtaccaacatccaacaacactccacccaggacaaacgtaccccaaactactaattaatttatagtacggtacaacgtaaaccggccctagaggtacgtttactaactccgtacttctcgtggtcccttaccgtaagttccgtacggaccaaaccgtacccggtcccttaccccgtacgtaaccctacttaccgttcgtccgggtaccctaccccgtaaacccgttagggaaccgggaaccggtacggtacctaccgtaactttacgttaacgtttcggacctaacgtccttactaagttaactaacgaagccgaacgtccgtacgttacggtttcggggtacggttccggggacgggtaaccgggtacccgtaccggttacggtaccggttaccgtttacgggaccaccggtacccgacgggtcccgtacccggtccccggtacgttaccctccgtttacccgtttccggtttcccccgccctttacccgtaccgtaccgttaccgtccgtaaccgg

SEQ ID NO: 257324 - DNA, 568 bp, Homo sapiens
  misc_feature: GYAE6OF02IWX46.38.39.D06.1.454.CMB.1.raw
  modified_base (247)..(247): a, c, t, g, unknown or other
  misc_feature (247)..(247): n is a, c, g, or t
  modified_base (353)..(353): a, c, t, g, unknown or other
  misc_feature (353)..(353): n is a, c, g, or t
  modified_base (397)..(397): a, c, t, g, unknown or other
  misc_feature (397)..(397): n is a, c, g, or t
  modified_base (410)..(410): a, c, t, g, unknown or other
  misc_feature (410)..(410): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctcgtgtctgggtctcctggacagtcgatcaccatcctcctgcacgtggaaccagcagtgacgttggtgttaataaatatgtctcttggtaccaacatcaaccaacntacacccaggacaaacgtaccccaaactcaattaatttaatgaggtcaactaaacggcctcaggtagtttctaatcgcttctctcggctccaagtcgtaggcaacncgcctcctcgacctactctcgtcgggctcccaactgacggacgnggctacacttatnttcgcacgctacctaatataacacgcagctccgtattcggggtgttaccgggcggaacggccgaccgtagaccgttgtacggtcacgccacggctccggtcccgtcgtacctacgtctttccggtaccctccgttccctcgtaccgtagtactaccgg

SEQ ID NO: 257325 - DNA, 860 bp, Homo sapiens
  misc_feature: GYAE6OF02IR4QE.38.39.D06.1.454.CMB.1.raw
  modified_base (257)..(257): a, c, t, g, unknown or other
  misc_feature (257)..(257): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatcctcctgcactcggaaccagcagtgacgtttggtggttaataaagtatcgtctcgttacggaaccaacataccaaccaacnctaccaacccgtaaggacctaaaacggtccccccaaaaacgttcctaaattaaacttttagacggtacggttaccctaaaccgttaaaacccggccccttacgtaggtaacgttttaacctaaagtccggttacctttaccgttccgtacgggtaccttaccgtaaacggttccgtagggtaaccctaaacccgtacccgggtcccctttaccccgtacggtaaacccttacgttacctccggttacggggaccctttaacccgaaacccggttacgggaaaccgggtaaccgtaacgggtacccttaacccgtaaacgttttaacgtttaaacgttccggaccgttaacggtcccttaactaacgtttaaactaacggaaaccgttacgtaaaccggtccgttaaccgttaaccgggtttcgggttacggtttaccgggggaaccgggtaacgggtacccgtacggttccgtaaccggtttcctaaacggttacgacccgtaacgtacggtacccgtccccggtaaccccgttcggtaccctaaccgttccgttcccgttacccctacccgttcctaccgtaccggttacgaccgtaaccgg

SEQ ID NO: 257326 - DNA, 764 bp, Homo sapiens
  misc_feature: GYAE6OF02F9OMA.38.39.D06.1.454.CMB.1.raw
  modified_base (217)..(217): a, c, t, g, unknown or other
  misc_feature (217)..(217): n is a, c, g, or t
  modified_base (284)..(284): a, c, t, g, unknown or other
  misc_feature (284)..(284): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttaataatntgtctcttggtaccaacatcaaccaacactccacccaggacaaacgtccccaaactcattaatttangagtacacgtaacggccctgaggtattcaatcgtactttctcgtggcctaccgaagtctggaccaaccgaccggtccctccctgaccctattcctcgtcgggtaccctacccgaaccgtggacgggaacgacggacctactaacttaatttagttcgactacgtccttacgtaacttaactaaccgtaagtcacggtacccgtacgttacggtttggggttacggttccggggaccggggtaacccgggacccggtaccggttaccggttacccgggtttaacgtttaccgggtaacccgaccgggtaaccccgtaagggttcccccgtaccccgggtaccccccccggtttacgggttaaccccgttaacccgttttcccccggtttacccccgggttttaccccccccggtcccccgttttacccccggttaccccgggttaacccggtttacccgggttaacccggttacccccggg

SEQ ID NO: 257327 - DNA, 564 bp, Homo sapiens
  misc_feature: GYAE6OF02FLGS7.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttggtaccaacatcaccaacatcacccaggcaaacgtccccaaactcataatttatgaggtcactaaacggcctcaggtatttctaatcgtcttctctggctcaagtctggcaacacgcctcctgaccatctctggcctccaactgacggacgagctacacttattatgcagctacatatacaagcagcctctacgttgggttcggttcggacgggtacgggaccgtacgtacgaccgttcgttacggtcacgacccgacggtccgtccggtcccccgttcggtacctaccgttccttccgttcccctacccttcccgtccgacggttcgtactaccgg

SEQ ID NO: 257328 - DNA, 600 bp, Homo sapiens
  misc_feature: GYAE6OF02GN6TH.38.39.D06.1.454.CMB.1.raw
  modified_base (343)..(343): a, c, t, g, unknown or other
  misc_feature (343)..(343): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcaccaggacaaacgtaccccaaactcataattatgagtacactaaacggccctgaggtagtttactaatcgtcttctctggctcaagtctgacaacncgcctcctgaccatctcgtacggctaccaactgacgacgagctacacttatatcgactagtctcaatactaacaacgctagccgtacgtacgtttgggtcgttcgggacgggacgggacccgtaccgtacgtaccgttacgttacggtacctaccgacccgacggtccgtcccggtacccccgtttcggacccctacgttcccgttcccggttcccccgtccccgttacccttaccgaccggttcgttactcccggg

SEQ ID NO: 257329 - DNA, 828 bp, Homo sapiens
  misc_feature: GYAE6OF02HM9ZY.38.39.D06.1.454.CMB.1.raw
  modified_base (219)..(219): a, c, t, g, unknown or other
  misc_feature (219)..(219): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctcgtgtctgggtctcctggacagtcgatcaccatctcctgcactggaaccagcagtgacgttggtaggttaataaatntgtctcgttaggtaaccaacatacaaccaaacactaccaacccaaggaaccaaaaacgtacccccaaaactctaaattaaactttataggaacggttaccaaaccgtaaaaccgggccccttacgtaagggttaacgttttactaaacgtccgtactttcgttacgtcgggtaccttaccgtaaagttccgttacgggaaccaaaccggtaacccggaccccttaccccgttacgaacccttacttaccgttcgtacggggtacccttaacccgaaaccggttaggaaccgggaaccggtaacggtacccttaacgttaaacctttaagtttacgttacggaaccgtacgtaccttacgtaaacttaacgtaaaccgaaacgtccctaaacggttcccgttacgtaacggtttttgggggtaccggttaccgggggtaccgggtaacggggtacccgtaacgttccgggtaaccgtttaccggttaacggtaccgtaaccggtaccccgaacgggttcccgtcccggtacccccggttcggtaccgtaccgttcccgttccggttccccccgtacccctccgttaccgaccggttacgtaccgtaccgg

SEQ ID NO: 257330 - DNA, 602 bp, Homo sapiens
  misc_feature: GYAE6OF02JF57Q.38.39.D06.1.454.CMB.1.raw
  modified_base (275)..(276): a, c, t, g, unknown or other
  misc_feature (275)..(276): n is a, c, g, or t
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttaggaccaacatcacacatcacccagacaacgtccccaactcatattannaggtcactaacggacctnaggtattctaatcgcttntctgctcagtctgactacgaccgcctccctgaccatcctactcgggacctaccaacgtagagggacgacggactacgtacctattacgttgctagtctacgatactaacgaagcacgtacgtcgtacgtagggttcgttacggacgggaccggtaccgtaccgtacgtaccgtacggtttacggtaccgacgacccgtacggcccgtccgtcccccgttacggtacctaaccgttcccgttaccggttccccgtcccttcccttaccggtaccgttacgcgttaaccccg

SEQ ID NO: 257331 - DNA, 685 bp, Homo sapiens
  misc_feature: GYAE6OF02G8G69.38.39.D06.1.454.CMB.1.raw
  modified_base (242)..(242): a, c, t, g, unknown or other
  misc_feature (242)..(242): n is a, c, g, or t
tcagtcgatcacgtcacgaccggtgctcgatttagtgacatctcgcagttctttggggactttgcctgggctctgctgctcctcaccctcctcactcagggcacagggtccctgggccccagtctcgccctgacctcagcctgcctccgtgtctgggtcctccgtggacagtcgatcaccatctcctgcactggaaccagcagtgacgtttggtgttataaatctgtctcttggtaccaacntaccacctaacgatccgaccaggacaaacctccccaaatctaattaattatggacgtaccaacgtaaaccgcctcgaggtactttactaactcgtcctttctacgtcgtcctactaacgtcgtagggacctaaccgacccggtcctccctacgaccctagtccgtccggtcgggtccctacccgtaacgttggaacgggtaaccggtcggtaccctacctaaactttacgtttaattcggaccttaggtcccttagtaacttaaccgtaactaaacgggcctaaaggtcccgtacgttaccggtttgggtacggttaccgggcgggtaacggaccctaccggtcgtacccggttagttcgacgtaccgaccgtacgccgtcccgtccccgtacgtcacccgttcctaccgttccccctctcccgacgtaccgtggtactacgg

SEQ ID NO: 257332 - DNA, 645 bp, Homo sapiens
  misc_feature: GYAE6OF02FW7ZD.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatccaccaacatccaccagcaaacgtccccaaatcaataatttatgaggtacacgtaaaccggccctagaggtagtttctaatcgtctttcgtctcggccttaccgaagttctggacaaccgaccggcctccctagaccctatcgtcgtcggtcctaccaaccgtggaacggacgcgtcctacacttattagttcgacagtctacataacgtaccgaagcacgtcctacgtacggtttggggttcgtaccggggacgggtacgggtacccgtaaccgtgtacccgtttacgttaacggctacccggacccgacggtccgtacccggtcccccggttacgtacccgaccgtttcccgtaccggtttccccccaacccgttcccgtaccgtaccgttacgtacctacccggg

SEQ ID NO: 257333 - DNA, 168 bp, Homo sapiens
  misc_feature: GYAE6OF02HNKVW.38.39.D06.1.454.CMB.1.raw
  modified_base (168)..(168): a, c, t, g, unknown or other
  misc_feature (168)..(168): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacaggtn

SEQ ID NO: 257334 - DNA, 738 bp, Homo sapiens
  misc_feature: GYAE6OF02GVFYR.38.39.D06.1.454.CMB.1.raw
  modified_base (222)..(222): a, c, t, g, unknown or other
  misc_feature (222)..(222): n is a, c, g, or t
  modified_base (310)..(310): a, c, t, g, unknown or other
  misc_feature (310)..(310): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatcctcctgcacgtggaaccagcagtgtacgttggtagttaataaatntgttactcgttagtaccaactctaccaaccaactactccgaacccgtaggacctaaaaccgtacccccaaaactcaaatttaacttanacggtacggtaccaaacgtaaacccggtcccctagaaggtacgtttactaacgtccgtcttcgtacgtcggccttaaccgtaagttccgtacggaccaacgacccgtccctccgtacgacctacgtctaccggcggtaccctacccgaacgtggaccggaacgcggtactacgtaacttacgtttatcggtactacgtctactaactaacgtaacgaacgtcgacgtccgttacgtacggtttgggtccggttacgggtaccgggaacggtacccgtaccgtacggtacccgtttaggttaaccggaccgtacggtacccgtaacgtccgtaccccggttcccccggtaggttaccccgtaaccgttcccggttccccgttacccccgccctttaccccgtaccgtacggttccgaacggttccccgg

SEQ ID NO: 257335 - DNA, 695 bp, Homo sapiens
  misc_feature: GYAE6OF02JVWCQ.38.39.D06.1.454.CMB.1.raw
  modified_base (178)..(178): a, c, t, g, unknown or other
  misc_feature (178)..(178): n is a, c, g, or t
  modified_base (222)..(222): a, c, t, g, unknown or other
  misc_feature (222)..(222): n is a, c, g, or t
  modified_base (238)..(238): a, c, t, g, unknown or other
  misc_feature (238)..(238): n is a, c, g, or t
tcagtcgatcacgtcacgaccggtgctcgatttagtgacatctcgcagttctttggggactttgcctgggctctgctgctcctcaccctcctcactcagggcacgagggtcctgggcccagtctcgccctgactcagcctgcctcgtgtctggtcacctggacagtcgatcaccatcncctgacacgtggaccagtcagttgacgttggtcgttaataactntgtctgttgaaccatntcaactacactccgacccaggacctaaaccgtacccaaacttacgaactttaagttctaggtacggtacctaacgttaaaacccggcctacgtaaggtaacgtttcctaaagttccgcctttccttcgacggtccttaacctaggtccttacgaacgaaccctcgggtccctaccgttcgaaccttctcgtcgtacgggcctacctaaaccggttcgaaggggtaccgacggtcctacgtaccgttaaacgttcgttacgcgtacgtactactaacgtactaacgtaacgtacagaccgtcgttacggttcggtcggttcggaccgacgggtaccgtcgtacgtaccggtactaacggtcgacgtcccgaaggtcctacccggacccttcggtcctaaccgttcctaccggttacccctacccgttacccctacgtaacccgttcggtaccgtacgg

SEQ ID NO: 257336 - DNA, 503 bp, Homo sapiens
  misc_feature: GYAE6OF02IQXG6.38.39.D06.1.454.CMB.1.raw
  modified_base (261)..(261): a, c, t, g, unknown or other
  misc_feature (261)..(261): n is a, c, g, or t
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (397)..(397): a, c, t, g, unknown or other
  misc_feature (397)..(397): n is a, c, g, or t
  modified_base (457)..(457): a, c, t, g, unknown or other
  misc_feature (457)..(457): n is a, c, g, or t
  modified_base (462)..(463): a, c, t, g, unknown or other
  misc_feature (462)..(463): n is a, c, g, or t
  modified_base (466)..(503): a, c, t, g, unknown or other
  misc_feature (466)..(503): n is a, c, g, or t
tcagtcgatcacgtcacgaccggtgctcgatttagtgacatctcgcagttctttggggactttgcctgggtgacgttggtggttataaatatgtctcttggtaccaacatcaaccaacatcacccaggcaaagtccccaaactcataatttatgaggtcaactaaacggccctcaggagtttctaatcgtcttctctggcctccaagtctggaccaacaccggcctccctagaccatctctggctccacctgagacgagcnactattatgcagctcattanaacaagnagctcaacgttggtgtccggaggtacgggacctacctggaccgtgttaagtcagaccgagccgtacgcccctacggtcacgtctcgtccccacccttccgctaaccgtntacgtctaccgtagacggccgggtcgtacggaccgtaaggcccgtaccgaagttggaccncgtanncgnnnnnnnnnnnnnnnnnnnnnnnnnnnnnnnnnnnnnn

SEQ ID NO: 257337 - DNA, 639 bp, Homo sapiens
  misc_feature: GYAE6OF02JBD88.38.39.D06.1.454.CMB.1.raw
  modified_base (193)..(193): a, c, t, g, unknown or other
  misc_feature (193)..(193): n is a, c, g, or t
  modified_base (226)..(226): a, c, t, g, unknown or other
  misc_feature (226)..(226): n is a, c, g, or t
  modified_base (246)..(246): a, c, t, g, unknown or other
  misc_feature (246)..(246): n is a, c, g, or t
  modified_base (360)..(360): a, c, t, g, unknown or other
  misc_feature (360)..(360): n is a, c, g, or t
  modified_base (438)..(438): a, c, t, g, unknown or other
  misc_feature (438)..(438): n is a, c, g, or t
  modified_base (460)..(460): a, c, t, g, unknown or other
  misc_feature (460)..(460): n is a, c, g, or t
tcagtcgatcacgtcacgaccggtgctcgatttagtgacatctcgcagttctttggggtactttgcctgggctctgctgctcctcaccctcctcactcagggcacaggtcctgggcccagtctgccctgactcagcctgcctcgtgtctgggtctcgtggacagtcgatcaccatcctcctgcacgtgaaccngcgagtcgacgttggtaggttataatatgtctnttaggacctacatcacaacntacaccagacaacgacccaactacataattatagtagtcaactaaccgacctacacgtaacgttcttaactcgtacttctacgtgcctcacgtctcggacacgaccgacctccngtaccgtactcgtactcggtcctacgacctcggacggtacgacggcctactacttacgttatacgtacgtcgacttanacttaactacaacgtcgactcncgtacgttgggtacgttcgggacggtacgggaccgccgtacggtacccgttcgttacggtacgtaccgggaccgtacggccggttccccgtccccgttaaccggtccgtacccttacccgggtttcccgttccccgttccccgttcccgtttacccgtaccggttcgtacgttacccgg

SEQ ID NO: 257338 - DNA, 427 bp, Homo sapiens
  misc_feature: GYAE6OF02GK4HC.38.39.D06.1.454.CMB.1.raw
  modified_base (406)..(406): a, c, t, g, unknown or other
  misc_feature (406)..(406): n is a, c, g, or t
  modified_base (413)..(427): a, c, t, g, unknown or other
  misc_feature (413)..(427): n is a, c, g, or t
tcagtcgatcacgtcacgaccggtgctcgatttagtgacatctcgcagttctttggggactttgcctgggtgatgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaacctgaggacgaggctcactattattgcagctcatatacaagcagcgtcacttgggtgttcggcggagggaccgacctgaccgtcttaggtcagcccaaggctgccccctggtcactctcgttcccgccctctcacgtgatcgactgacgcgggctggcaaggcncagtagnnnnnnnnnnnnnnn

SEQ ID NO: 257339 - DNA, 732 bp, Homo sapiens
  misc_feature: GYAE6OF02GQG9Z.38.39.D06.1.454.CMB.1.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
  modified_base (287)..(287): a, c, t, g, unknown or other
  misc_feature (287)..(287): n is a, c, g, or t
tcagtcgatcacgtcacgaccggtgctcgatttagtgacatctcgcagttctttggggactttgcctgggctctgctgctcctcaccctctcactcagggcacagggtcctgggcccagtctcgccctgactcagcctgccttcgtgtcgtgggtctccgtggacagtcgatcaccatcctcctgcacgtggaaccngcagtgtacgttggtagttaataaatntgtctcttgaccaacntcacaactctccaccgagacaacgtacccaaactcaagttattaagngtacggtactaaccgtaaaccggccctagacggttacgtttactaacgtcgttaccttacgtcgtgtacccttacgtaacggttcgtacggaacccaacgtaccggtacccctccgttacgaaccttactccgttacggttccggaaccttcccgtaaacgtcggaaccggacggtaccgtaccgttaacttaaccgtttaactttacggttacgaccgtaacgtcctaacgtaagtaactacgaacgtcgaacgttcccgttagtacgggtttcggttccggtcggaaccgggtacggtacccgtacgttacggtacccgtttgttacggtccaacggtacccggtacgttaccgtcccggttccccggtacgtcccgttacgttacccgttccggtttccccaacccgttccgttaaccgaccggttacgtaaccgtcccggg

SEQ ID NO: 257340 - DNA, 893 bp, Homo sapiens
  misc_feature: GYAE6OF02H6XGH.38.39.D06.1.454.CMB.1.raw
  modified_base (225)..(225): a, c, t, g, unknown or other
  misc_feature (225)..(225): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgcccctgactcagcctgcctccgtgtctgggtctcctggacagtcgatcaccatctcctgcacgtacggaaccagcaggtgacgtttggtagttaataaatntgtcttcttacggtaccaacatacaccaacactccaccagacaaccgtacccaaactcaattaattagtagtacgtacaacgtaaccggccctacgtaaggtacgttacttaactccgtctttaccttcgttgaccgttacctaacggttcgtacgggaccaaacccggtacccgtcccgttaccgtaccgtaccctaccgttaccgttccggtccggggtacccttaaccccgtaacccgttcgggtaacgggtaacccggacgggttaccgttacccgttaaacctttaacggtttttacgtaccggtaccttaacggtacccttaaccgtaagttaaaccgtaaccgtaaacggtcgaaccggttaccgttacgtttaaccgggtttcggggttaccgggttttacccgggggaacgggttaaccggggaaacccccggttacccggttaacccgggttaacccggttttacccggtaaggttaaccccggtacccgggtaacccggtaacccgggttcccggttacccccccgggtaccccggttaaccccggtttcccgtaaccccgtttacccgttaccccccggttttacccccccgaacccccgttttccccggttaacccgttaccccgggttacccggttaccgttaaccccccgggg

SEQ ID NO: 257341 - DNA, 730 bp, Homo sapiens
  misc_feature: GYAE6OF02FGK1U.38.39.D06.1.454.CMB.1.raw
  modified_base (219)..(219): a, c, t, g, unknown or other
  misc_feature (219)..(219): n is a, c, g, or t
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
tcagtcgatcacgtcacgaccggtgctcgatttagtgacatctcgcagttctttggggactttgcctgggctctgctgctcctcaccctcctcactcagggcacagggtcctggcccagtctgccctgactcagcctgcctccgtgtctgggtctcctggacagtcgatcaccatctcctgcacgtggaaccagcagtgacgttggtggtttaataatntcgtctcttggaccaacatccaacaacatccaccaggcaaacgtcccaaactcataatttngagtcactaacggccctnaggtagtttactaagtcgtctttctcgtggtccttaccgaacgttctcggtaccaaccgacgggtcccctcccttacggacctaacttcgtttcgtacggggtcccttaccccgtaaaccgttcgggaacgggtacggtaccgggtccgtactaaccgtttactttaacgtttcggtaccaacggtccttacaacgttacttaacgaaacgtaccgtagccgttacgttaccggtttagggttcgggtttccgggacggggtaccggggacccggttaacccgtacggttaccggttacctttacggtaccgaccgtaacccggtacgggtccaccggtccccccggtaccgggttaccctaccgtttcccgttcccggtttacccccgtccccgtttacccccgtacgtaccggttcgtaccgttacccgg

SEQ ID NO: 257342 - DNA, 854 bp, Homo sapiens
  misc_feature: GYAE6OF02GH373.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttaataatatgtctcttggtaaccaatatcaccaacactccacccaggacaaacgtccccaaactcaattaattatgtacggtacaacctaaaaccggcccctacgtaggtacgtttactaacgtccgtctttcctcgtcggacctaccgtaagtcgttcggactaaccgaccggtccctcccgtacgaacctacgttccgtcgtcgggtacccttacccgtaacccgtggtaaccgggaacggtaccgggtaccttaccgtaacgttaacgtttacgttacggtacctaacggtaccttaaccgtaacgttaacgttaaaccgtaacgtacccgtaacggtacccggttaccgtaaccgggtttttacgggggttccgggtttacccgggggtaacccggggtaacgggggttaacccccggttaaccggtttaacccggggttaacccccgggttttaccgggtttaaacccgggttacccggtaaccggtaccccggtaaacgggtcccggtttacccccggtacccccccggtttaccgggttacccttaacccgttacccggtttacccggttttaacccccgtacccccggttacccttaacccggtacccggtttacccggtacccgtttaaccccggg

SEQ ID NO: 257343 - DNA, 713 bp, Homo sapiens
  misc_feature: GYAE6OF02FUWHX.38.39.D06.1.454.CMB.1.raw
  modified_base (241)..(241): a, c, t, g, unknown or other
  misc_feature (241)..(241): n is a, c, g, or t
  modified_base (293)..(293): a, c, t, g, unknown or other
  misc_feature (293)..(293): n is a, c, g, or t
tcagtcgatcacgtcacgaccggtgctcgatttagtgacatctcgcagttctttggggactttgcctgggctctgctgctcctcaccctctcactcagggcacagggtcctgggcccagtctgccctgactcagcctgcctcgtgtctgggtctcctggacagtcgatcaccatctcctgcacgtggaaccagcagtgacgtttggtaggttaataatatcgttctcgttaggtaaccaanataccaaccacactaccaccaggacaaacgtcccaaacttcaattaatttanagaggtacaacttaaaccggccctacgaggtacgtttactaactcgtacctttcgtcgtcggtccttaccgtaaggttccgtacgggtaccaaccggtacccgtcccttcccgtacgaacctacttccgttacgtcgggtccctaacccgtaaccgtcggaacgggaaccggtacggtccttaaccgtactttaagtttacgtttcgacgtacggacttacgtaactaacgtaaacctaacggtaccacggttacccgtacgtttacggtttcggggtcgggtttacgggaccggggtaccgggtacctaccgtccggtacgttacgtaccgtcgaccgaccgtagccttaccggcccctacggtacctccgttacctacccgttacccctaccgttccctagaccgttcacgtacccgg

SEQ ID NO: 257344 - DNA, 732 bp, Homo sapiens
  misc_feature: GYAE6OF02HCU36.38.39.D06.1.454.CMB.1.raw
  modified_base (240)..(240): a, c, t, g, unknown or other
  misc_feature (240)..(240): n is a, c, g, or t
  modified_base (289)..(289): a, c, t, g, unknown or other
  misc_feature (289)..(289): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgtacgttgggtggttaataaatatgtactcgttggaccaacntccaccaacatccaccaggacaaacgtaccccaaactcaattaatttanacgtacgtacactacgacgtccggccctacgtacggggttttcctacgttccgtctttccgtcgtcggtacctaccgttaaggtttcggaccaaccgtacccggtaccctccgtacggtaccttagtttccgtcgggtcctaccgtgggtacctaggacgggtcgacgggtctaggttaaacttttgtcgccgtttccctactaacttacctaacgacggctaacggaccgtaccgtaccccgtaacccttttatccgggtttacgtaaccgggtaacgttaccggggtaaccctaaggggttacccttaaccccggttaccgtacccgtacgtaaccgacccgtaacggaccccaaacccgtacggtccgttaacgtacccttacccggttcccttaccccgtaaccccttccgtaccgtaccggttactaccgttaaccgg

SEQ ID NO: 257345 - DNA, 450 bp, Homo sapiens
  misc_feature: GYAE6OF02GK58X.38.39.D06.1.454.CMB.1.raw
  modified_base (301)..(301): a, c, t, g, unknown or other
  misc_feature (301)..(301): n is a, c, g, or t
  modified_base (408)..(408): a, c, t, g, unknown or other
  misc_feature (408)..(408): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (422)..(450): a, c, t, g, unknown or other
  misc_feature (422)..(450): n is a, c, g, or t
tcagtcgatcacgtcacgaccggtgctcgatttagtgacatctcgcagttctttgggggactttgcctgggtgacgttggtggttataaatatgtctcttggtaccaacatcaccaacatcacccaggcaaagtccccaaatcataatttatgaggtcactaaacggccctcaggagtttctaatcgcttctctggctccaagtttggcaaacacggccctccctgacctatttctgggctccaggctgaggacgaggctgtaattttatgctcctcatatacaggcagcagcacccttantcttcggaactggaaccaaggtccaccgtctacgtcacgcccaaaggcccaaaccccatgtaccacttctcgtccccgcctcctcacgtgactcgatggagcgggcnggcaaggcnanagnnnnnnnnnnnnnnnnnnnnnnnnnnnnn

SEQ ID NO: 257346 - DNA, 600 bp, Homo sapiens
  misc_feature: GYAE6OF02GL16P.38.39.D06.1.454.CMB.1.raw
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
  modified_base (267)..(267): a, c, t, g, unknown or other
  misc_feature (267)..(267): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtcgtgggtctcctggacagtcgatcaccatcctcctgcactggaaccngcagtgacgttggtgttaataatntgtctctgtaccanatcacantcaccagcaacgtcccaatcatattangacgtacactaacgcctagaggtacttactatcgcttactcgtcggaccttcgaacgtcgtacggaccaaccgaccggtcctcccgtgacctactcgtacgtcggggtaccctaccgaaccgtggacggacggtggtcctactacctttagttatcgacagtcctataacttactaacgaacgcgtacgcgttccgtaggtttgggtcgggttacgggacgggtacggcccttacgtagaccgttctacggccgtacgaccgtagtccgtcccggtcccgtagtccgtccgtcgttcccgtcccgtccctccgttacgccgtactcgtaccgg

SEQ ID NO: 257347 - DNA, 725 bp, Homo sapiens
  misc_feature: GYAE6OF02HGAVZ.38.39.D06.1.454.CMB.1.raw
  modified_base (360)..(360): a, c, t, g, unknown or other
  misc_feature (360)..(360): n is a, c, g, or t
  modified_base (436)..(436): a, c, t, g, unknown or other
  misc_feature (436)..(436): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttataaatatgtctcttcggtaaccaacactccaaccaactactaccaacccgaggaaccaaacgtacccccaaactacaattaatttatggacggtacaacccgtaaaacgcccctacgtaggtatttactaaatccgtaccttcttcgnggtacctacgagtccgtggaccaacgaccgtccctctacgaactagtccgttacgtcggtacctacccgtaaacgnggtaacggaccggtaggtacctaccgttaactttaaattcggtaacgctacgtactaacgtaactaaactaaccgaagtccgtaacggttccgttaccgttcggtttacggggttcggttacccggggtaccggggaacgggtacccgtacccggttacggttaccgtttccggttaacggtccgaacccggtacgggtacgtcccgttcccgtaaccccggttcgtacctaccgttcccgttacccgttccccgacccgttccgaccggtaccgttaggaccgtaccg

SEQ ID NO: 257348 - DNA, 748 bp, Homo sapiens
  misc_feature: GYAE6OF02F2DP1.38.39.D06.1.454.CMB.1.raw
  modified_base (235)..(235): a, c, t, g, unknown or other
  misc_feature (235)..(235): n is a, c, g, or t
  modified_base (286)..(286): a, c, t, g, unknown or other
  misc_feature (286)..(286): n is a, c, g, or t
  modified_base (706)..(706): a, c, t, g, unknown or other
  misc_feature (706)..(706): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataatatgtctcttggtaccaanatacaccaacatccacccaggaccaaacgtccccaaactcaattaatttangtacggtacaacgtaaaccggccctacgaggtacgttttactaacgtccgtaccttttcgtacgttcggtaccttaccgtaaacgttcgttacgggaccaaaccgtaaccgggtccccttacccgtacggaaccctattcccgttcggtcggggtacccttacccgaaccgttggaaccgggtaacgacgggtcctacgtaactttaacgtttacgttcgaccgtagtcctacgtaacttaacgtaaccaacggtccaacggtccgttaccgtaacggtttcggggttacgggttaccgggacgggtaaccgggtacccgtaccgtcggtacccgtttacgttacggacgtaccgacccggtacggtccgtcccggtccccgttacggtccctacccgttcccgttcccggtttaccccnccccggttacccgtaccgtaccgggttctacccggtacccgg

SEQ ID NO: 257349 - DNA, 733 bp, Homo sapiens
  misc_feature: GYAE6OF02GKJ2T.38.39.D06.1.454.CMB.1.raw
  modified_base (193)..(193): a, c, t, g, unknown or other
  misc_feature (193)..(193): n is a, c, g, or t
  modified_base (239)..(239): a, c, t, g, unknown or other
  misc_feature (239)..(239): n is a, c, g, or t
  modified_base (294)..(294): a, c, t, g, unknown or other
  misc_feature (294)..(294): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtagttaataaatatgtctcttcggtaaccaacntaccaaccaacactccacccaggacaaacgtaccccaaactcaattaaactttangacgtacaaccgtaaaccggtccctagacggtagtttactaatcgtacttctctggtacctaccgaagtctacggtaccaaaccgccggtacccttccccgtacgaaccctagttccttccggtcgggtacctacccgtaaaccgtggaacgggacggacggtacctaccgtaactttacgtttaacttcggaccgtaagtccgtaactaacgtaactaaccgtaacgaccgtaacggtaccgttacgttacggtttcggggttaccggtccggggaccggggtaccggtacccggtaccgtaccgggttaccgttacggttacggtaccggaaccgtcccggtaacggtcccgtacccggtccccggtcggtaccctaccgttccgttcccggttaccccctcccgttcctaccggtaccgtttacgacgttacccgg

SEQ ID NO: 257350 - DNA, 707 bp, Homo sapiens
  misc_feature: GYAE6OF02JCG9Q.38.39.D06.1.454.CMB.1.raw
  modified_base (201)..(201): a, c, t, g, unknown or other
  misc_feature (201)..(201): n is a, c, g, or t
  modified_base (492)..(492): a, c, t, g, unknown or other
  misc_feature (492)..(492): n is a, c, g, or t
  modified_base (504)..(504): a, c, t, g, unknown or other
  misc_feature (504)..(504): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtcgtgggtcctccgtggacagtcgatccaccatccgtctgcacgtacggaaccngcagtgtacggttggtagttaataaattattcgtcctaccgtacggtaaccaaacaaccacccgaggaaccaaaccgacccccaaactcaactctaatttacgtcgaccgtcactacctacgtcccggtccctacggttacgggtttcctaaccgttccgtcttccgtcgtcggtcctaccgtaagtttcgacctaacgccggtccctccgtcgtaaccttcgttcgtcggtcctaccgcggtcgtacggacggacggacggtcgttagtttaattttcgtgtccctactntaacgtatacgngacagaccgacgtacccttaccgtacgttcgtaccgttacgacgtaccggtacgtaccggtccgtaccgttccgtaactaccgaccgacccgaaaccgtacccctaacctaccgtcgtaccctcgttcccgtacccgttccccgttaccctacccgtacgttacgtacgtaccgttaccggtacgtaccgggccgtaccgggg

SEQ ID NO: 257351 - DNA, 681 bp, Homo sapiens
  misc_feature: GYAE6OF02GONOG.38.39.D06.1.454.CMB.1.raw
  modified_base (164)..(164): a, c, t, g, unknown or other
  misc_feature (164)..(164): n is a, c, g, or t
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
  modified_base (309)..(309): a, c, t, g, unknown or other
  misc_feature (309)..(309): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacngtcgatcaccatctcctgcactggaaccngcagtgacgttggtgttaataatntgtctcgttaggtaccaatntaccaccaactntccaccaggacctaacgtaccccaaatcaataattatgacgtacaacctaacggccctanaggtagtttactaatcgtcttctcgtggctaccgtaagtctcggaccaacgaccggtccctaccgtcgaaccctactccgtacgtcgggtacccttacccgaaccgttcggaacggtacgacggtccttaccgtaacttattacgttcgcgtacgtcgttacctaatacgtaaccaacgtaccgtaacggttccgtacgtaccggtttacgggttcggtttacccggggacgggtaccgggtacccgtaccgtaccgttaccgttacgttacggtctaccggaccgtacggtcgtcccgttacccgttcggttcctaccttccgttacccttccccgttaccctccgttaccacggttacgaccgttaccgg

SEQ ID NO: 257352 - DNA, 689 bp, Homo sapiens
  misc_feature: GYAE6OF02ILZBP.38.39.D06.1.454.CMB.1.raw
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
  modified_base (278)..(278): a, c, t, g, unknown or other
  misc_feature (278)..(278): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatntgtctnttcggacaacatcacaacatccaccaggcaaacgtccccaaactcaataattntagtaggtactaacgtaaaccgcctacgtaggtacttctaatcgtcttctcgtaggcctactaagtctaggcctaaacgaccggccttaccctcgacctacgttcctcgtccgggactaccctaaccgtaggaacgggacgtacggctaccgtaacgttacgtttattcgacgtacgtactacctaataacgtaacgaacgctaacggccgttaccgtaaggtttcgggtcggttacgggacggggacgggtaacccgtaccgttaggacccggtttacgtacggttacccgaaccggtacccgtacgggcccgttacccggtccccccggttacggttacccttaaccgttcccgttcccggttcccccgtaccccttcccgtaccggtaccggttccgtactacccggg

SEQ ID NO: 257353 - DNA, 915 bp, Homo sapiens
  misc_feature: GYAE6OF02GYOFC.38.39.D06.1.454.CMB.1.raw
  modified_base (205)..(205): a, c, t, g, unknown or other
  misc_feature (205)..(205): n is a, c, g, or t
  modified_base (239)..(239): a, c, t, g, unknown or other
  misc_feature (239)..(239): n is a, c, g, or t
tcagtcgatcacgtcacgaccggtgctcgatttagtgacatctcgcagttctttggggactttgcctgggctctgctgctcctcaccctcctcactcgagggcacgagggtcctgggcccagtctgccctgactcagcctgcctcggtgtcgtgggtctcgtggacagtcgatccacctatcctccgtagctacgtcggaaaccngcgagttgtacggtttggttagttaaataaattntcgttccttacgttacggtaaccaactctaccgaaccctaacactaccaacccgaaggaaccaaaaccgttacccccaaacttactaaactttaaaagttttagtacggtaacggtaaccgtaaaccgttaaaaccccgggccccttaacggtaagggttacttttaactaacgttccgttaccgttttacctccggttaccggtaccttaccggtaacgtttccgtacgggaaccctaaaccggtacccggtccccctttaaccggtacctaacccgtttaacgtttcccggtaccgtttacccggggttaccctaacccgttaaaccggttacggggtaaaccgggtaaccggtaccggttacttacctttaaacgtttaagttttacgtacgtaccgtaacgtcgttacctaacttaaacgtaaacccggtaagtccgttaacggttccggtttacctacgggttttacggggtttccgggccggggtaaaccgggtaccgggttacccgaacggtttaccgtacccggttaagttaccggtaaccgcgaaacccggttccgtccgtacccccggttccccgggttctttccccgtaacgtttcccccgtttaccgttaccccccgtccctttacccgggtaaccgttccggttaacggtcccgttaacccgg

SEQ ID NO: 257354 - DNA, 756 bp, Homo sapiens
  misc_feature: GYAE6OF02FTT7H.38.39.D06.1.454.CMB.1.raw
  modified_base (521)..(521): a, c, t, g, unknown or other
  misc_feature (521)..(521): n is a, c, g, or t
tcagtcgatcacgtcacgaccggtgctcgatttagtgacatctcgcagttctttggggactttgcctgggctctgctgctcctcaccctcctcactcagggcacagggtcctggcccagtctgccctgactcagcctgcctccgtgtctgggtctcctggacagtcgatcaccatctcctgcactaggaaccagactagtgacggtttggtaggttaataaatagttgttacttcgttaggtaccaaactataccaaccgaactactaccaaccgacggacaaacgttacccaaactactaactaaatttacgtgaacgtaccaaccgtaaaccgtccctagtacgtacgtttactaacgtcgtcttcctctaggtcctacgtaacgttcctagtaccaacgtacccggtaccctcccgtacgaacctactccgttcggaccgggtctacccgtaccgtagggacggaacgtccggttaccgtactacgtttacttacgtacgtctaacgtctacgttaanaactaacgaacgtaccgacgttcgtaaacgtacggtttcgggtacggttaccgggacgggtaaccgggtaccgttaacggtccgggtaaccgtttcgttacgggtacctaaccgggacccgtaacgggttcccacccgggttcccccttaccgggttacctaacccggtttccgtttacccggttcccccgttaccttcccgtaacccggttacggtaccgttacctacccgggg

SEQ ID NO: 257355 - DNA, 661 bp, Homo sapiens
  misc_feature: GYAE6OF02H24RS.38.39.D06.1.454.CMB.1.raw
  modified_base (276)..(276): a, c, t, g, unknown or other
  misc_feature (276)..(276): n is a, c, g, or t
  modified_base (311)..(311): a, c, t, g, unknown or other
  misc_feature (311)..(311): n is a, c, g, or t
  modified_base (428)..(428): a, c, t, g, unknown or other
  misc_feature (428)..(428): n is a, c, g, or t
  modified_base (469)..(469): a, c, t, g, unknown or other
  misc_feature (469)..(469): n is a, c, g, or t
tcagtcgatcacgtcacgaccggtgctcgatttagtgacatctcgcagttctttggggactttgcctgggctctgctgctcctcaccctcctcactcagggcacagggtcctcgggcccagtctgccctgactcagcctgcctccgtgtctgggtcctccgtggacagtcgatcacactctcctgcactcggaaccagcagtgacgttggtagttaataaaatatgtctgttacgaccaactatcaacaactatcaccgagacaaacgtacccaancattaattataggagtacaacgtaaaccgcccgtnacgtacgtttactaatccgacttctcgtgtctaccgaagtctcggcaaacgaccggtcctacccgtacgactaactcctacgtggactacccgaacgtggaacggacgacggtaccncaacttatacttgacctgtctctaatacgtaacaagtaacncgtaccgttccgtggtttacgggtggttccggggacggtacgggtacccgaacgtccgtaaccgttcgttaaacgggtcgaaccgtccggaacggtcgtccggtacccccgtaccgtccggtaaccgttccgttacccggttacccccgttccccgtttacccgccgtttaaccgttccggtacctacccgg

SEQ ID NO: 257356 - DNA, 636 bp, Homo sapiens
  misc_feature: GYAE6OF02HLGDV.38.39.D06.1.454.CMB.1.raw
  modified_base (441)..(441): a, c, t, g, unknown or other
  misc_feature (441)..(441): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtcgacgttggtgttaataaatatgtctcttgtacaacatcaccaacactcacccaggacaaacgtaccccaaaactctaattaaatttatagtacggtacaactaaaccggccctacacggtagtttactaacgtcgtcttctctggtctccaagtctaggacaacgcgacctcctacgacctactctcgtcggtctccgaacctgacggacgtacggctactacttattagttcgacagtctntaactataacgaacgacacgtctacgtacgttacggggttcgtccggggtacgggaaccgggtaccgtaccgtacggtaccgttacgttacggtacgtacgacccgacggtccgtccgtcccccgtccggtaccgtaccgttccgttacccgttccccgtcccttccgttacccgtaccgttcgtaccgtaccgg

SEQ ID NO: 257357 - DNA, 926 bp, Homo sapiens
  misc_feature: GYAE6OF02JZAY9.38.39.D06.1.454.CMB.1.raw
  modified_base (200)..(200): a, c, t, g, unknown or other
  misc_feature (200)..(200): n is a, c, g, or t
tcagtcgatcacgtcacgaccggtgctcgatttagtgacatctcgcagttctttggggactttgcctgggctctgctgctcctcaccctctcactcaggcacagggtcctgggcccagtctgccctgactcagcctgcctccgtgtctgggtctccgtggacagtcgtatccaccatcctcctgaccacgtacggaaccngccaaggtcggtacggtttgggttaggttaaataaattacgttggttccttccggttacggtaaccaaaacgtacttaccaaccaaacctacgttaccgaacccggaacggtaacctaaaaaccgtacccccctaaaacgttactaaacgttaacttttaaggtacgggtaacggtttaacccaaaacccggttaaaacccgggtcccccgtaacggttaacgggtaacgttttaacccgtaaacgttccggttacccttttaccgtccgggtaacggtacccttaacccggttaaacggtcccgttaacggggaacccaacccggtaacccgggttccccttaccccggtaacgacccgttaacgttccccggttaccggtacgggttacccaacccccgttaaaggttcgggaaacggttaccggtaacggtcctaaaccgttaaccgtttaattacggttaccgacgttacgtactaactaacgttaacgtaccgaaggtaccgacggtaccgttactacgggtttacgggtccgttacggggacggaacccgggttaccgtaccgttacggtaccgttaggttaccgtacgaaccgggttcccgtaagggtccccttaacccgggccccgtttaaccggtacctacccggttttccgtaacccccctacccggtttaacccgtcccggtttacaacccggttacccttaggttaacccccgg

SEQ ID NO: 257358 - DNA, 583 bp, Homo sapiens
  misc_feature: GYAE6OF02GW719.38.39.D06.1.454.CMB.1.raw
  modified_base (337)..(337): a, c, t, g, unknown or other
  misc_feature (337)..(337): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatatgtctcttggtaccaacatcaccaacatcacccaggcaaagtccccaaactcataatttatgaggtcactaaacggcctcaggatttctaatcgcttctctggctccaagtctggcaacncggcctcctgaccatctctgggcctaccaacctgacggacgaggctcacttattattgcagtctacaatataacaagcagccgtactacggtttgggtcgttcgggacggtacgggaccgtaccgtggtacccgttcgttacggtccacggtaccccgaagggtccgtaccggccccccgttcgggtacctaccttccgttccgttacccccacccgttcccttaccgtacgttcgacttacccgg

SEQ ID NO: 257359 - DNA, 719 bp, Homo sapiens
  misc_feature: GYAE6OF02GZ2A0.38.39.D06.1.454.CMB.1.raw
  modified_base (452)..(452): a, c, t, g, unknown or other
  misc_feature (452)..(452): n is a, c, g, or t
  modified_base (498)..(498): a, c, t, g, unknown or other
  misc_feature (498)..(498): n is a, c, g, or t
tcagtcgatcacgtcacgaccggtgctcgatttagtgacatctcgcagttctttggggactttgcctgggctctgctgctcctcaccctcctcactcagggcacgagggtcctgggcccagtctgccctggactcacgcctgtccgtccgtgtcgtgggtcctccgtggacagtcgatcacatcctctgcacgtcggaaccagctaggtcgtacggttggtagttaataaactgttcgttccttcgttacggaacctaaactactccaaaccaacactaccgaccgacggaacaaaccgtaccccaaattacaattaaacgtttagtcggtaacggtctaaaccgtaaaccggtccctagtaacggttacgtttaacaacgtcgtcttccgttcgacgtcctaacgtaacgttcgacggaccaacgccggacccttccagtacctacttcgngtcggaccttaccgaacgtggaacgacgcgctacgtattatacgtnaccgactctaacaatactagacgagtacgtccgtaagtcggtttacggggtgttaccgggaccggtaaccgggtacctacccggtagttaacccgttcgttaaggccgttaacgcccgtagccctaacccggtccccggtttacgaccgttaacccggtccgtttacccggtacccccgttccgttacccgtacggtaacggttaccggaacctttccggg

SEQ ID NO: 257360 - DNA, 174 bp, Homo sapiens
  misc_feature: GYAE6OF02HEOEL.38.39.D06.1.454.CMB.1.raw
  modified_base (157)..(174): a, c, t, g, unknown or other
  misc_feature (157)..(174): n is a, c, g, or t
tcagtcgatcacgtcacgaccggtgctcgatttagtgacatctcgcagttctttggggggaagaggaagactgacggtcctgccacagcggccctgggctgcctggtcaaggactacttccacgtgatcgactgagcgggctggcaaggcgcatagnnnnnnnnnnnnnnnnnn

SEQ ID NO: 257361 - DNA, 739 bp, Homo sapiens
  misc_feature: GYAE6OF02JLQOH.38.39.D06.1.454.CMB.1.raw
  modified_base (135)..(135): a, c, t, g, unknown or other
  misc_feature (135)..(135): n is a, c, g, or t
  modified_base (165)..(165): a, c, t, g, unknown or other
  misc_feature (165)..(165): n is a, c, g, or t
  modified_base (178)..(178): a, c, t, g, unknown or other
  misc_feature (178)..(178): n is a, c, g, or t
  modified_base (197)..(198): a, c, t, g, unknown or other
  misc_feature (197)..(198): n is a, c, g, or t
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
  modified_base (687)..(687): a, c, t, g, unknown or other
  misc_feature (687)..(687): n is a, c, g, or t
tcagtcgatcacgtcacgaccggtgctcgatttagtgacatctcgcagttctttggggactttgcctgggctctgctgctcctcaccctcctcactcagggcacgagggtcctgggcccagtctgccctgactcngcctgcctcgtgtctgggtctccgtggacngtcatcaccatcncctgctacgtacggaaccnncgagtgtacgttggtagttaataaattntcgttctacgttacgtaaccanactaccaaccaacactaccgaaccgacggaccaaacccgttaccccaaaacttcctaaatttaaacgtttagtagtaacggttaccctaaacgtaaaccccgtccgtacggtaacggttacgtttacttaactccgtcctttcgtccggtaccggtaccttaccgaacgttccgacggacccaaacgtcccggtccctacctaacgccttgtcccttagcccggtacctacccacggtcggaacggtaccggacgttacctaacgtattaagtttacgtccgtaactcgtactactaactaacttacgaacgtcgtaacgtccgttcagggttttccgggtcggttacgggacgggtacccgggacctacggtacggttaccgttcggtaaccgtcgaccggcccgttacggcccgtccgtaaccccggtgtacccgtnttcccggtttccccgtccccgttcaccccgtgtaccccgtggtccctaacgg

SEQ ID NO: 257362 - DNA, 827 bp, Homo sapiens
  misc_feature: GYAE6OF02F3QS9.38.39.D06.1.454.CMB.1.raw
  modified_base (192)..(192): a, c, t, g, unknown or other
  misc_feature (192)..(192): n is a, c, g, or t
tcagtcgatcacgtcacgaccggtgctcgatttagtgacatctcgcgagttctttggggactttgcctgggctctgctgctcctcaccctcctcactcagggcacagggtcctggcccagtctgccctgactcagcctgcctccgtgtctgggtctcctggacagtcgatcaccatctctgcacgtgaaccngcaggtgacgttggtacgttaataaactagttcgttcgtacgttaggtaaccctaaactcttaccgaaacctaaacgtattacccaaacccgaagggaacctaaaaaccggtacccctaaaaacctactaaactttaaactttaagtacggtaacgggttaaccctaaaccgtaaaaacccgggtccccttaaggtaacgggttaacgtttacgttaaactccgtaccttttccgtacgttcggtaccttaccgtaacgtccgtagggtaccaaaccggtacccggtcccttacccggtacgaacccgttagtaccgttccggtacgggtaacccttaccgtaaaccgaggtaaaccgggacggtaacggtaccttaacctaacgtttaatttaacgtacggactaacgtaccgtaatacgaaactaaccgtaagtccgtaacggtaccgtacgttacggtttggggttacggtaccgggtacgggaaccgtacccgtacgttacggttaccgttacgttacggtacgacccgtacggtaccggacccttcccgggtaccccgttaggtaacccgtcttaccccggttccgtacccccgtccggttaccctacgtacgggtctaccgtaacccgg

SEQ ID NO: 257363 - DNA, 746 bp, Homo sapiens
  misc_feature: GYAE6OF02GXGPE.38.39.D06.1.454.CMB.1.raw
tcagtcgatcacgtcacgaccggtgctcgatttagtgacatctcgcagttctttgggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatatgtctcttggtaccacatcacaacatccaccagcaaacgtaccccaaactcaataacttatgaggtacaacgtaacggccctacgaggtagtttactaatcgtcctttctcgttcggccttaccgtaagtccgtaggaccaaccgaccggcccttccctacgaacccacttttttccacgtcgggtacctaccctaaaccgtggaacgggaacgacggtactaccgtaacgtttaacgtttaacgttcgtaccgtactaccgttactaaacttaacgtaaaccaaggtaccgtacggtaccgttaccgttacggtttacgggttaccggttccggggaacgggtaccgggtacccgtaccgttacggtacccggtttacgttacggttacccaaccggtacccgtaacgggtcccgttaccccggtaccccccgttacggttacccctaaccgttccccgtttcccggttaccccccggtaccccgttaccccggttcccgttaaccggttacggtacccggttacccgg

SEQ ID NO: 257364 - DNA, 746 bp, Homo sapiens
  misc_feature: GYAE6OF02FYEZC.38.39.D06.1.454.CMB.1.raw
  modified_base (181)..(181): a, c, t, g, unknown or other
  misc_feature (181)..(181): n is a, c, g, or t
tcagtcgatcacgtcacgaccggtgctcgatttagtgacatctcgcagttctttggggactttgcctgggctctgctgctcctcaccctctcactcaggcacagggtcctggcccagtctgccctgactcagcctgcctccgtgtcgtggtctccgtggacagtcgatccaccatcctccngcacgtcggaaccagcagtgtacgttggttagttaataatgtcttcttcgttacggtaccaactataccaaccaactactacccaaccgtacgaacctaaaccgtaccccaaaacttctaaatttaaatttagagtaacggtacaaccgtaaccggccctaggtacggttacttactaacgtcgtcttcctcgtcgtaccttaccgaagttccgagaccaaacgtcccgtccctaccgtacgactctcgttcgcggtacctaccgaactggaaccggacggtcgtacttacgtaactttattacgtcgacgtaactccgtaaactacgtaacgttaacgaaacgtcgtaaccgtaccggttaccggttaacgggttacggggtttcggttaccggggaacccgggttaaccgggtaaccccgtaccgtttaacccggggtacgtttaacgtaaccggtccgtaacccgcgtacccggtcccgtacccgtccccggttacgtacccctaccgtttccgttacccgcccctacccgttccgtaaccggtccgttacgaccgttccgg

SEQ ID NO: 257365 - DNA, 705 bp, Homo sapiens
  misc_feature: GYAE6OF02HJANZ.38.39.D06.1.454.CMB.1.raw
tcagtcgatcacgtcacgaccggtgctcgatttagtgacatctcgcagttctttggggactttgcctgggctctgctgctcctcaccctcctcactcagggcacgagggtcctgggcccagtctgccctgactcagcctgcctccgtgtctgggtcctccgtggacagtcgatcaccatcctcctgcacgtacggaaccagctaggtgtacggttggttagttaataaattatcgttcttcgttacggtaaccaacactacaaccaactatacccaaccgaggacctaaaacgtacccctaaactactaattaactttagtacgggtaacgtacgtaaacccgtaaacccggtcccttacggtaggttaacgtttacgttaactccgttcttcgttcgtacggtacctaccgtaagtcgtacggaccaacgccgtccctaccgtcacgtactcgtcgtacggcctaccgaacgtggacggacgtacgtctacgttacttactttacgtacgtacacgtcctacgtaactacaacgacgacagtccgtacgtcggttgggtacggttacggacgggacgtacccgtacgtccgtaaccgttcgtacgaccgtagacccgtacgtccgtacccggccccggtacgtcctaccgttccgttacccggttccccgtccctacgtacccggtacgacgttccgtaaccgg

SEQ ID NO: 257366 - DNA, 751 bp, Homo sapiens
  misc_feature: GYAE6OF02FT5MR.38.39.D06.1.454.CMB.1.raw
  modified_base (219)..(219): a, c, t, g, unknown or other
  misc_feature (219)..(219): n is a, c, g, or t
  modified_base (238)..(238): a, c, t, g, unknown or other
  misc_feature (238)..(238): n is a, c, g, or t
  modified_base (252)..(252): a, c, t, g, unknown or other
  misc_feature (252)..(252): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctcgtgtctgggtctcctggacagtcgatcaccatctcctgaactggaaccagcagtggacgttgggtgttaataaatntgtactcttaggaaccaanataccaaccgaacncgtaccacccgaggaccaaaaccgtccccaaatacaattaaatttagaggtacggtaccaaaccgtaaaccggccctagtaggtacgttttacaaagtcgtaccttcttacttcggactaccgtaacggttcgttaccggaaccaaaccgtacccggtacccttccccgtacgaacccttaactttccccttacgggtccggtaaccctaccctaaaccggttgggaacggtaccgacgggttacctaaccgtaacttaaggttttactacggacacggtacctagtaaacaagttaaccgagccaaggtaccgttgtacgggtttcgggttacgtaccggggacggggaccggtaaccgtaccgtacggtaaccgttcgttaacggtcaccgtacccggaacgtctcccgggtcccctacggacccttaccgcccgttttacccgtacccccgttcccttaccggttaacctacccggttcgaccgtttcgaacccgg

SEQ ID NO: 257367 - DNA, 689 bp, Homo sapiens
  misc_feature: GYAE6OF02F6YXM.38.39.D06.1.454.CMB.1.raw
  modified_base (202)..(202): a, c, t, g, unknown or other
  misc_feature (202)..(202): n is a, c, g, or t
  modified_base (220)..(220): a, c, t, g, unknown or other
  misc_feature (220)..(220): n is a, c, g, or t
  modified_base (290)..(290): a, c, t, g, unknown or other
  misc_feature (290)..(290): n is a, c, g, or t
  modified_base (478)..(478): a, c, t, g, unknown or other
  misc_feature (478)..(478): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggaccagtcgatccgaccatcctcctgcactggaagcagtagngacagttggtaggttaanaacgtatgtctcctaggtaccaaacgaacacccaggtaccaaacgcccccaaaactccatactaatttangtacgtcactccatccggccctcgtacggggtttctaccgtcgtcttcctcgtcggcttaccgtaaggtttcgacaaccacggtccctcctacgacctactttcgcgggccttcgacggtcgtagacgggaacggcggtaccttagtaaatttttagtcgtcctttacctacgtaattaacgttaacncgggtacacggtacacgacccgtacccttaagttcggtaccgttaaccggtaacgtaccgggtaaccaacgggttccgtaacccgttaccttaccgtaccaaccggaccctaaaccgggccctaaaccccgtctaccgtaactcctacgtaccccggttccccaacccgttccctacgtaccgtactacgttacccggatacgggtaccgg

SEQ ID NO: 257368 - DNA, 757 bp, Homo sapiens
  misc_feature: GYAE6OF02JBKIF.38.39.D06.1.454.CMB.1.raw
  modified_base (190)..(190): a, c, t, g, unknown or other
  misc_feature (190)..(190): n is a, c, g, or t
  modified_base (224)..(224): a, c, t, g, unknown or other
  misc_feature (224)..(224): n is a, c, g, or t
  modified_base (229)..(229): a, c, t, g, unknown or other
  misc_feature (229)..(229): n is a, c, g, or t
  modified_base (251)..(251): a, c, t, g, unknown or other
  misc_feature (251)..(251): n is a, c, g, or t
  modified_base (664)..(664): a, c, t, g, unknown or other
  misc_feature (664)..(664): n is a, c, g, or t
tcagtcgatcacgtcacgaccggtgctcgatttagtgacatctcgcagttctttggggactttgcctgggctctgctgctcctcaccctcctcactcgacgggcacgagggtcctgggcccagtctcgccctgactcagcctagcctcgtgtctgggtctccgtggactagtcgatcaccatcctccgtncgctggaaaccgtcaggtgacgtggtcggttaanaaatntgtctacgttaggtaccaactntacaaccaactatccacccgaaggcaaacgtacccaaactctaattaaatttacgtagacggtacaacgttaaacggaccctgaaggtactttactaatccgtatcttaccgtggaaccttcaacgtcgttcggaacaaccaaccgggtccctaccctacgggtacctaagtctaccgtagggtaccctaacccctaaagttacggacgggaacgttaccggacctacgtaaacctttagttaaacgttcggtaccttacggaccgttaccgtaagtacctttaacgaaaggtaccctaacgtacgtaccggtaacgtttccggggttaacggtaccgggttaccgggaacggggtaccgtaccggggtaacccgttaagttacccggttaacggtaaccgcgtaaaccccgnggtaacccgaccgttcccccgggacgtttacccgtacgtacccgttccgtcccccggtacccgttacgcccggtaacgcggttacgtaaccgg

SEQ ID NO: 257369 - DNA, 692 bp, Homo sapiens
  misc_feature: GYAE6OF02ITBOJ.38.39.D06.1.454.CMB.1.raw
  modified_base (181)..(181): a, c, t, g, unknown or other
  misc_feature (181)..(181): n is a, c, g, or t
tcagtcgatcacgtcacgaccggtgctcgatttagtgacatctcgcagttctttggggactttgcctgggctctgctgctcctcaccctcctcactcgagggcacgacggtcctgggcccagtcctgccctgactcagcctgccctcgtgtcgtggtcctccgtgaccagtcgatcaaccntcctcagctacgtcgaacagctagtgtacgttggtagttaacaaatgtcgtactacgttacgaacctaaatctaccaaccaactactccgaaccgaggaaccaaaaccggtaccccaaagtactaaactttaagttacgacggtaacgttacctaaaccgtaaaccggtcccttaaggtaaacgttacgttaacttaacgtccgttacttcgtacgtacgtacctaagtacggttcgacgactaccgaccgtcctcgtacaactcgtactcgcgtactaccaagtgaacggtacacgtactactaagtactaactcacgtacacgtaactaagttaactaaacgacacgtacgtacgtacgttacggtcgggttacgtaccggggacgtacggtaaccgacgttacgtacgttacggtaacaccgtaccgtaccgacgtcctcccggtacccgtacgtcgtaaccgttccttccggtaccctaacctccgtaccggttctacgtctaccgg

SEQ ID NO: 257370 - DNA, 761 bp, Homo sapiens
  misc_feature: GYAE6OF02HRT7D.38.39.D06.1.454.CMB.1.raw
  modified_base (180)..(180): a, c, t, g, unknown or other
  misc_feature (180)..(180): n is a, c, g, or t
  modified_base (187)..(187): a, c, t, g, unknown or other
  misc_feature (187)..(187): n is a, c, g, or t
tcagtcgatcacgtcacgaccggtgctcgatttagtgacatctcgcagttctttggggactttgcctgggctctgctgctcctcaccctcctacactcgagggcacgagggtcctgggcccagtctgccctgactcagcctgcctcgtgtctgggtctccgtggacagtcgactcacctntctcctncacgtacgaccagcagtcggtacggtttaggttggttaataaatagttgttccttacgttacggtaaccaactactacaacccgaatccgtacccaccgacgtaaccaaccgttaccccaaacttcaatttaagttagtgaacgtacctaaaccgtaacccggaccctacggtacggttaacgttttacctaagtaccgtctttcgtccgttacggtactacctaagtacgttcgaccaaacgtcccgtaccctcgacgacctactccgtcgtacggaccctaccgaacgtgggaacggacgtaccgtcgtacttaactacttaagtcgtacgtaccgtactacgtacttaaagttacgaacggtccgacgaccgaccttacccgtttaacccttcggttaaccggttaccggttaaccgggacggttaaccggaacccggtaacggttacccgtaccccgttaaccggccgtacccgtaccggacccggtaacccggaaccccttaccccgtaacgtccctaccgtaccttccgttcccgttaccccgccctttacccgtcgtacccgtacgg

SEQ ID NO: 257371 - DNA, 703 bp, Homo sapiens
  misc_feature: GYAE6OF02I53DA.38.39.D06.1.454.CMB.1.raw
  modified_base (160)..(160): a, c, t, g, unknown or other
  misc_feature (160)..(160): n is a, c, g, or t
  modified_base (212)..(212): a, c, t, g, unknown or other
  misc_feature (212)..(212): n is a, c, g, or t
  modified_base (229)..(229): a, c, t, g, unknown or other
  misc_feature (229)..(229): n is a, c, g, or t
  modified_base (316)..(316): a, c, t, g, unknown or other
  misc_feature (316)..(316): n is a, c, g, or t
tcagtcgatcacgtcacgaccggtgctcgatttagtgacatctcgcagttctttgggactttgcctgggctctgctgctcctcaccctctcactcaggcaaagggtcctggcccagtctgccctgactcagcctgcctccgtgtctgggtctcctggacngtcgatcaccatctcctgcactggaccagcagtgacgttggtgttataaatntgtctctggtaccaacntcaccacatccaccaggacaaacgtccccaaactctaataattatgagtcaactaacgtccctgaggtattactaatcgtacttctntcgcctaccgaatcgtacggacctaacgccggtaccctcccgtacgacctacgtcctcgtaccggccctacccgaacgttacggacggtaaccggaggtaccctacgtaacctttattagttccgtacgtactccgtacacttaacctacgaacgtacgtacgtcccgttacgtaccggtttggggtaccggtttacggggaccgggtaaccggggtaccccggtaacccgttcggtaacccggtttaccgttaacggttcccgaacccggtccgtaaccgttcccgtcccgtaccccccggttcggtaccccgttaccgttccgttccccgttacccccgtacccttcccgttacccgtaacgttcgtacccgttaccggtaccgg

SEQ ID NO: 257372 - DNA, 816 bp, Homo sapiens
  misc_feature: GYAE6OF02ID58W.38.39.D06.1.454.CMB.1.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcatcacatctcctgcactcggaaccagcagtcgtacggtttaggtagttaaataacttagtgttcttacttacggtaaccaactactccgaaaccaaactactacccaacccgaaggtaccaaaaccgtaccccctaaaacttactaaactttaaattttagtacggtaacggttaacctaaaccgttaaacccggtaccccctaaggtaacggtttacgttttaaccttaacgtaccgtttcctttccgtaccgttcggtaaccttaccgtaaacggttccgttacggacccgtaaaccgtacccgggtccccttacccgtacgaccctacttccgtaccggttacgggtacccttacccgtaaaccggtacgggaacgggtaaccgggtacgtaccttaacccgttaactttacgtttaacgtgaccctacgtctacgtaataaccgtaacaagtaccgtacgtacctttcggttaaggtttcgggtacggttccgggaacggggtaccggtaccgtaccgtaccggtaaccgtttcggtaacgtcgaaccgtacccgacggtccgttccccggacccgttccgttactcccggtttaccctacccgttcccctacccgttccgtaacgtacggttacacggttaccg

SEQ ID NO: 257373 - DNA, 606 bp, Homo sapiens
  misc_feature: GYAE6OF02HSQCI.38.39.D06.1.454.CMB.1.raw
  modified_base (165)..(165): a, c, t, g, unknown or other
  misc_feature (165)..(165): n is a, c, g, or t
  modified_base (185)..(185): a, c, t, g, unknown or other
  misc_feature (185)..(185): n is a, c, g, or t
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (231)..(231): a, c, t, g, unknown or other
  misc_feature (231)..(231): n is a, c, g, or t
  modified_base (237)..(237): a, c, t, g, unknown or other
  misc_feature (237)..(237): n is a, c, g, or t
  modified_base (255)..(255): a, c, t, g, unknown or other
  misc_feature (255)..(255): n is a, c, g, or t
  modified_base (264)..(264): a, c, t, g, unknown or other
  misc_feature (264)..(264): n is a, c, g, or t
  modified_base (298)..(299): a, c, t, g, unknown or other
  misc_feature (298)..(299): n is a, c, g, or t
  modified_base (310)..(310): a, c, t, g, unknown or other
  misc_feature (310)..(310): n is a, c, g, or t
  modified_base (325)..(325): a, c, t, g, unknown or other
  misc_feature (325)..(325): n is a, c, g, or t
  modified_base (574)..(574): a, c, t, g, unknown or other
  misc_feature (574)..(574): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctccgtggacngtcatcaccatctcctgacncgtgaaccngcagtgacgttggtagtaataatntntctntcgacantcacantcacagacaacaccaacnctatattanagagtacaactacgccagagtattacatctcttnntcgctcagtcncgacacgccgcctcncgactactcgtccgtcggacctaccgaacgtacggacggacgacgtctacttaacttattagtacgacgacgtctacgtaactaataaccacgacgtaccggttcgttaccgtacggtttcgggtcggttaccgggaccgggaaccggtacccggtacgttaccgtaaccgtttcggtacgacccgacgacccgttacgacccgttcccgcccggttccggtacctaccgttacccgttccgttccccnccgttacccgtacgtaccggttcacgttccgg

SEQ ID NO: 257374 - DNA, 566 bp, Homo sapiens
  misc_feature: GYAE6OF02GHMGY.38.39.D06.1.454.CMB.1.raw
  modified_base (280)..(280): a, c, t, g, unknown or other
  misc_feature (280)..(280): n is a, c, g, or t
  modified_base (289)..(289): a, c, t, g, unknown or other
  misc_feature (289)..(289): n is a, c, g, or t
  modified_base (324)..(324): a, c, t, g, unknown or other
  misc_feature (324)..(324): n is a, c, g, or t
  modified_base (499)..(499): a, c, t, g, unknown or other
  misc_feature (499)..(499): n is a, c, g, or t
  modified_base (503)..(503): a, c, t, g, unknown or other
  misc_feature (503)..(503): n is a, c, g, or t
  modified_base (508)..(508): a, c, t, g, unknown or other
  misc_feature (508)..(508): n is a, c, g, or t
  modified_base (511)..(512): a, c, t, g, unknown or other
  misc_feature (511)..(512): n is a, c, g, or t
  modified_base (514)..(514): a, c, t, g, unknown or other
  misc_feature (514)..(514): n is a, c, g, or t
  modified_base (517)..(517): a, c, t, g, unknown or other
  misc_feature (517)..(517): n is a, c, g, or t
  modified_base (522)..(522): a, c, t, g, unknown or other
  misc_feature (522)..(522): n is a, c, g, or t
  modified_base (528)..(530): a, c, t, g, unknown or other
  misc_feature (528)..(530): n is a, c, g, or t
  modified_base (532)..(532): a, c, t, g, unknown or other
  misc_feature (532)..(532): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (539)..(540): a, c, t, g, unknown or other
  misc_feature (539)..(540): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (551)..(552): a, c, t, g, unknown or other
  misc_feature (551)..(552): n is a, c, g, or t
  modified_base (556)..(557): a, c, t, g, unknown or other
  misc_feature (556)..(557): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
  modified_base (564)..(565): a, c, t, g, unknown or other
  misc_feature (564)..(565): n is a, c, g, or t
tcagtcgatcacgtcacgaccggtgctcgatttagtgacatctcgcagttctttggggactttgcctgggtgatgttggtggttataaatatgtctcttggtaccaacatcaccaacatcacccaggcaaacgtcccaaactcataatttatgaggtcactaaacggccctcaggtagtttctaatcgcttctctggctaccaagtctggcaacaccggcctccctgaccattctcgtgggcctccgaaccgtgaggacgaggctacacttattattgcngctcaatanaacaagctagccgtcgtacgttgggttggttcggnggacgggaccgtaccgtggtaccgttcgtacggtcgtacgacccgaggacctccgcccccgtcggtctaccttccgtacggttccccgtaccccgtccctctacggtcgtaccgtaccggtaccgtaggacgggccgggtcgacggtaggaaccggtccgagtagaacgtgacgntcgngctancgnngntgncgtangtgtannncngtnananntagacngntgnngcgnngcncngnng

SEQ ID NO: 257375 - DNA, 762 bp, Homo sapiens
  misc_feature: GYAE6OF02JNEPD.38.39.D06.1.454.CMB.1.raw
  modified_base (320)..(320): a, c, t, g, unknown or other
  misc_feature (320)..(320): n is a, c, g, or t
  modified_base (338)..(338): a, c, t, g, unknown or other
  misc_feature (338)..(338): n is a, c, g, or t
tcagtcgatcacgtcacgaccggtgctcgatttagtgacatctcgcagttctttggggactttgcctgggctctgctgctcctcaccctcctcactcgagggcacgacgggtcctcgggcccagtctcgccctgactcgacgcctgcctccggttgtcgtgggtcctaccgtggactagtcgatccaccgatcctcctgctacgacgggaaccagcgtaaggtcgtacggttggtagttaactaaatgtcgtacgttcgttacgaccaatctaccgaactaacgctaccaaccgacggtaactaaaccgtacccaaactntaaacgttaacgttttanacggaccgttacaaacgtaaacccggtcctaacgtacggttacttactaacgtcgtacttcctcgtacggtacttacgtaacgtctacgtaacaaccgtccgtcctcctacggaccttagtccgtcggtcgtacaccgtaacgagacggacgtacgtcttaacgtaattaacgtgtccaacgtacgaccgttaataaacggtacgtaaacgtcaaacggtcggtaccgttaaccggttacgggttaggggttacggacgggtacccgggtacggggtacccttagggtaccgtaccgttaacgtcggaaccgtacggacccgtacggtccggttaccccgtcccggttacggtccgtaacgtttcccggtaaccccggtcccgtttaacccgcttaacccgggacggttacctccggtaaccgg

SEQ ID NO: 257376 - DNA, 758 bp, Homo sapiens
  misc_feature: GYAE6OF02JEQ7Y.38.39.D06.1.454.CMB.1.raw
  modified_base (586)..(586): a, c, t, g, unknown or other
  misc_feature (586)..(586): n is a, c, g, or t
tcagtcgatcacgtcacgaccggtgctcgatttagtgacatctcgcagttctttggggactttgcctgggctctgctgctcctcaccctcctcactcaggcacgagggtcctgggcccagtctgccctgactcacgcctcgcctcgtgtcgtgggtcctccgtgacgagtccgatccacatctcctgcacgtacgaaccagcgagtgtacgtttggtaaggttaataaagtactcttctacggttcgtaacaacactccaaccaacactccaaacccgaacggactaaacctacccctaaaactacgttaatttaaagttacgtacgaacggtaaccaaaaccgtacccggtaaccttgaacggtttatttaacccgtagtccgttacttttccggtacgttcgtaaccctaccgtaagttccgtaaccggtaccaaaccccgtttcgggaccccctttaaccaggtaacccctagtttcccgtacggtacgtaccccgttacaacggtaggaaccggttcggaccgacctttaccaactttagttaacgttacggaccgtacgtacttacgtaactaaacctaanaaccggtctacggacttacgtgttccggttcgttacgggacgtacggtaaccgtccggttaacgtaccgtttacgacgtaccgaacgaccgtacgtctacccgggtaccctgtacccgtaccttcccggtacccgtcccgtaccgttacctacgtacgttccgtactacccg

SEQ ID NO: 257377 - DNA, 736 bp, Homo sapiens
  misc_feature: GYAE6OF02JZ28H.38.39.D06.1.454.CMB.1.raw
  modified_base (220)..(220): a, c, t, g, unknown or other
  misc_feature (220)..(220): n is a, c, g, or t
  modified_base (240)..(240): a, c, t, g, unknown or other
  misc_feature (240)..(240): n is a, c, g, or t
  modified_base (713)..(713): a, c, t, g, unknown or other
  misc_feature (713)..(713): n is a, c, g, or t
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctccgtggacagtcgatcaccatcctcctgcactggaaccagcagtgacgttggtagttaataatnttgtcttcttaggaaccaanatccaaccgaatactccaacccgaggactaaaccgtaccccaaatcaattaatttagtagaggtaccaacgtaaaccggccctagacgttagttactaacgtccgtctttacctcgtcggtacctaccgtaacgtccgtaacggaccaaccgtcccgggtaccccttacccgtacgtaaccctacgttcgttaccggtaccgggtaccctaccccgtaaaccgttacgggaacgggtacccgtacgggtaccttaacgtaaactttacgtttacgtacgaccgtaccgttcgaacttaagaacttaacgacgtacgaccgttccgtaccgttacgggttagggttacgttccggggacgggtaccggaccccgttacggtacgtaaccgtacgtttcggacgtaccggaccgtacgcccgtcccggtcccgtaccgtccgtaccgttccgtaccgttacccccgccgttaccncgggtaactcggtaccgtaccgg

SEQ ID NO: 257378 - DNA, 663 bp, Homo sapiens
  misc_feature: GYAE6OF02G6V80.38.39.D06.1.454.CMB.1.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (271)..(271): a, c, t, g, unknown or other
  misc_feature (271)..(271): n is a, c, g, or t
  modified_base (280)..(280): a, c, t, g, unknown or other
  misc_feature (280)..(280): n is a, c, g, or t
  modified_base (372)..(372): a, c, t, g, unknown or other
  misc_feature (372)..(372): n is a, c, g, or t
tcagtcgatcacgtcacgaccggtgctcgatttagtgacatctcgcagttctttggggactttgcctgggctctgctgctcctcaccctctcactcaggcacagggtcctgggcccagtctgccctgacctcagcctgcctccgtgtctgggtctcctggacagtcgatccactatctcctgcacgtcggaaccngcagtcgtacgttggtagttaataaatntgtctcgtcgtaacantacacanactccacagacaacgtacccaactnaattaatgngtacgtacaacgtaacgcctagacgtattactaagtcctcttcgtctcgtcctacaacgttcgacgacaaccgtcgtccctctacgaactcncgtacgtgccctaaccgtacgtacgaggtaacgcgccttacgactttattacgtcgacaggtacctagtaactacggtaactaaggtccaggttccttaacgtacgggtttgggttcgtaccggggtaccggtacgggtaacccttccgtacgggttaacctttacggaccggtaacgtaccggtacccgtacggttcccgtacccccggtcccgttagttaacccctaccggtttcccgttaccccgtacccccgttccgtccgtaacttcccggtacgtaacgtcccgg

SEQ ID NO: 257379 - DNA, 173 bp, Homo sapiens
  misc_feature: GYAE6OF01CA61B.8.26.C04.1.454.CMB.1.raw
  modified_base (173)..(173): a, c, t, g, unknown or other
  misc_feature (173)..(173): n is a, c, g, or t
tcagctcgcgtgtccacgaccggtgctcgatttagtctagcgactttgggtttgggggaagaggaagactgacggtcccccaggagttcaggtgctgggcacagcggccctgggctgcctggtcaaggactacttccgacacgcgagctgagcgggctggcaaggcgcatagn

SEQ ID NO: 257380 - DNA, 541 bp, Homo sapiens
  misc_feature: GYAE6OF01CADLD.8.26.C04.1.454.CMB.1.raw
  modified_base (186)..(186): a, c, t, g, unknown or other
  misc_feature (186)..(186): n is a, c, g, or t
  modified_base (189)..(189): a, c, t, g, unknown or other
  misc_feature (189)..(189): n is a, c, g, or t
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (275)..(275): a, c, t, g, unknown or other
  misc_feature (275)..(275): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (287)..(287): a, c, t, g, unknown or other
  misc_feature (287)..(287): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
tcagctcgcgtgtccacgaccggtgctcgatttagtctagcgactttggtttgggagctctgagagaggagcccagccctggattttcaggtgctttcatttggtgatcaggactgaacagagagaactcaccatggagtttgggctggagcggtcgtggacttaacggtcgcgattaagttaagntcngtgtgagtgcagtgtggactgtgggagttgacgngcgtggtcagagtactctcgngngactacgctcgtagtactctctgtcgcgngtcgtgtngngngcgtcgcgcgcgcgcgagngngngtgtcgtcgtcgtgtcgtgtgtgtgtgtgtgcgacgacgacgacgacgacgacgacgtcgtacgtacgtcgtactacgtacgtcgcgacgagacgacgtacgaacgtacgtacgtagtacgtctagacgaagacgacgacgtacgtagagacgacgacgacgacgtacgtagtacgtacgtagtacgtacgtacgttagttacgttacgtacgtacgtacgtagtagtacg

SEQ ID NO: 257381 - DNA, 628 bp, Homo sapiens
  misc_feature: GYAE6OF01A99E0.8.26.C04.1.454.CMB.1.raw
  modified_base (308)..(308): a, c, t, g, unknown or other
  misc_feature (308)..(308): n is a, c, g, or t
tcagctcgcgtgtccacgaccggtgctcgatttagtctagcgactttgggtttggggagctctgagagaggagcccagccctgggattttcaggtgctttcatttggtgatcaggactgaacagagagaactcaccatggagtttgggctgagcgtgtcgtacttacgtgtggacttaagtttaaaggtgtccagtgtgaggtgcagttgttggagtcgtggggaggttggtacagccgtgggggtccctgagactctcctgtgcagctctggattcacctctggcagcttgtcatgagctgggtccncaggctccgagggaagggctgggagtgggtctcgatcgtatgagtggtagtggtgtcacgacacactacgcagacctcgaggaacgggtccgttacacctatcctacgagtaacaccgtaattacccgaaagaaccgtacggtatagtcctacggaactaaacgttacggaacctacgacccgttggaaaggaccggaccgggaacggaccggaccggtaccgttaatacgttaccttaggtaccggtaagtaaaccggttatttttaccggggttacggtaacggttacccttacgtttaagttttacgtttaacccgg

SEQ ID NO: 257382 - DNA, 176 bp, Homo sapiens
  misc_feature: GYAE6OF01B2W4S.8.26.C04.1.454.CMB.1.raw
  modified_base (173)..(176): a, c, t, g, unknown or other
  misc_feature (173)..(176): n is a, c, g, or t
tcagctcgcgtgtccacgaccggtgctcgatttagtctagcgactttgggtttgggggaagaggaagactgacggtcccccaggagttcaggtgctgggcacagcggccctgggctgcctggtcaaggactacttccgacacgcgagctgagcgggctggcaaggcgcatagnnnn

SEQ ID NO: 257383 - DNA, 593 bp, Homo sapiens
  misc_feature: GYAE6OF01A15RY.8.26.C04.1.454.CMB.1.raw
  modified_base (403)..(403): a, c, t, g, unknown or other
  misc_feature (403)..(403): n is a, c, g, or t
  modified_base (421)..(421): a, c, t, g, unknown or other
  misc_feature (421)..(421): n is a, c, g, or t
  modified_base (482)..(482): a, c, t, g, unknown or other
  misc_feature (482)..(482): n is a, c, g, or t
  modified_base (536)..(536): a, c, t, g, unknown or other
  misc_feature (536)..(536): n is a, c, g, or t
  modified_base (553)..(553): a, c, t, g, unknown or other
  misc_feature (553)..(553): n is a, c, g, or t
  modified_base (576)..(576): a, c, t, g, unknown or other
  misc_feature (576)..(576): n is a, c, g, or t
tcagctcgcgtgtccacgaccggtgctcgatttagtctagcgactttgggtttggggagctctgagagaggagcccagccctgggattttcaggtgctttcatttggtgatcaggactgaacagagagaactcaccatggagtttgggctgagctggctatttcttgtggcttattttaaaaggtgtccagtgtgaggtgcagttgttggagtcgtgggggaggttggtacagccgtgggggtccctgagactctcctgtgcagcctctggtattcacctctggcagtctttgtcagtgagcgtcgggtcccgcgacggctccgaggggaacggggcgtgggaggtgggtctcatcgtagtggagttgggtagtggtcgtcacacacacgtacgcagactcgnggaacggccgttacaccntctaccgagacgactaattaccgaagaacgtcggtgtaactcagaactaaacgtgaaaccnggtccctaggaacgacggtaccggaggaaccgacgggtacctagttacgttagngtagtaacgtaaagttnttttcggtacggagttacccttnttaagtttagttaacgg

SEQ ID NO: 257384 - DNA, 560 bp, Homo sapiens
  misc_feature: GYAE6OF01CIIW7.8.26.C04.1.454.CMB.1.raw
  modified_base (188)..(188): a, c, t, g, unknown or other
  misc_feature (188)..(188): n is a, c, g, or t
  modified_base (233)..(233): a, c, t, g, unknown or other
  misc_feature (233)..(233): n is a, c, g, or t
  modified_base (271)..(271): a, c, t, g, unknown or other
  misc_feature (271)..(271): n is a, c, g, or t
  modified_base (303)..(303): a, c, t, g, unknown or other
  misc_feature (303)..(303): n is a, c, g, or t
  modified_base (314)..(314): a, c, t, g, unknown or other
  misc_feature (314)..(314): n is a, c, g, or t
  modified_base (342)..(342): a, c, t, g, unknown or other
  misc_feature (342)..(342): n is a, c, g, or t
  modified_base (344)..(344): a, c, t, g, unknown or other
  misc_feature (344)..(344): n is a, c, g, or t
  modified_base (346)..(347): a, c, t, g, unknown or other
  misc_feature (346)..(347): n is a, c, g, or t
  modified_base (367)..(367): a, c, t, g, unknown or other
  misc_feature (367)..(367): n is a, c, g, or t
  modified_base (404)..(404): a, c, t, g, unknown or other
  misc_feature (404)..(404): n is a, c, g, or t
  modified_base (411)..(411): a, c, t, g, unknown or other
  misc_feature (411)..(411): n is a, c, g, or t
  modified_base (441)..(441): a, c, t, g, unknown or other
  misc_feature (441)..(441): n is a, c, g, or t
  modified_base (458)..(458): a, c, t, g, unknown or other
  misc_feature (458)..(458): n is a, c, g, or t
  modified_base (465)..(465): a, c, t, g, unknown or other
  misc_feature (465)..(465): n is a, c, g, or t
  modified_base (536)..(536): a, c, t, g, unknown or other
  misc_feature (536)..(536): n is a, c, g, or t
tcagctcgcgtgtccacgaccggtgctcgatttagtctagcgactttgggtttggggagctctgagagaggagcccagccctgggattttcaggtgctttcatttggtgatcaggactgaacagagagaactcaccatggagtttgggctgagcggtgcgtattacgtgtgacttaagtttaaaggtntcagtgtgaggtgcagttgttggagtcgtgggggaggttggtacngccgtggggggtccctgagactctcctgtgcagcctcnggattccactctggccaggtctttgctatggngcgtgggtccncaggcctccgagggaggctggagtggtncntnntgagtgtagtgtgtcacacncactacgcagcctcggtagacgggtcccgtcaactcncctcganacgtaactacgtaccgaacgtaacacggtntacacgtacgaactaancgtaacncggtcctagaccgtacgcggtaagccacggtacctagttactccgtgaagcgtaaagttgtttggtaccgngtaccttcttaagttcgttaacgg

SEQ ID NO: 257385 - DNA, 626 bp, Homo sapiens
  misc_feature: GYAE6OF01BFMPB.8.26.C04.1.454.CMB.1.raw
  modified_base (314)..(314): a, c, t, g, unknown or other
  misc_feature (314)..(314): n is a, c, g, or t
tcagctcgcgtgtccacgaccggtgctcgatttagtctagcgactttgggtttggggagctctgagagaggagcccagccctgggattttcaggtgctttcatttggtgatcaggactgaacagagagaactcaccatggagtttgggctgagcgtgcgtattacgttgtggactagtttaaaaggtgtccagtgtgaggtgcagttgttggagtctgggggaggttggtacagccgtggggggtccctgagactctcctgtgcagcctctggattcacctcgtggcagtctttgtcatggagcgtgggtcccncgaggctccgagggaaggggctggagtgggtctcgatctagtggagtgggtagtgggtggtacacacacacgtacgcagacctccgtaggaacgggtcccgttcaaccgtattccaccgaagacgaacctaacttacccgaaaggtaaccgtacggttgttaactccgtaggtaacctaaaagtcggaaaccacgtccgtagaacggtacgaccggaacgggacaccgggtacttaagtattccgtgacggtacgtaaaagttgtttttacgggtacggaaggttaccccttatttaagttagttaaaccgg

SEQ ID NO: 257386 - DNA, 771 bp, Homo sapiens
  misc_feature: GYAE6OF01B43SU.8.26.C04.1.454.CMB.1.raw
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
  modified_base (298)..(298): a, c, t, g, unknown or other
  misc_feature (298)..(298): n is a, c, g, or t
tcagctcgcgtgtccacgaccggtgctcgatttagtctagcgactttgggtttggggagctctgagagaggagcccagccctgggtattttcaggtgtctttctatttggtgatcaggactgaacagagagaactcacagtggtagtttgggctggagcgtggtcttatttcgttggtgtattaaagtttaaaggtgtccaggttgtggnggtgtcgtggttggtggnggttcgggtagggggtagggttggtacgcggtccgggttcggggggtcctggacgtccttcgtcgtggtnaccgtcgtcccttcgtacggtcttccaccgtcgtggcctgttcgtttgagtagcgtcggtcgtcggtccgccgacggtccgacgggaggggtacgggtcggtgggtagggttcggtcctaacgtcgttacggtaggtagggtagggttagggtaagggttcggtaccggtacaaccgaaccggtaacaccggtaaccgacggtaacggttaaccggtccggggttaaggggaccccggttacgttccccaaacttccgtaccccgtaacgaacggtaaacttaaccggtaaacccgttaaacgaaacccggtaagttaacgtcgtacgttacgaaaccgtagtaacgaacgtacggacgtacgaccggagacccgggaagaacggtacggttccgtaattacggtacgttacggaggttaacgtagttaacgtttggtaccgtgggtaactccgttatttagtacgttacggg

SEQ ID NO: 257387 - DNA, 180 bp, Homo sapiens
  misc_feature: GYAE6OF01ATN44.8.26.C04.1.454.CMB.1.raw
  modified_base (173)..(180): a, c, t, g, unknown or other
  misc_feature (173)..(180): n is a, c, g, or t
tcagctcgcgtgtccacgaccggtgctcgatttagtctagcgactttgggtttgggggaagaggaagactgacggtcccccaggagttcaggtgctgggcacagcggccctgggctgcctggtcaaggactacttccgacacgcgagctgagcgggctggcaaggcgcatagnnnnnnnn

SEQ ID NO: 257388 - DNA, 699 bp, Homo sapiens
  misc_feature: GYAE6OF01AIIKM.8.26.C04.1.454.CMB.1.raw
  modified_base (214)..(214): a, c, t, g, unknown or other
  misc_feature (214)..(214): n is a, c, g, or t
  modified_base (269)..(269): a, c, t, g, unknown or other
  misc_feature (269)..(269): n is a, c, g, or t
  modified_base (316)..(316): a, c, t, g, unknown or other
  misc_feature (316)..(316): n is a, c, g, or t
  modified_base (323)..(323): a, c, t, g, unknown or other
  misc_feature (323)..(323): n is a, c, g, or t
  modified_base (338)..(338): a, c, t, g, unknown or other
  misc_feature (338)..(338): n is a, c, g, or t
  modified_base (363)..(363): a, c, t, g, unknown or other
  misc_feature (363)..(363): n is a, c, g, or t
  modified_base (371)..(371): a, c, t, g, unknown or other
  misc_feature (371)..(371): n is a, c, g, or t
  modified_base (393)..(393): a, c, t, g, unknown or other
  misc_feature (393)..(393): n is a, c, g, or t
  modified_base (400)..(400): a, c, t, g, unknown or other
  misc_feature (400)..(400): n is a, c, g, or t
  modified_base (402)..(402): a, c, t, g, unknown or other
  misc_feature (402)..(402): n is a, c, g, or t
  modified_base (410)..(410): a, c, t, g, unknown or other
  misc_feature (410)..(410): n is a, c, g, or t
tcagctcgcgtgtccacgaccggtgctcgatttagtctagcgactttggggtttggggagctctgagagaggagcccagccctgggtattttcaggttgtctttctattttggtgatcgaaggactagaacagagacgaactcactgtggtaggtttggcgtggacggcggtgtacgtacgttacgtgtacgttattaagttagtcgctgtggngtgtcgtgtggttggtggtggtgggtagggtcgtagtacgcggtcggtcggactntcgtctacgtcgtgactctcgtagtctcgtctacctcgtgctacttnggtcagntcgccggtcgaccgngcgtacggcgggtagcgtggtcggntcgcgtancgtgtacgtggcgtgtcgagtnaacctancngtaaccgngtaccggtgaccggtcgtaccgtacgtactacgtactacgacgtaacgaacgtacgaaccttaacgtaacgtacgtaacggtaacctacgtacgtaaccgtacgtaacgtacgaccggtaacgacggtaaccggacggttaacggaaccgtaaccggtaaccggttacgtaaccggttaaccgttaacgttaccgttaacgggttaccgttacggtttaaggttaccgttaaccggtttaaggttaaccgttacgtttaacgttaggtaccgtttcggtacggtacggg

SEQ ID NO: 257389 - DNA, 790 bp, Homo sapiens
  misc_feature: GYAE6OF01CG3TT.8.26.C04.1.454.CMB.1.raw
  modified_base (413)..(413): a, c, t, g, unknown or other
  misc_feature (413)..(413): n is a, c, g, or t
tcagctcgcgtgtccacgaccggtgctcgatttagtctagcgactttgggtttggggagctctgagagaggagcccagccctgggattttcaggtgctttcatttggtgatcaggactgaacagagagaactcaccatggagtttgggctgagctggcttattttcttgtggtcttaagttttaaaaggtgtccagttgtgaggtgctagttggttggagtcgtgggggtagggttggtacacggccggttcggggggtccctggacgtacgttcctccgtagtcgacgacggtcccttcgtggtactttaccacccgtcgtcggcctagtccgttttgtcctaagtgacggtccggttcggggttcccgaccgtacggccgtacccgggaagggggaacggggtcgtagggnggtcgggtctcgattcgtagtggtaggttgggtaggtggtggtacaacgtacacctacgtaccgacgtacgtaccgttaccgggtagggtaacggggtccccgttaccgtaaccgtacgttacccgtaccgaacggaaacgtaccttaaaccgttacccgaaaacgtacccgtagggttacgttacgtagtaccgtaacgtaaacctacggaacaccggtacggaaggtaccgaccggacgggaaccgtacggtacccggttacgttacttaacggttcgtaacggttacgtaaacggtttaacggtttacggttttttacgggaccgggtttaaacccttactttaacgtttaaccgtttaaggtttaaacccggg

SEQ ID NO: 257390 - DNA, 206 bp, Homo sapiens
  misc_feature: GYAE6OF02GTJZW.8.26.C04.1.454.CMB.1.raw
  modified_base (177)..(206): a, c, t, g, unknown or other
  misc_feature (177)..(206): n is a, c, g, or t
tcagctcgcgtgtccacgaccggtgctcgatttagtctagcgactttgggtttgggggtaaggaggaagactgacggtcccccaggagttcagggtgctgggcacagcggccctgggctgcctggtcaaggactacttccgacacgcgagctggagcgggctggcaaggcgcatagnnnnnnnnnnnnnnnnnnnnnnnnnnnnnn

SEQ ID NO: 257391 - DNA, 171 bp, Homo sapiens
  misc_feature: GYAE6OF02JGYTS.8.26.C04.1.454.CMB.1.raw
  modified_base (171)..(171): a, c, t, g, unknown or other
  misc_feature (171)..(171): n is a, c, g, or t
tcagctcgcgtgtccacgaccggtgctcgatttagtctagcgactttgggtttggggaagaggaagactgacggtccccaggagttcaggtgctgggcacagcggccctgggctgcctggtcaaggactacttccgacacgcgagctgagcgggctggcaaggcgcatagn

SEQ ID NO: 257392 - DNA, 173 bp, Homo sapiens; identical to SEQ ID NO: 257379
  misc_feature: GYAE6OF02HC1HW.8.26.C04.1.454.CMB.1.raw
  modified_base (173)..(173): a, c, t, g, unknown or other
  misc_feature (173)..(173): n is a, c, g, or t

SEQ ID NO: 257393 - DNA, 174 bp, Homo sapiens
  misc_feature: GYAE6OF02GD8M8.8.26.C04.1.454.CMB.1.raw
  modified_base (173)..(174): a, c, t, g, unknown or other
  misc_feature (173)..(174): n is a, c, g, or t
tcagctcgcgtgtccacgaccggtgctcgatttagtctagcgactttgggtttgggggaagaggaagactgacggtcccccaggagttcaggtgctgggcacagcggccctgggctgcctggtcaaggactacttccgacacgcgagctgagcgggctggcaaggcgcatagnn

SEQ ID NO: 257394 - DNA, 172 bp, Homo sapiens
  misc_feature: GYAE6OF02GN0GH.8.26.C04.1.454.CMB.1.raw
  modified_base (172)..(172): a, c, t, g, unknown or other
  misc_feature (172)..(172): n is a, c, g, or t
tcagctcgcgtgtccacgaccggtgctcgatttagtctagcgactttgggtttgggggaagaggaagactgacggtcccccaggagttcaggtgctgggcacagcggccctgggctgcctggtcaaggactactccgacacgcgagctgagcgggctggcaaggcgcatagn

SEQ ID NO: 257395 - DNA, 542 bp, Homo sapiens
  misc_feature: GYAE6OF02GJ7MS.8.26.C04.1.454.CMB.1.raw
  modified_base (286)..(286): a, c, t, g, unknown or other
  misc_feature (286)..(286): n is a, c, g, or t
  modified_base (405)..(405): a, c, t, g, unknown or other
  misc_feature (405)..(405): n is a, c, g, or t
tcagctcgcgtgtccacgaccggtgctcgatttagtctagcgactttgggtttggggagctctgagagaggagcccagccctgggattttcaggtgctttcatttggtgatcaggactgaacagagagaactcaccatggagtttgggctgagcgtggctatttcttgtggctattttaaaggtgtccagtgtgaggtgcagttgttggagtctgggggagggttgggtacagccgtggggggtccctgagactctcctgtgcagcctctggattcacctctggcngctttgtcatgagctgggtccgccaggctccgaggggaagggctgggagtgggtggcagttgtttcatcgtgagggcaggtgttcaatggtatgctgacgcgtgagggccatcacatcncagacgacactcaggaacacaatgtattggactgaacagacctaagtccagaggacgacgggtgtatacgtacgtggtaacggaagggacgggggaacgaggacggtacggttaccaaggtactccgttgtaaccgg

SEQ ID NO: 257396 - DNA, 744 bp, Homo sapiens
  misc_feature: GYAE6OF02JJBQP.8.26.C04.1.454.CMB.1.raw
tcagctcgcgtgtccacgaccggtgctcgatttagtctagcgactttgggtttggggagctctgagagaggagcccagccctgggattttcaggtgctttcatttggtgatcaggactgaacagagagaactcaccatggagtttgggctgagctggctatttcttgtggctattttaaaaggtgtccagtgtgaggtgcagttgttggagtcgtgggggagggttggtacagccgtgggggtccctggagactctcctgtgcagcctctggattccacctctggcagtctttgtcagtgacgcgtgggtccccgccgagggcctaccgaggggaacgggctagggacggtcgggtctcgagtcgtagtaggagttgggtaggttgggtcggtacacgaccactaaccgtacgcgacgaccgtcggtagggaacgggcccgtttcgaaccctactccctaccgaacgtaacgacctaaacgttacccgaaaggtaaccgacgggttacgtaacgttccgtacgaaccgtaaaagttacgaaaacgtaccggacccgttaagggaaccggaacgggtaccccgggaaaggggaacccgtaacccggggtaccgttaaaccgttaacgtttaaccggttagggttacggtaaacccggtttaaaaggtttaccggtttttttacggggtttacccgggtaaccggttaacccgtttcgttttaaccgtttaacggtttaacccggg

SEQ ID NO: 257397 - DNA, 559 bp, Homo sapiens
  misc_feature: GYAE6OF02GTYQ3.8.26.C04.1.454.CMB.1.raw
  modified_base (307)..(307): a, c, t, g, unknown or other
  misc_feature (307)..(307): n is a, c, g, or t
  modified_base (416)..(416): a, c, t, g, unknown or other
  misc_feature (416)..(416): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
  modified_base (452)..(452): a, c, t, g, unknown or other
  misc_feature (452)..(452): n is a, c, g, or t
  modified_base (543)..(543): a, c, t, g, unknown or other
  misc_feature (543)..(543): n is a, c, g, or t
tcagctcgcgtgtccacgaccggtgctcgatttagtctagcgactttgggtttggggagctctgagagaggagcccagccctgggattttcaggtgctttcatttggtgatcaggactgaacagagagaactcaccatggagtttgggctgagctggctatttcttgtggctattttaaaaggtgtccagtgtgaggtgcagttgttggagtcgtgggggagggttggtacagccgtggggggtccctgagactctcctgtgcagcctctggattcacctctggcagctttgcatgagctgggtccnccgaggctccgagggagggctgggagtgggtctcatctatgagtggtagtggtggtcacacacactacgcacgacctcgtggaacgggtccgttacaccatctccaganactatccaagacacggtntatcngacaaatcgaacngccgtagacgaacggccgaaggaccgacgggaccttaagtacgttacgtggttagaacgtaaagttagttttacggtacggacgtaccttnttattacgttaaccgg

SEQ ID NO: 257398 - DNA, 769 bp, Homo sapiens
  misc_feature: GYAE6OF02GTGZN.8.26.C04.1.454.CMB.1.raw
  modified_base (317)..(317): a, c, t, g, unknown or other
  misc_feature (317)..(317): n is a, c, g, or t
  modified_base (353)..(353): a, c, t, g, unknown or other
  misc_feature (353)..(353): n is a, c, g, or t
tcagctcgcgtgtccacgaccggtgctcgatttagtctagcgactttgggtttggggaggcgtctgagagaggagcccagccctgggattttcaggtgcgtttcatttggtgatcaggactgaacagagagaactcaccatggagtttgggctgagtctggctatttcttgtaggtctattttaaaaggtgtccagtgtgaggtgcagttgttggagtcgtgggggaggttgtacagccggtgggggtccctgagactctcctgtgcacgcctgtggattcacctctggcagtcttagtcatggacgcgtgggtccnccgaggcgtccgaggggaaggcgtggagtggtctanatctagtggtagtggtagtggtggtcacgtacactacgtacgacgtacgtaccgtccggtaggaacgggtcccgtttaaccgacctacgtttcccaacccggaaggtaaccgtaacccttaaacgttacccgaaaacgtaacccggtaacgggttataaccgttcctaacggaaacttaaaacggttcgaaaacccgttacgggtaccccgttaagggaaaacgggtaccggaacccccggggttaaaggaacccggtaacccgggtttacccgttaaatttaacccgggttttccgtaacgggtttaacggaaaccggtttaaagggtttttacggttttttaccgggtttaaccggggaaccgtttaaccccttttaacgggttttaactttaaaccggggttttaaaccccgg

SEQ ID NO: 257399 - DNA, 799 bp, Homo sapiens
  misc_feature: GYAE6OF02HSBTN.8.26.C04.1.454.CMB.1.raw
  modified_base (339)..(339): a, c, t, g, unknown or other
  misc_feature (339)..(339): n is a, c, g, or t
  modified_base (611)..(611): a, c, t, g, unknown or other
  misc_feature (611)..(611): n is a, c, g, or t
tcagctcgcgtgtccacgaccggtgctcgatttagtctagcgactttgggtttgggagctctgagagaggagcccagccctgggatttttcaggtgctttcatttggtgatcgaggactgaacagagagaactcaccagtggtagtttgggctgagcgtggctatttcgttgtgcttaagttttaaaggtgtccagtgtgaggtgcgtagttgtggagttcggtgggggagggttggtacgacggtccggttcggggggtccctggaacgccttccgtccgtgtacgcgacgcctacgtggtacttccgaccgtcgtacggctaggttctttgtactanggacgtgtcgggtccgaccgtacggctaaccggaggggaacgggtcggtagggacggttcggttacgtcgtactagtaagtcggaaggtttgggtacgttagggttcggactaacgtacacgaaccgttacgaccgtaaccggtaccgttaccgggttaacgggtaaaccgggtcccggtttaaaccgtaccccgtaacgttaccaccggttaaacgcgtaacgtaaaacctccggaaaagtaaccgtacgggtttaaagttaccgttaccncggttaaactaaacgtaccggaaacgtacctacggtacggtaacgtaaccggggccgaaaacggggtaccaaccggggtttccttaagtttaacgggtcttacggtacggttaaggttaaacgttttcgggtttaacggtttacggttaccggttaaccgtttaacgtttaacgtttcccgttaacgg

SEQ ID NO: 257400 - DNA, 553 bp, Homo sapiens
  misc_feature: GYAE6OF02F2CDV.8.26.C04.1.454.CMB.1.raw
  modified_base (341)..(341): a, c, t, g, unknown or other
  misc_feature (341)..(341): n is a, c, g, or t
  modified_base (399)..(399): a, c, t, g, unknown or other
  misc_feature (399)..(399): n is a, c, g, or t
  modified_base (407)..(407): a, c, t, g, unknown or other
  misc_feature (407)..(407): n is a, c, g, or t
  modified_base (434)..(434): a, c, t, g, unknown or other
  misc_feature (434)..(434): n is a, c, g, or t
  modified_base (501)..(501): a, c, t, g, unknown or other
  misc_feature (501)..(501): n is a, c, g, or t
tcagctcgcgtgtccacgaccggtgctcgatttagtctagcgactttgggtttggggagctctgagagaggagcccagccctggggattttcaggtgctttcatttggtgatcaggactgaacagagagaactcaccatggagtttgggctgagccgtggctatttcttgtggctatttaaaaggtgtccagtgtgaggtgcagttgttgagtctgggggaggttggtacaggcctggggggtccctgagactctcctagtgcagcctctggacttccgactctggcagctttgcatgagctggtcgcaggctccgaggaggctggagtggactcatctangtagtgtagtggtggtcacacacactacggacaagcctacgtggaacgggcccgttanaccattcnccgagacgactattccaaagcacggtntactctgactaaatgaacagtacctgaagaccgtcggaagaccacggacccgttataacggtttagngttcgaaccgtaaagtgttttacgtcggaagaccctttagtatttacgtaac

SEQ ID NO: 257401 - DNA, 497 bp, Homo sapiens
  misc_feature: GYAE6OF01C0HAV.51.35.D02.1.454.CMB.1.raw
  modified_base (313)..(313): a, c, t, g, unknown or other
  misc_feature (313)..(313): n is a, c, g, or t
  modified_base (487)..(487): a, c, t, g, unknown or other
  misc_feature (487)..(487): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctnagggatccctgagcgattctctggctccaggtcagggacaacggtcacattggccatcagtggagtccaggcagaggacgaggctgactattatgtcaatcaacagacaccattggtacttatgtcttcggaactgcgaccaggtcaccgtctgggtcagcccagcccaacccntcgctctccg

SEQ ID NO: 257402 - DNA, 499 bp, Homo sapiens
  misc_feature: GYAE6OF01E2QR6.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcagcccaaggcccaacccatcgtcactc

SEQ ID NO: 257403 - DNA, 522 bp, Homo sapiens
  misc_feature: GYAE6OF01B2RE1.51.35.D02.1.454.CMB.1.raw
  modified_base (312)..(312): a, c, t, g, unknown or other
  misc_feature (312)..(312): n is a, c, g, or t
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctnagggatccctgagcgattctctggctcaggtcagggacaacggtcacattggccatcagtggagtccaggcagaggacgaggctgacttattattgtacaatcaacagacacctagttggtaacttattcgtacttcggaactgaccgacgaaggtccaccggttcctgggtccacgaccccaaggccccaaccccatcgtcaccttccg

SEQ ID NO: 257404 - DNA, 522 bp, Homo sapiens
  misc_feature: GYAE6OF01ATGVJ.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcgagggatccctgagcgattctctggctccgaggtcagggacaacggtcacattggccatcagtggagtccaggcagaggacgaggctgactattattgtacaatcaacagacaccattggtacttatgtctcggaactggacgaccgaaggtccaccgttccgtgggtccacgccccgaaggccccaaaccccatcgtcctacgttcccg

SEQ ID NO: 257405 - DNA, 576 bp, Homo sapiens
  misc_feature: GYAE6OF01BZYGJ.51.35.D02.1.454.CMB.1.raw
  modified_base (221)..(221): a, c, t, g, unknown or other
  misc_feature (221)..(221): n is a, c, g, or t
  modified_base (312)..(312): a, c, t, g, unknown or other
  misc_feature (312)..(312): n is a, c, g, or t
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgganatgcattgccaaaccgatatgcttattggtaccagcagaagccggccaggcccctgtgttggtgatgtaataaagacactgagaggccctnagggactccctgagcgattctcgtggctccgaggtcgagggacaacggtcacattggccatcagtggagtcaggcaggaggacgaggctaggacttattagttgtacaatcaaacagaacactagttaggtaactttagtcgttacgttacggaacttcggaccgaaccgtaaagggttcccgaccggttcccgtacggggttcccacggtacccccgaaacggtcccccgaaaccccctacgtcgttaccaaccgtttacccg

SEQ ID NO: 257406 - DNA, 502 bp, Homo sapiens
  misc_feature: GYAE6OF01BP82S.51.35.D02.1.454.CMB.1.raw
  modified_base (497)..(497): a, c, t, g, unknown or other
  misc_feature (497)..(497): n is a, c, g, or t
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccgaggtcagggacaacggtcacattggccatcagtggagtccaggcagaggacgagctgactattattgtcaatcaacagacacctattggtacttatcgtcttcggaactgacgaccaaggtcaccgtcctgggcacgcccaaggcccaacccntcgtc

SEQ ID NO: 257407 - DNA, 539 bp, Homo sapiens
  misc_feature: GYAE6OF01DVBMH.51.35.D02.1.454.CMB.1.raw
  modified_base (312)..(312): a, c, t, g, unknown or other
  misc_feature (312)..(312): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtacagcagaagccgggccaggcccctgtgttggtgatgtataaagacactgagaggccctnagggatccctgagcgattctctggctccaggtcagggacaacggtcacattggccatcagtgagtccgaggcagaggacgaggctagactattatgtacaatcaacagaacacctattggtacttatgttcgttcggaacttgacgaaccgaaggtcctaacccggtccgttcggggtcaaccgccccgaaacggccccaaaccccctattccgtcctacgttcccg

SEQ ID NO: 257408 - DNA, 606 bp, Homo sapiens
  misc_feature: GYAE6OF01CAJ53.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtataagacactgagagccctgagggactcccgtgagcgtacttctcgtggctccgaggtcgagggacaacggtcactagttcggccatcgagtggacgtccgaggcaaggaggacgaggctgtaactattattagtactaagtacaaacgtagaacctacctagtttacggtactttaagttcgttacgtttacggaacttcggtaccgtaaccgtaaagggtcccgtaacccggttcccttacggggttccaaccgggacccctaaacgggacccccaaacccccgtacgttcgttacccgaccctttccccgg

SEQ ID NO: 257409 - DNA, 500 bp, Homo sapiens
  misc_feature: GYAE6OF01D1GAW.51.35.D02.1.454.CMB.1.raw
  modified_base (314)..(314): a, c, t, g, unknown or other
  misc_feature (314)..(314): n is a, c, g, or t
  modified_base (471)..(471): a, c, t, g, unknown or other
  misc_feature (471)..(471): n is a, c, g, or t
  modified_base (495)..(495): a, c, t, g, unknown or other
  misc_feature (495)..(495): n is a, c, g, or t
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgtggtgatgtataaagacactgagaggccctnagggactccctgagcgattctctggctccaggtcagggacaacggtcacattggccatcagtggagtccaggcagaggacgaggctgactattattgtcaatcaacagacacctattggtacttatgtcttcggaactgcgaccgaggtcaccgtcnggtcacgcccaaggcccaaccccntgtcc

SEQ ID NO: 257410 - DNA, 523 bp, Homo sapiens
  misc_feature: GYAE6OF01A4077.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacacgtgagaggccctgagggactcccgtgagcgattctcgtggctcaggtcgagggacaacggtcacagttggcatcagtggacgtcgaggcagaggacgaggctgactattagttgtacaatcaacagaactacattgtacttatgtcttacggaactgaccgaccgtaagtccgaccgtcgtgggtacacgacccgaaggccccaacccatctcgtcttcccg

SEQ ID NO: 257411 - DNA, 586 bp, Homo sapiens
  misc_feature: GYAE6OF01BXGTX.51.35.D02.1.454.CMB.1.raw
  modified_base (239)..(239): a, c, t, g, unknown or other
  misc_feature (239)..(239): n is a, c, g, or t
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagcccaccctcggtgtcagtgtccccaggacagacggccaggatcacctgctctggagatgcattgccaaaccgntatgcttattggtacagcagaagccggcaggcccctgtgttggtgatgtataaagcacgtgagacggccctgagggactcccgtgacgcgtattctcgtcggctaccgaggtcgagggacaacggtcacgtagttcggactagttcgagtgggacgtccgaggcaggaggacgaggctagacttatttatgtacaatcaacagtaaccgacctagttacggttaaccttagttcgttaccgttacggtaaacgtcgaccgaaaccgtaagggttaccctacccgttcgtacgggtccgaccgaccccgaacggtaccccaaccccgtacgtcgaccgtcttaccccg

SEQ ID NO: 257412 - DNA, 535 bp, Homo sapiens
  misc_feature: GYAE6OF01C2WZ9.51.35.D02.1.454.CMB.1.raw
  modified_base (524)..(524): a, c, t, g, unknown or other
  misc_feature (524)..(524): n is a, c, g, or t
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtacagcagagccggcacggcccctgtgttggtgatgtaataagacactgagacgccctcgagggactcccgtgacgcgtatctcgtgctcgaggtcacgggacaacggtcacgagttcggacctatcgaggtggacgtccgaaggcaggaggacgaggctagactacttattgtacatacaacagacactagttgtacttatcgtcttcgaactgacgaccgtaaggtccaccggtctgggtaccacggtacccgaacggacccaaccccngtccgtacccg

SEQ ID NO: 257413 - DNA, 573 bp, Homo sapiens
  misc_feature: GYAE6OF01ARD2Z.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaaccgatatgtcttattcggtaccagcagaagccggcacggccctgtgttggtgatgtaataagacactggagacggccctgacgggactcccgtgagcgtattcgtcgtcggctccgaggtcgagggacaacggtcaactagttcggccatcgaggtggacgtccgagggcgaaggacgggaacgaggctagacttattattgacaatcaacacgaacacctagttaggtaacttatgttacttacggaacttggaccgtaaaccgaaggtccgccggttcgtacgggtccaaccggtacccgaaccggaccccaaccctactcgtccctccttccg

SEQ ID NO: 257414 - DNA, 801 bp, Homo sapiens
  misc_feature: GYAE6OF01CIYXS.51.35.D02.1.454.CMB.1.raw
tcagcgatcgtatacacgaccggtgctcgatttagcacacgatagttgggtttggggctgtgggtccaggaggcagaactctgggtgtctcaccatggcctggatccctctacttctccccctcctcactctcctgcacaggctctgaggcctctatgagctgacacagcccaccctcggtgtcagtcgtccccaggacagacggccaggatcgacctgctctggagatcgcaattcgaccaaaaccgatatgcttattggtaccagcagaagcggcagccctgtgtggtgactgataaagacacgtgaggaaggtccctcgaggggactccccgtagaaggaccgtaattccgtcgtacggacctacccgagggtaccgaacggggaacctaaacgggtacgaaccgtaagtttacgggaccctaacgtaccgtaacgggttacgggaaccggttacccggaaacgggacggaacgggaaaacgggggtaaccggaacgggtccccgtttaaggtaaaccggtttaatttaacgtttaggtaaccttaaaacgttacccaaaaccggtaacgaacccgtaaaccccgtaaggttttaacggggtttaacctttaaacgttcgggttaaccgtttttacccggggaaacgtttaccgggaacccggtaaaccccggtaaacggggttccccgtaaaccccgggttcccgttaccggggggttacccgaaacggtacccccccggtaaaacgggtacccccccggtaaaacccccccttaggttacccggtttaacccccgg

SEQ ID NO: 257415 - DNA, 710 bp, Homo sapiens
  misc_feature: GYAE6OF01DGXZ6.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgcattcgaccaaaaccgatatcgtctttagttcggtaccagacaaggaacggccgggaccacggccccttggttgttggtgatagtaataaacgacacgtagaggtacgccctgacgggactcccgtagacggcgtacttctcgtacggtcctaccgacggtacgaacgggggaacctaacggggttaccaacgtacgtttaccgggacctaacgtcggtaacggtgggaacggtcccggaagggacgaacgggaacgggtaacgggagggtacctaggtaaccttaagtttaacgttcggtaacaaactaaccaaacgaacgaacctaaccgttagttaggtttaacctttagttacggttaccgttaacgggtaacctcggaccgtaaccgtaacggtacccgtaccccgttaggtccgggtaccacccggtaaccccgaaacggtacccccaacccctagtaccgtcctaacccgttcccg

SEQ ID NO: 257416 - DNA, 595 bp, Homo sapiens
  misc_feature: GYAE6OF01D14W8.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagcactgagaggccctgagggatcccgtgagcgattctcgtggctccgaggtcgaacgggacaacgggtcacgtagttcggcctagtcgaagtggacgtccgaggcaaggaggacgagggctagactttattattgactaatacaacgagaacaacctagtttacggtactttaagttcgtcttacggaacttcggaccggtaaacctaagggttccgtacccggttccgtacggggtccaaccggtacccccaaacgggtaccccaaaccccccgtgtaccgtcccgtaccttcccgg

SEQ ID NO: 257417 - DNA, 583 bp, Homo sapiens
  misc_feature: GYAE6OF01B1NYF.51.35.D02.1.454.CMB.1.raw
  modified_base (240)..(240): a, c, t, g, unknown or other
  misc_feature (240)..(240): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccggccacggcccctgtgttggtgatgtataaagacactggagacggccctcgagggactcccgtgagcgattctcgtggctccgaggtcgagggacaacggtcactatggccatcgaggtggacgtccgaggcgagacgggacgaggcgtagaactttattagttgtacaatacaacacgaaccactagttacggttactttaagttcgttcttacgggaactcggaccgaccgtaacggtccgaccggttcccgtgggtcccaacggaccccgaacggtaccccaaacccccgacgttaccgtccctaccttccccg

SEQ ID NO: 257418 - DNA, 603 bp, Homo sapiens
  misc_feature: GYAE6OF01A7EDB.51.35.D02.1.454.CMB.1.raw
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgaccaaaaccgatatgcttattggtaccagcagaagccggcaggcccctgtgttggtgatgtataaagacactgagacggccctcgagggactccctggagcgattctcgtggcctccgaggtcgaagggacaacggtcactagtcggaccatcgagtggacgtccgaggacaggaacggacggaggcctagacgttattagttgtacaatacaacacgaacacctagttacggttaacttgtacgttacgttaccgggtaactacggaccgtaaccgtaaacgggttacccacccgggttcccggttacggggtaccaacccgggacccccgaaacgggacccccaaaccccgtacgttccggtaaccc

SEQ ID NO: 257419 - DNA, 516 bp, Homo sapiens
  misc_feature: GYAE6OF01EVMED.51.35.D02.1.454.CMB.1.raw
  modified_base (313)..(313): a, c, t, g, unknown or other
  misc_feature (313)..(313): n is a, c, g, or t
  modified_base (421)..(421): a, c, t, g, unknown or other
  misc_feature (421)..(421): n is a, c, g, or t
  modified_base (508)..(508): a, c, t, g, unknown or other
  misc_feature (508)..(508): n is a, c, g, or t
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggccaggcccctgtgttggtgatgtataaagacactgagagccctnagggactcccgtgagcgacttctctggctccaggtcaagggacaacggtcacgtagttggccagtcaggtggagtccgaggcaggaggacgaggctgacttattattntacatacaactagacactagttgtattatgtcttggactgacgaccaggtcaccggtcacggtcacgtacccaacgacccaaccccngcgtaccg

SEQ ID NO: 257420 - DNA, 522 bp, Homo sapiens
  misc_feature: GYAE6OF01BTA61.51.35.D02.1.454.CMB.1.raw
  modified_base (514)..(514): a, c, t, g, unknown or other
  misc_feature (514)..(514): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgtattctcgtggctccaggtcagggacaacggtcacattggcctatcagtggacgtcaggcagaggacgaggctagactattattgtacaatcaacagacactattaggtacttagtgttcttacggaatgacgacaacggtccaccgtccgtaggccacgccccgaacggccccaacccatcgtcncgttcccg

SEQ ID NO: 257421 - DNA, 557 bp, Homo sapiens
  misc_feature: GYAE6OF01A9C6N.51.35.D02.1.454.CMB.1.raw
  modified_base (445)..(445): a, c, t, g, unknown or other
  misc_feature (445)..(445): n is a, c, g, or t
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgccaaaccgatatgcttattgtaccagcagaagccggcacggcccctgtgttggtgatgtaataaagacacgtgagacggccctcgagggactcccgtagacgcgtattctcgtggctccgaggtcgaagggaccaacgggtcaacgtattcggaccatccgaggtggacgtccgaggcaggaggacgaggctagacttattattgtacaatcaangaaccactagttggtaacttatgttacgttacggaactggacgaaccgtaaggttcccaccgttccgtgggtcaacgcccgaaaggccccaaaccccatcgtctaccgtccg

SEQ ID NO: 257422 - DNA, 659 bp, Homo sapiens
  misc_feature: GYAE6OF01C3APQ.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcactgctctggagatgcattcgaccaaaccgatatgcttattggtaccagcagaagccgggccaggcccctgtgttggtgatgtaataaagacacgtagagacggccctacgagggactccctagagcgtattctcgtcggctccgaggtcgaagggaccaacgggttcaactagttggcccatccgaaggttcgggacgtaccgagggaccaaggacgggacggaacggcttagaccttaagtttacttggtacctaaattacaaacgtagaaccaaccgttagtttacggttacttattcggtttactttaccgggtaaccgttacggaccgtaaccgtaaagggttccccgtaacccggttacccgggttaggggttacccaaccggtaccccgaaacgggtacccccaaaccccctaccgttacgtccccgtacccgtttcccccg

SEQ ID NO: 257423 - DNA, 569 bp, Homo sapiens
  misc_feature: GYAE6OF01A4MR0.51.35.D02.1.454.CMB.1.raw
  modified_base (239)..(239): a, c, t, g, unknown or other
  misc_feature (239)..(239): n is a, c, g, or t
  modified_base (431)..(431): a, c, t, g, unknown or other
  misc_feature (431)..(431): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaacgntatgcttattggtaccagcagaagccgggccaggcccctgtgttggtgatgtataaagacacgtgagaggccctgagggactcccgtgacgcgtattctctggctcgaggtcgagggacaacgggtcacgtattcggccagtcaggtggacgtccaggcagaggacgagctgactattagttgacaatcaanagacaacctagttaggtactttagtcgttacttacggaaactgaccgtaaccgaaggtccgaccggttccgtggggttaccaccggaccccgaaacgggaccccctaaacccctacgtccgtaccgtacccgttcccg

SEQ ID NO: 257424 - DNA, 580 bp, Homo sapiens
  misc_feature: GYAE6OF01CB2YA.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggccacggcccctgtgttggtgatgtataaagacactgagaggccctgagggatccctgagcgtattcgtctggctccgagggtcagggacaacggtcactattcggccatcagtggagtccgaggcagaggacgaggctgacttatattgtcaatcaacagaataacctagtttacgggtaactttagttgttacgttacggaacttcggaccgtaaccgtaaacgggtccgtaacccggttcccgttacggggtccaacggtcccccgaaacgggtcccccaaacccccgtatccgtacctaccgtttccccg

SEQ ID NO: 257425 - DNA, 592 bp, Homo sapiens
  misc_feature: GYAE6OF01EKDQ5.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctctccctcctcactctctgcacaggctctgaggcctcctatgagctgacacagcccaccctcggtgtcagtcgtcccccaggacagacggccaggatcacctgctctggagatgcattgaccaaaccgatatgtcttattcggtaccagcaagaacgccggccacggccctgtgttggtgatgtaataaagacacgtagacgacggccctagaggtactcccgtagacgcgtattcgtcgtggctaccgaggtacgaagggacaacggtcaacgtacgttcggcctaagtcgaggtcggacgtccgaggacgaggacgggaacgacggtctagtacttatttacgttgtacaatccaaacgacgaacctacctagtttacgttaactttagtcgttacgtacggaactcgaccgaaccgtaggtccaccgtcgtcggaccacgaccccgaacgaccccaacccgtctcgtcctacccg

SEQ ID NO: 257426 - DNA, 701 bp, Homo sapiens
  misc_feature: GYAE6OF01CSVG9.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgacttattggtaccagcaagaagcccggcacggcccctgtgttgtgagtagtaataagacacgtgaggacggcccgtcgagggtactccgtgacgcgtactttctctcgggtcctaccgacggtcgtaacggggaacctaacgggtcaacgtacgtttcggacctacgttccgaaggttcggacggttaccgacgggtacgaacgggacggaacgggacggactacggtaacgtttaagtttacgttcgtacgtaaacttacgaaaccgtaacgaacccgtaacctaaggttttcgtaaccgttttagtaccggtttttaccgttacggttaaaccggtcggtacccgaaaccggttaaacggttcccgacccggttaccggttacggggtaccgacccgtaacccgaaccggtaccccaaaaccccgtccgtacgttacccgaccgttttcccccgg

SEQ ID NO: 257427 - DNA, 756 bp, Homo sapiens
  misc_feature: GYAE6OF01AVEBQ.51.35.D02.1.454.CMB.1.raw
  modified_base (257)..(257): a, c, t, g, unknown or other
  misc_feature (257)..(257): n is a, c, g, or t
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagcccacccgttcggtgtcgagtcgtccccaggacaggaccggccaggtactccaccgtgctcctgggagatgctagttcgacccaaaccgtntagtgtactttagtcggtaccagtacaagaacggcccgggaccacggcccttggttgtggtgtactgtaataacgacacgtagacggcgcctacgacgggtctccgtagacgtcgttacttcgtacgtcggtaccttcggaacggttccggaacgggtaaccgtaaccgggttaccaacgttacggttccggacccgtaattcccggaggtacgggtaccgtaccggaacggtacggaacgggaacgggtaccggaacgggtccgtaacggttaactttaacgttttacgttaccgtaagtaaccttacgaaaccgttacgaaccgtaaccgttaggtttacgttaacgttttacgttacggttaccggttaccggaaacgtcggaaccgttaaaccggtaacgggtccttacccgggtcggttacggtaaccgaccccgtaacccggtaacccggtaccccaaaccccgttgtacccgttaccgtaccgtttaccccg

SEQ ID NO: 257428 - DNA, 576 bp, Homo sapiens
  misc_feature: GYAE6OF01A5U4M.51.35.D02.1.454.CMB.1.raw
  modified_base (241)..(241): a, c, t, g, unknown or other
  misc_feature (241)..(241): n is a, c, g, or t
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccggccacggcccctgtgttggtgatgtataaagacactgagacggccctcgagggactcccgtagacgcgtattctcgtggctccgaggtcaggggacaacggtcacagttcggccatcagtggacgtccgaggcaggacggacgaggctagacttattattgtacaatcaacgagactacctagtttacggtacttagtcgttacgttacggaacttcgaccgtaacccgtaaggttccgacccggttccgtacgggtacccaaccggtacccccgaacgggacccccaaaccccgtgtccgttacccg

SEQ ID NO: 257429 - DNA, 699 bp, Homo sapiens
  misc_feature: GYAE6OF01BY1NR.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtcgtcccaggacagacggccaggatcacctgctctggagatgcattcgaccaaaccgatatgcttattggtaccagcaagaaggccgggccacggcccctggtgttggtgatgtaataaagcacgtgaggacggccctgacgggtactccgtagacgcgtattcgtctcgggtctacgaggtccgaagggactaacggtcacgagttcggactagtcgaggtggacgtccgaggacgaggagggaacggaggtacgtacgaacctttaagttaacgtttacggtacctaaacgtactaaaaccgaacggtaaccctaaccgttacggtttaacggttaaccgtttagtttacggtttacccgttaacggtaaaccgtcgtaacccggtaaacccggtaaacggttaccccgtacccggtttacccgggtccgggtaacccgtaacccgggaacccccgaaaccggtaaccccccgtaaaccccgtaccgttccggtaccctaaaccggttttccccc

SEQ ID NO: 257430 - DNA, 545 bp, Homo sapiens
  misc_feature: GYAE6OF01EW40S.51.35.D02.1.454.CMB.1.raw
  modified_base (238)..(238): a, c, t, g, unknown or other
  misc_feature (238)..(238): n is a, c, g, or t
  modified_base (450)..(450): a, c, t, g, unknown or other
  misc_feature (450)..(450): n is a, c, g, or t
  modified_base (539)..(539): a, c, t, g, unknown or other
  misc_feature (539)..(539): n is a, c, g, or t
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctggtgtcagtcgtccccaggacagacggccaggatcacctgctctggagatgcattgaccaaacgntatgcttattggtaccagcagaagccggcacggcccctgtgttggtgatgtaataaagacacgtagagacggccctagagggactccctgacgcgtacttctcgtcggctaccgaggtcgaacgggacgaacggtcaacgtagttacggacctatacgaggtggacgtccaggcaggaggacgaggctagatattatagtacaatacaacanacaactagttgtaactagtgttctagacgtgaccgtacgacgtcgtccggtcgtcggtcaccgtcccgaacggcccaacccatcgtccncttccg

SEQ ID NO: 257431 - DNA, 666 bp, Homo sapiens
  misc_feature: GYAE6OF01BUESK.51.35.D02.1.454.CMB.1.raw
  modified_base (225)..(225): a, c, t, g, unknown or other
  misc_feature (225)..(225): n is a, c, g, or t
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcactgctcgtgganatgcattgaccaaaccgatatgcttattggtaccagcagaacgccggccacggcccctggtgttggtgatagtaataagacacgtgagacgccctagaggactcccgtgacgcgtattcgtgtcggctccgaggtcgacgggacaaacggtcaacgtattcgggaccagtccgaaggtcgggtacgttacccgaggacgacgggaacgggtaaccggacgggtctacggtaactttacgtttaagtttcgtaactaaagttaccgaaaacgacggtaaacccaacgttaacgtttaacggttaactttaacgttcgtttacgtaccgggtaaaccttggtacccggtaaaccgtaacggttaccctaacccggttcccgtacggggtaccaaccggtacccccgaacgggacccccaaaccccgtaacgtccgttaacccg

SEQ ID NO: 257432 - DNA, 703 bp, Homo sapiens
  misc_feature: GYAE6OF01A1DKR.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctctggagatgcattgaccaaaccgatatgcttattggtaccagcagaacgccgggccacggcccctgtgttggtgatgtaataaagacacgtgaggacggccctacgagggactcccgtagagtcgtattctcgtcggtccgggtcccaggtaccgaacgggtaaccgaaccgggtacaacgtagttcggacctagtacgaggtggacggtccgaggtacgaaggacgggaacggaggtctacggtaattattaagtttcgtaactaactaaccgaaacgtacgaacctaacgttaagtttacgggttaacttagttcgttaccgttacggtaacgtaccggtacggtaaacccgtaacgggttacccgtacccgggtttaccggtacgggtacccgaaacccggaaccccccggaaaaccgggtacccccccaaaacccccggtacccgtttaccgtaccccgtaacccgttttaccccccggg

SEQ ID NO: 257433 - DNA, 761 bp, Homo sapiens
  misc_feature: GYAE6OF01ES0JG.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgacccaaaccgatatgtctttagttcggtaccagcaggaacggccgggccacggcccctggtgttggtgatgtataaagacagtggagacggccctacgacgggactcccgtagacgcgtacttctcgtcggtctaccgagggtaccgaacggggaaccgtaaccggggtaccaacgtagttcggaccctagttaccgtagggtacgggtacgtacccgaagggaccgtaagggaacgggaacggaacgggtaccttacggtaactttaagtttacgtttacgtaccaaacttacccgaaagtaccgtaacctaaccgttaagttttccggttaaacgttttacgttacggtttaccgtttaccgggaaacttccgggaacccgttaaacccggtaaacggttccccggtaaccccgggtttccgggttacgggttaacccgaacccggtaaccccccggtaaacccgggtacccccccgtaaacccccgttacccggttaccgttacccctacccgttttaccccccgg

SEQ ID NO: 257434 - DNA, 633 bp, Homo sapiens
  misc_feature: GYAE6OF01AYJ5X.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtggagatgctattcgaccaaaaccgatatgcttattggtaccagcagaacgccggccacggccctgtgttggtgatgtaataaagacacgtgagacggccctagagggtactcccgtagacgcgtacttcgtcgtcggcctccgaggtccgaagggaacaaccggtcaacgtacgttcggaccagtcgaggtggacgtaccgagggcgaaggacggacgaggtccgtagtaacttattagttcgtacaagtacaaacgacgaactacctagtttacgttactttaagtcgttaccgtacggtaactacggacccgtacgtaaacgggtccctaacccggttccgtacggggtccaaccggtaccccgaaccggtacccccaaaccctaccgttcgtacccgttcgttaccccg

SEQ ID NO: 257435 - DNA, 713 bp, Homo sapiens
  misc_feature: GYAE6OF01AWTFG.51.35.D02.1.454.CMB.1.raw
  modified_base (299)..(299): a, c, t, g, unknown or other
  misc_feature (299)..(299): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtcccccaggacagacggccaggatcacctgctctggagatgctattcgaccaaaccgatatgtcttagttcggtaccagcagaacggcccgggccacggcccctgtgttggnatagtaataagacagtaggagacggtcctgagggactccctgatcgtacttctcgtggcctcgaggtacgaagggtacaacgcccaatcgttcggcctagtcgaggtggacgtaccgagggaccgaaggaacggacggtaggaccgtacgtaatttaacgtttgttacgtaactaacgttaaccgaaaaccaggtaacccctaaacgttacggttttaaccggttaatttaccgtttacggtttaccggtttaaccggaaacgtttcccgggaaaccggtaaaccccgttaaacgggtaccccgtaacccgggttccccggttaacggggtaacccgaaccggtaaacccccggaaaccccgggtacccccaaaccccccgttaagtcccgttaccgtaacccgtttacccccg

SEQ ID NO: 257436 - DNA, 812 bp, Homo sapiens
  misc_feature: GYAE6OF01B0OCP.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacacgcccacccgtcggtgtcagtcgtccccaggacacggaccggccaggactccacctcgctcgtggacgatgctattcgaccaaaccgatagtgtactttagttcggtaccagacgaggaacggcccgggccgacggcccccgttggttcggttaggtgtaagttagttaaagtaaacgactacgtaggaacggaccgggtaccccgtcggtaacgggtaccttcccgtaggtacggtacgtacgtttccgtacgtcgggaccttaccggtagggttcccgaacgggtaaccgtaaccgggtaccaacggttacgttaccgggacctagtaccggtaggtacgggtaccgtaccgacgggacggaacggaacgggacgggtagggtccgtttaaccggtaagttttaacgtttaacggtttacgttaacgtaacgttaccgaaacgaacggtaaccctaacgttaacgtttacggtttaactttacgtttacgttaccgttacggtaaccgttacggtaccccggtaaaccgttaccgggtacccgttaccccggttaccggttacggggtacccgaaccgggtacccccgaaaccgggaccccctaaaccccggtacttcccgttaacccgtcccgtttacccccg

SEQ ID NO: 257437 - DNA, 709 bp, Homo sapiens
  misc_feature: GYAE6OF01A58E6.51.35.D02.1.454.CMB.1.raw
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacaggacggccaggatcacctgctctggagatgctattcgccaaaccgatactgtcttattcgggtaccagcaagaacgccgggcacggcccctgtgttggtgtatgtaataaagacacgtgaggacggccctacgacgggactcccgtagaggtcgtatttcctcgttcggcctccgtagggtccgtaacggggaaccgtaaacggtacgaactagtttcgggaccctaagtaccgtaaggtgggaacggttcccgaaggggacgtaacgggaacgggaccggaagggtccgtacgggtaccttaagtttaagttacgtacgtaaacgtactaaaccgtaacgtaacccgtaacccttaaggtttcggttaaacctttagtaccgttccgtttaaccgggaacttcgggaacccgtaaccgtaacgggttccctaccccgggttccgttaccggggtcccgaaaccgtccccggaaaccggacccccaaaccccctaggttacccgtaccccg

SEQ ID NO: 257438 - DNA, 711 bp, Homo sapiens
  misc_feature: GYAE6OF01AUWU4.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgggagatgcattgccaaaccgatatgcttattggtaccagcagaagccggccacggcccctgtgttggtgagtgtataaagacacgtgagacggccctcgagggactcccgtggacgcgtacttcgtcgtgtcctccgaggtccgagggacctaaacgggtcacgtacgtttcggacctatacgtagtcggacggttacccgagggaccagggaacgggtaacggacgggtacgttacgtaaccgtttaatttaacgtttacggtactaaagtacccaaacgtaacgaaaccgtaaccgttaacgtttacgggttaactttaacgttagtttaccgtttaccgggtaaaccgttcgggtaccgtaaaccccggtaaaccgggtacccgtaaccccgggttacccgttaccggggtacccgaaccggtacccccggaaacggtacccccctaaacccccgtaacccttacggttaccccgtaccgtttacccccg

SEQ ID NO: 257439 - DNA, 724 bp, Homo sapiens
  misc_feature: GYAE6OF01A1N3I.51.35.D02.1.454.CMB.1.raw
  modified_base (240)..(240): a, c, t, g, unknown or other
  misc_feature (240)..(240): n is a, c, g, or t
  modified_base (288)..(288): a, c, t, g, unknown or other
  misc_feature (288)..(288): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgntatgcttattggtaccagcagaagccgggccaggcccctgtcgttggngatgtataaagcactgagaggccctagagggactccccgtagacgcggtactttccgtcgttgggcctacccgtagggtccgaagggggacaaaccggggttcaaccgtagtttcgggaccctaattccgaacggttgggaacgttccccgaagggccgaaagggacgggaaccgggaagggccttagggtaaccctttaattttacgttacggtactaaacggttccaaacgaacggtaaccaacccgttaagttttccggggttaaccttttaaggtcggtttaccgttaccgggtaaaccttgggacccgtaaaccccggtaaaggggttcccctaaaccccgggtttacccgttgggggttacccaacggtaccccccgaaaggtacccccctaaacccccgtaaccgttcgtaccccgtaacctttccccg

SEQ ID NO: 257440 - DNA, 639 bp, Homo sapiens
  misc_feature: GYAE6OF01ERVO7.51.35.D02.1.454.CMB.1.raw
  modified_base (391)..(391): a, c, t, g, unknown or other
  misc_feature (391)..(391): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgagcctcctatgagctgacacacgcccacccgtcggtgtcagtcgtccccaggacagacggccaggatccacctgctcgtggagatgctattcgacccaaacgatatgtactttattcggtaaccagacagaacggccgggccacggcccctgtgttggtgatgtaataaacgcagtgagacgcctcgaggcctcctgacgtacgtacttcgtcgtcggtcctccgtagtcggaacgggacaacggtnacgtgtcgcatcgaggtcggacgtcgaggtacgaggacggacgtacggctagtactttattagttatacaattccaaactagaacccgtaactagtttacggttacttagttacggttccttacggtaaccgtcgtacccgtaaaccggtacgggttacccgtaacccgggttcggtcgggtaaccgaccccggaaccctaacccgggaccccctaacccgacttcccggtacctacccgttccccgg

SEQ ID NO: 257441 - DNA, 757 bp, Homo sapiens
  misc_feature: GYAE6OF01CM33R.51.35.D02.1.454.CMB.1.raw
  modified_base (184)..(184): a, c, t, g, unknown or other
  misc_feature (184)..(184): n is a, c, g, or t
  modified_base (241)..(241): a, c, t, g, unknown or other
  misc_feature (241)..(241): n is a, c, g, or t
tcagcgatcgtatacacgaccggtgctcgatttagcacacgatagttgggtttgggggtgggtccaggaggcagaactctgggtgtctcaccatggcctggatccctctacttcctcccctcctcactctctgcacaggctctgacggcctcctatgagctgacacgacgcccacccgtcggtntcgagtccgtacccgaggacgacgaccggccaggactccaccgtgcgtcgtggaagntcgctagttcgacccaaaccgatattgtacgtttagttcggtaaccagacgaagggaaccggcccggaccgaccggtccccgttggttcggtggtagtacgtttagtaaacgtaacgaactacgtaggaacggacggtcccgtacggacgggtacctccgtagacgtgtacttcgtcgcgtactacggaggtacggaacgggaaccgtaacgtaccgagtacggttccgacgtacgtaccggaaggtcggtaacgtccggaaggacggaacgggtaaacgggaggaacggtcgttaagtaaccgttttagttactacggtaaccgtaactaccgaaagtacgtaccttaaccgttaaggtttaacgttaacgttaagtttccggttaacggttaccgaaccgttaggaacccggttaaacccgacgttacccggtaccccgttcgggttaaccggccgtaacccgtaaccccggacccgttaaccccacccgtagtctaaaccgttcccgttcccg

SEQ ID NO: 257442 - DNA, 599 bp, Homo sapiens
  misc_feature: GYAE6OF01C7UN3.51.35.D02.1.454.CMB.1.raw
  modified_base (223)..(223): a, c, t, g, unknown or other
  misc_feature (223)..(223): n is a, c, g, or t
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctcgtgganatgcattcgaccaaacgatatgtctttaattcggtaccagcaaggaacggcccgggaccacggtcccctggttgttgggtagagttgtaaataaacgacacgtaggacggacggtccctagagggtactcccgtaggacgcgtattcgtacgtcgggtcctccgaggtacgaacgggtacaacggtcacgtagttcggacctagttacgaggtcggacgtccgagcgaaggacggacgaggtctagaacttattagtgactaatacaacgacgacactagttacgtaacttgtcgttcttacggaactgaccgaactacggtccgaccgttcgtggccacgacccaacggacccaacccgtatcgcctcgttcccg

SEQ ID NO: 257443 - DNA, 596 bp, Homo sapiens
  misc_feature: GYAE6OF01DGC52.51.35.D02.1.454.CMB.1.raw
  modified_base (243)..(243): a, c, t, g, unknown or other
  misc_feature (243)..(243): n is a, c, g, or t
  modified_base (294)..(294): a, c, t, g, unknown or other
  misc_feature (294)..(294): n is a, c, g, or t
  modified_base (584)..(584): a, c, t, g, unknown or other
  misc_feature (584)..(584): n is a, c, g, or t
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaccgntatgtcttattgtaccagcaggaagccgggccacggcccctggtcgttggngatgtaataaagacatgagacggccctacgaggactcctgagtcgtacttctctcggctccgacggtacgacgggacgtaccggactacgtagttcggacctagtcgtaggtagggtacgtccgaggcgaaggaagggtcggaggcttaggtaacttacgtttagtttgtacaattacaaactagaaccctacgtagttagttaactttgttacgttcgtttaccggactggtacccaacgtacggtcctaccggtccgtggtaccacgtacccaaacggccccaaaccncgttcgtacccg

SEQ ID NO: 257444 - DNA, 680 bp, Homo sapiens
  misc_feature: GYAE6OF01CHSCQ.51.35.D02.1.454.CMB.1.raw
  modified_base (286)..(286): a, c, t, g, unknown or other
  misc_feature (286)..(286): n is a, c, g, or t
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagcccaccctcggtgtcagtgtccccaggacagacggccaggatcgacctgctctggagatgcattgaccaaaccgatatgcttattggtaccagcagaagccggcaggcccctgtgttggngatgtaataagacacgtgagaggccctacgagggactcccgtggacgtcgtaatttcctacgtcggaccctccgaacggggttccgaacggggaaccgtaaccggggtccaacgtaaggtttcgggaccctaagtccgaaggttgggacggttccgaagggaccgaaggtacgggaacggtagggccttagggacctttaaagtttagtttcggtaaccaaagtccctaaaacgagtaaccctaacgtacgtttacgggttaactttacgtcggtttaccttacgggtaaacgttcgtaccggaaccgtaacgggtacctacccggttccgtaggggtcccaacggtaccccgaaacggtccccaaacccgtcgttcgtcctaaccgttccccg

SEQ ID NO: 257445 - DNA, 627 bp, Homo sapiens
  misc_feature: GYAE6OF01D4ZOY.51.35.D02.1.454.CMB.1.raw
  modified_base (138)..(138): a, c, t, g, unknown or other
  misc_feature (138)..(138): n is a, c, g, or t
  modified_base (246)..(246): a, c, t, g, unknown or other
  misc_feature (246)..(246): n is a, c, g, or t
  modified_base (342)..(342): a, c, t, g, unknown or other
  misc_feature (342)..(342): n is a, c, g, or t
tcagcgatcgtatacacgaccggtgctcgatttagcacacgatagttgggtttggggctgtgggtccaggaggcagaactctgggtgtctcaccatggcctggatccctctacttctccccctctcactctctgcacnggctctgacgcctcctatgagctgacacagcccaccctcggtgtcacgtcgtccccaggacaggacggccaggatcacctgctgtggagatgcattcgaccaaaacgntatgctattggtaccagcagacgccggaccaggcccctgtgttggagattagaataaagcactcgagacgccctgcggtactccgagacgacgttntcctcgtcggtccacggtacgacggacgaacgtacgtcaactgtacgacgtacgtacgtaggaggtctacggaggacgaaggacggacggacgtacgtagtaacgtttcaatttacgttacaacgtaactaaccaaactacggaacccgtaacttacggttacgtttaacgtaacgttaacgttccggtaaccgtaacggtacggaccgtaaccggtacggtaaccggtccgacccgggttacgtacgaccccgaaccgacgaccccgaaccctaccgttacccg

SEQ ID NO: 257446 - DNA, 810 bp, Homo sapiens
  misc_feature: GYAE6OF01AEXFH.51.35.D02.1.454.CMB.1.raw
  modified_base (237)..(237): a, c, t, g, unknown or other
  misc_feature (237)..(237): n is a, c, g, or t
  modified_base (262)..(262): a, c, t, g, unknown or other
  misc_feature (262)..(262): n is a, c, g, or t
tcagcgatcgtatacacgaccggtgctcgatttagcacacgatagttgggtttgggggtgggtccaggaggcagaactctgggtgtctcaccatggcctggatccctctaccttctccccctcctcactctctgcacaggctctgaggcctcctatgagctgaccacacgcccacccgttggtgtcagtccgtccccagggacaggaccggccaggatccaccgtgcctcgtggganatgactagttcgaacccaaaccgtnttagtcgtacgtttagttcggtaaccaggaccgaggaaccgggcccgggtccgaccgggtcccccgttaggttggtttggtaggtaagttacggttaaacgaaaacgacgtacggtaggaacggtaaccggtccccgtacggtacgggtaccgttcccgtacggaacggtccgttacgtttcctccggtacggtccgttaccggtacgggtacggaacgggtaccgtaacgggtacctacggttacgttccggacctagtaccgtacgggtaggaccgtaccgggacggtacggaaggtaacgggacggtacggtactacggttaactttagttacgttagtaacctaagttaccgaaacgtaacgtaacccttaaccgttacgtttaaggtttaccttaggttccgtttaccgtacggtaaccgttccggaccgttaacccgtacggttacccgtaccggttcccggtacggacccgtaacccgggtaaccccaaccccgggtaccccaaccccgttcgtaccgttacccgtacccgtttcccccgg

SEQ ID NO: 257447 - DNA, 640 bp, Homo sapiens
  misc_feature: GYAE6OF01BU8GH.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgctcgtggagatgctattcgacccaaaaccgatatgtactttattcggtaaccagcaaggaacggcccgggaccacggcccctggttggttcggtgatagtaataaagacacgtgaggacggcctcgaggactcccgtgacgcgtattctcgtcggcctaccgagggtcgaagggacgaacggtcacgtagtcggcagtcaggtggacgtccgaggacgaggacggacgaggctagtacttagtttatgtactaacgtacaaacgacgaacctacctacgtttacggttaactttacgttcgttacgttacggtaacgtcgaaccgaccgtaacggttcccgaccggttccggtacgggtccgaaccgaccccggaaaccggaccccctaaccccgaagttcccgtaccgtaccgttacccccg

SEQ ID NO: 257448 - DNA, 736 bp, Homo sapiens
  misc_feature: GYAE6OF01A1J9B.51.35.D02.1.454.CMB.1.raw
  modified_base (224)..(224): a, c, t, g, unknown or other
  misc_feature (224)..(224): n is a, c, g, or t
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccacccgtcggtgtcagtcgtcccaggacagacggccaggatcacctgctcgtggganatgctattcgaccaaaccgtatatgtacttattacggtaaccagcaaggaacgcccggggtaccacgggtccccgtggttcggttggtgattaggtaaataaacgacacgtaggaggaccggtcccgtacggacgggtaacttcccgaggtacgaccgtacgtttccgtcggtacgccgttaccggtaaggtacggaacgggacgtaaccggtaccaacgtacggttcgacctacgtacggtagggtacggtaccgtaccggaggcgaaaggacgggtacgaggttaccgtagttaacgtttaagttacgttagtaacctaaacgtaaccgaaacgacggtaaaccctaccgttaagtttaccgttaactttgtacccggtttacgtacggtaacgtcggaaccgtaccgtaacggtcccgttaaccggtccggtacggtacccgacccgtaacccgggaacccgtaacccccgtaaccccgtaagtttcccgaacccgttccgttaccccg

SEQ ID NO: 257449 - DNA, 657 bp, Homo sapiens
  misc_feature: GYAE6OF01EWSFA.51.35.D02.1.454.CMB.1.raw
  modified_base (245)..(245): a, c, t, g, unknown or other
  misc_feature (245)..(245): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgctattcgaccaaacgntatgcttatgtaccagcagacgcggcacgccctgtgtgnatgtanaagcagngagcgcctgaggctccgtgcncgtattctcgtagctacgaggtcgaggacacgtcatgtgcatacgtagtcggactaccgaggacgaggagggacgaggtctagtacttagttacgttacgtactaacgtacaaacgtaacggaacctaacgttacgtttacggtttaacctttagttaccggttaaccgtttaccgggaaaccgtttaccgggaaaccccggttaaacccgtaaacggggttccccgttaaaccccgggtttccgggtttaacccgggtacccgaaaccccgggtacccccgggtaaacccgggtaaaccccccccgtaaacccccttacggttccggttaaacccccg

SEQ ID NO: 257450 - DNA, 790 bp, Homo sapiens
  misc_feature: GYAE6OF01C23MJ.51.35.D02.1.454.CMB.1.raw
  modified_base (244)..(244): a, c, t, g, unknown or other
  misc_feature (244)..(244): n is a, c, g, or t
tcagcgatcgtatacacgaccggtgctcgatttagcacacgatagttgggtttgggggtgggtccaggaggcagaactctgggtgtctcaccatggcctggatccctctacttcctcccctcctcactctctgcacaggctctgaggcctctatgagctgacacagccacccgtggtgtcagtcgtccccgaggacagacggccaggactccacctgctcgtggagatgctatcgaccaaacgntatgtacttagttcggtaccagacaaggaacggcccgggccacggtccctggtgttggtagagtagtaaagtaaacgactacgtaggacgtacggcccgtacggacgggacttcccgtagacggtcgttacttcgtacgtcgacccgtaccgtaggtacggaacgggaactaaccgggtacaacgttacggttcggaacctagttaccggtaaggtacggaacgttaccgaaggtacggaaggacggaacggtaaggtcgttacgtaactttaagtttacggttacgtaacctaacgtaacaaaccgttaacgaaccgtaacgtttaaggtttaccgggttaacttttaacgggtccgttttaaccgggttaaccgggtaacgtttccgggaacccggtaaaaaccccgggttaccgggttaaccccggtaccccgggtttaccggttaaccgggggtacctaaacccccgggtaccccgtaaaacccggggtaccccccaaaaccccggttcggttacccttacccgtacccgttttacccccgg

SEQ ID NO: 257451 - DNA, 822 bp, Homo sapiens
  misc_feature: GYAE6OF01BE5BQ.51.35.D02.1.454.CMB.1.raw
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacacgcccacccgtcggtgtcagtcgtccccaggacagacggccaggactcacctgctcgtggagatgctattcggacccaaaaccgtattatgtactttagttcggtaaccacgacgaacggaacggcccgggaccgaccggtcccccgttggttcggtttggtgtaacgttagtaaacgttaaaagaccgaacgtcggtaacgaccgggtccccgtacggacggggtaaccttcccggtacggacggtcgttaacgtttccgttccgttcggtccctaccgacggggttaccgaacgggggtaacctaaaccgggttccctaacgtacggtttacgggacccgtaacgtacggtaacgggtacgggtaccggtaccggtaacggacggaacgggaacgggtaaccggacgggtaccgttacggttaacgttaagtttacgttaagttaaccgtaacgtaacgtaaaccgaacgtaaccgtaaccgtacgtttacgttacgtttaacgttacgttaccgttaccggtaacgttaccggtaacccgtacccggtaaccgggttaccgtaacccttccgggggggggggttacctaccggaacccggtaccccgtaaaccccggaacccctaacccccgtaccgttcccgttaccccg

SEQ ID NO: 257452 - DNA, 645 bp, Homo sapiens
  misc_feature: GYAE6OF01EOY49.51.35.D02.1.454.CMB.1.raw
  modified_base (466)..(466): a, c, t, g, unknown or other
  misc_feature (466)..(466): n is a, c, g, or t
tcagcgatcgtatacacgaccggtgctcgatttagcacacgatagttgggtttggggctgtgggtccaggaggcagaactctgggtgtctcaccatggcctggatccctctacttcctccccctcctcactctctgcacaggctctgaggcctcctatgagctgacacagcccaccctcggtgtcagtcgtccccaggacaggacggccaggatccacctgctctggagatgcattcgaccaaaaccgatatgtacttattcggtaccagcaggaacgccggccacggcccctgtggttggtgtatgtaagtaaagacacgtgaggacgcctagacggactcccgtagacgcgtattctcgtcgtctccgaacggtcgagggaccaacggttcacgtagttcggacctagtaccgtaggtggacgtaccgaggacagggaacggaccggaggtcgtagtaacgttnttagttgtactaataccaaacgacaacctaccgtagtttacgttaacctttagttcgttaccgttacggtaactcggtaaccgaacccgtaacggttacccacccggttcttaccgggggtacccaacccggtaccccgaaaccgggaacccccaaaccccgttccgtaccggttaccc

SEQ ID NO: 257453 - DNA, 667 bp, Homo sapiens
  misc_feature: GYAE6OF01B57KD.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctcgtggacgatcgctacgttcgacccaaaaccgtatatcgtactttacgttaggtaaccagacgaaggaacggcccgggaccgaccggtccccgttggttcggttggtgtagtagtaagtaaacgactacgtaggacggtaccggtccctaggacgggtactcccgtagacgtcgtacttcgtcgtcggtcctccgaggtacgaacgggaacctaacgggtctaacgtcgttacggacctacgtcgtaacggtacgacggtcgaggtacgaaggaggacgaggtctacgtacttattacgtagactaagtacaacacgacctacttagttacgtacttagttcgttacgtacgacgttcgaccgtaaccggtaacgtccgtaccgttcgtacgggtccaccggacccgaaccggtccccaaccgtacgtaccgttacctccgtttacccg

SEQ ID NO: 257454 - DNA, 780 bp, Homo sapiens
  misc_feature: GYAE6OF01BINNO.51.35.D02.1.454.CMB.1.raw
  modified_base (260)..(260): a, c, t, g, unknown or other
  misc_feature (260)..(260): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctctatgagctgacactagcccacccgtcgggtgtcagtcgtaccccgaggacaggaccggccgaggactccacctgctcgtgggatatgctagttaccgaaccaaaccgtntagtcgtacttacgttcggtaccaggacctaggaaaccgggcccgggaccgtaccggtcccccgttggttcggtttcgggtagtacgttaggtaaacgtaaacgaccgtacgtaggaacggaccggtccccgtacggacgggtaccgtcccgtaggacgtaccgtagttccgtcgtcggtacccgtaccggtacgggtaccggaacgggtaaccgtaacggtctaacggttacgttaccgggacctacggttacggtacggttacgggtacggtaccggacgggacgtaacgggaacggggaaccggtacggtaccggttagtaacgtttaagtttacgtttacgtacgtaacgtaaccgtaacgaacgtaacgtaacgtaacgtttacggttacgtttacgttacgttacgttacgtacctacggggggactaaccggtaccgtaccgtaccggtcggtacggtaccgaccgaacccgaacccgtacccgacccgtacgtaccttccgtacgttccccg

SEQ ID NO: 257455 - DNA, 832 bp, Homo sapiens
  misc_feature: GYAE6OF01DEJ1E.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacacgcccacccgtcggtgtcagtcgtccccaggacagaccggccaggatccacctgctcgtggacgatgctagttcgaacctaaaccgattagtcgtactttagttcggaacctaggacgaacggaaccggcccgggaccgaccggtccccgttggttggttcgggtagtattaggtaaagtaaacgacctacgaggaacggtaccggtcccgtacggtaacgggtacctacccgtaggacggttccttaacgtttccgtacggttaccggccttaaccccgggtaggtacgggtaaaccggggaaccgtaaaccggtaccgtaacgttacggttacggaccctaacggtcggtaacggttaccgggtaccgtacccgggtaaggaccggaagggtaacgggaaccggtagggtaccttaacggtaacgttttaacgtttagtttccgtaacttaacgtaactaaccgtaacgtaaccgtaaccgtttaaggtttaccggtttaactttaggttaccgtttaacggtttaccggaaacgttcccgggaaccgaacccgttaaccgggtcccgtaacccggttcggtaccggtacccgaacccggtaaacccccgaacccggtaccccccttaaaccggtccttaaccggtccctacccggtttccccg

SEQ ID NO: 257456 - DNA, 723 bp, Homo sapiens
  misc_feature: GYAE6OF01C2Z26.51.35.D02.1.454.CMB.1.raw
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
  modified_base (252)..(252): a, c, t, g, unknown or other
  misc_feature (252)..(252): n is a, c, g, or t
  modified_base (430)..(430): a, c, t, g, unknown or other
  misc_feature (430)..(430): n is a, c, g, or t
  modified_base (452)..(452): a, c, t, g, unknown or other
  misc_feature (452)..(452): n is a, c, g, or t
  modified_base (472)..(472): a, c, t, g, unknown or other
  misc_feature (472)..(472): n is a, c, g, or t
tcagcgatcgtatacacgaccggtgctcgatttagcacacgatagttgggtttgggggtgggtccaggaggcagaactcgtgggtgtctcaccatggcctggatccctctacttcctcccctctcactctctgcacaggtctctgacggtccctcctagtgacgtctacgacacacgcccaccgtggtgtcagtcgcccgaggacngacgccgagactcacgtnctcgagganctgcttagcgaacctaacngttatgacgttattaccggacacgacgaacggacggacccgggtaccgcggtcccgttaggtggttacgggtattaagtacgtaaagtaatacaggtacgaggtaccgcctagacgggtactccgtgcgtcgttactcggtaccgtcgtacctacggagtaccggtaagacgtaaccncgtactagttacgacgttaagngtaggtacgtaccggaacgnggaacgacggacggaagtaacccggtagttacggtaaactttacggttacgttaacacgtacgttaacgaaccgaactacgtaacggttagtttaacctagtttaccgttacggttacgttaccgacgttaaccgtaaccggtaccggtaaccgttaccccgacggtaccgttaacggtaccgtaaccccgttaacggaccccgttaaaccccgacctttaccgccggttaccttaaccggttccccccgg

SEQ ID NO: 257457 - DNA, 670 bp, Homo sapiens
  misc_feature: GYAE6OF01ED94V.51.35.D02.1.454.CMB.1.raw
  modified_base (226)..(226): a, c, t, g, unknown or other
  misc_feature (226)..(226): n is a, c, g, or t
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctctatgagctgacacagcccacctcggtgtcagtcgtcccaggacaggaccggcaggactccgacctgcctcgtgganatcgcagttcgaccaaaccgatatgcttagttcggaccagacaagaacgccggaccacggccccttgtgttcggtgtattacgtaagtaaagactacgtaggacgacggccctagacgggaactcccgtaggcgtcgtacgttctcgtcggcctaccggtacggtacggacgggtaacgtaacggtacacgtaagttcggaccctagtaccgaggtacgtacgacggtacggacgtaagggaagggacgacggtcgttacgtaacgtttaacgtttaacgttacggtaacctaaataaccgaaacgtacgaacccgtaacttaggttacgttacctttagttcgtacgttacggaactcgaccgtaccgaacggtccaccgttcggtacggaccgacgtacccaacggtcccccaaacccgtccgttctccgtccttaccccgg

SEQ ID NO: 257458 - DNA, 851 bp, Homo sapiens
  misc_feature: GYAE6OF01BZCCA.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctggaggcctcctatgagctgacacgacgccctacccgtcggtgtccgtagtccggtacccccgaagggaccacggaccggaccaaggactaccgaccgtgtccttcgtagggaagtacgtcggtacctaacgttaccggaaaccctaaaaaccggtattaagttcggttaaccttttaacggttacgggaaccgaacgtaaccggaaacgggaaccgggtccccggggcccgtaaccgggttccccgttagggtttcggggtttacggtagttaagtttaaggtaaacgtaaaacggaccgttacgtagggaacggtacccgggtacccgtagggtaaccgggtaccttccgggtacgtacggtccttacgtttccgttacggtccggtacctaccggtacggtaaccgggacggtaaccgtaacgtcgaacgtacgttcggactacgtacgtaggtacggacgtcgggaacgcgaaggacggagcggtacgtagtaactttaagtacgtacgaactacgaacaacgacctaacgtaccttacggtttagttaccttagtcgttacgttaccggaacttcggtaaaccgccgttaaacggtcccgtaaccgggttaccggtaccggtaacccgaaccccgggtaaccccaaccgggtaaaccccccctaccccggttaaatccccggttaatccccggtttacccccgg

SEQ ID NO: 257459 - DNA, 835 bp, Homo sapiens
  misc_feature: GYAE6OF01BSGWJ.51.35.D02.1.454.CMB.1.raw
tcagcgatcgtatacacgaccggtgctcgatttagcacacgatagttgggtttgggggtgggtccaggaggcagaactctgggtgtctcaccagtggcctggactccctctacttcctccccctcctcactctctgcacaggctctgacgcctcctatcgagctagaacacacgcccctacccgtcggttgtccgacgtccgtaccccgaaggacacggaccggacgtaaggactcgaccgttcgactcgtaggaatagtcgactaagttaccggaaccctaaacgtatacgttcgtacgtttagtacggtaaccagacgaacggtaacggcccgggaccgaacggtccccgtggttaggttaggtagtaagttaaggtaaagtaaaacggaccgtaacgtaggaaccggtaccggtacccgttacggaacgggtacctttacccgaaggaccgtacgttacgtttccggtagtaccggaccgttaacccggtaaggtaccgggaaacgggttaaccgaaccggtaaccgtacgttaacggttcccggacgttaacgtacggtaacggggtacggttacgaacccgggtagggaaacggaacgggaaacgggtacccgggtaaagtcggtttaacggtaactttaaagtttaccgttaaggtaactaaacaacctaaacgtaaaccgaacttaaccgttaagtttaaccggttacctttaacggtttacgtaccgttaacggaaccgtacggtactaaaccgggagtacccgtacggtacggttcggaaccaccgaaccggaacctacccgaccgtatccaccgtacgttccccg

SEQ ID NO: 257460 - DNA, 891 bp, Homo sapiens
  misc_feature: GYAE6OF01A12D3.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttcctccccctcctcactctctgcacaggctctgacggcctctatgagctagacacacgcccacccgtggtcgtcacgtccgtccccgaaggacgacggaccggccgaaggactaccaccgttgccgttacgtgggagtagtcgacctagttccgaacccctaaacccttacttttacttttacgttaacgttccggtaaaccagtaacgaaggaaccgaccggaacgggtcccgtccggttccccgttggtttacggttttacgtttaggtaatttaaacgttaaaagttaaaaccgaccgtaacgttacggtaacggtaccggttacccggttacgggaaccgggttacccgtaccccgttaggtaccgtaccggtttaaccttaccgttccggtcccgtacccgttaccccgtaaccggttacggaaacggtaacgtaacgggttccgtaaaccgtaacgttaccgttaaccggaaccgttaacgttacggtaaccgggttacggtaacccggtacggtaacggtaacggaaacggaacggtaacccggaggtacgttaccgttaacgttttacgtttaccgtacttaacgttccttaacgttacgtaacgtaaccttagttacggttacggtttacgttactttggttaaccgttcggttaacggtaccgggtaaacggttaaccggtaccggttacccgtacggttacccggtaccggacccgaaccgaaccccgtaacccggccctaaacccggtcgtcccgttaccctacccg

SEQ ID NO: 257461 - DNA, 687 bp, Homo sapiens
  misc_feature: GYAE6OF01CR808.51.35.D02.1.454.CMB.1.raw
  modified_base (231)..(231): a, c, t, g, unknown or other
  misc_feature (231)..(231): n is a, c, g, or t
  modified_base (509)..(509): a, c, t, g, unknown or other
  misc_feature (509)..(509): n is a, c, g, or t
  modified_base (674)..(674): a, c, t, g, unknown or other
  misc_feature (674)..(674): n is a, c, g, or t
tcagcgatcgtatacacgaccggtgctcgatttagcacacgatagttgggtttggggctgtgggtccaggaggcagaactctgggtgtctcaccatggcctggatccctctacttcctccccctctcactctctgcacaggctctgaggcctcctatgagctgacacacgcccacccgtcggtgtcagtcgtccccgaggacagacggcaggactcacctgctcgtagganatgactatcgaaccaaacgtatactgtactttaagttcggtaccagacacggaaccggcccgggaccgtaccggtccccgtggttcggtttagggtagtaacttagtaaacgtaaagacctaacgtaggacggtacggccccgtagacggtacctcccgaggtacgtcgtactttcgtcgtacggtcctacgtaacgggtacgtaacggacgtaaccggtactacgtcgtacgctagtacgtaggtacgacgtcgaggactagggacgggacgtacgngtacgtacttattaagttcgaactaatacaactacgaacctacctaggttttaccgatttaacgtcgtaccgttaaggtactacggtaaccgaaccgtaacgttaccggaacccgttcgggtacggtaccgtacccgacccgaaacgttcccccaaacccggttntccgttaaccccg

SEQ ID NO: 257462 - DNA, 739 bp, Homo sapiens
  misc_feature: GYAE6OF01CQSFD.51.35.D02.1.454.CMB.1.raw
  modified_base (542)..(542): a, c, t, g, unknown or other
  misc_feature (542)..(542): n is a, c, g, or t
  modified_base (581)..(581): a, c, t, g, unknown or other
  misc_feature (581)..(581): n is a, c, g, or t
  modified_base (588)..(588): a, c, t, g, unknown or other
  misc_feature (588)..(588): n is a, c, g, or t
  modified_base (719)..(719): a, c, t, g, unknown or other
  misc_feature (719)..(719): n is a, c, g, or t
tcagcgatcgtatacacgaccggtgctcgatttagcacacgatagttgggtttgggggtgggtccaggaggcagaactctgggtgtctcaccatggcctggatccctctacttcctccccctcctcactctctgcacgaggctcgtgacggccttctatgagctgaacacgagcccaccgtcggtgtcagtcgtccccgaggacgaggaccggaccgaaggactccaaccgtcgcttcgaggagtaacgtgactacgttacgaaccgaaaaccgtataatcgtaacttagttacggaccagacgaaggaacggccgggtaccgaccggtacccgttggtaggttggtagtagttaagaacgttaaagactacgtaggaacgtcggcccgtaggagggtaccttccgaggtacgtactacgtttccaacgtcggtaccgtacgtaacgggaaccgaagggaaccgtaaccggttacaacgtagttacgacccaagtcggtaagggaacgtacggaacccgaggaacggagtaccgggaaacgnggtactacgtaacttaagtttatacggtaacaaacttanaacgaanaacccgtagtaacgttttgtaaaccttagtacgttcggtaaacgtatacgggaaccgtaacgtaaacgggtccgtaaaccggtacgttcggaaaccccgtagaaccccgtacccggaaccctaaacccgtntccgtttccaaccgttcccg

SEQ ID NO: 257463 - DNA, 668 bp, Homo sapiens
  misc_feature: GYAE6OF01A67O1.51.35.D02.1.454.CMB.1.raw
  modified_base (145)..(145): a, c, t, g, unknown or other
  misc_feature (145)..(145): n is a, c, g, or t
  modified_base (180)..(180): a, c, t, g, unknown or other
  misc_feature (180)..(180): n is a, c, g, or t
  modified_base (182)..(182): a, c, t, g, unknown or other
  misc_feature (182)..(182): n is a, c, g, or t
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
  modified_base (329)..(329): a, c, t, g, unknown or other
  misc_feature (329)..(329): n is a, c, g, or t
  modified_base (364)..(364): a, c, t, g, unknown or other
  misc_feature (364)..(364): n is a, c, g, or t
  modified_base (420)..(420): a, c, t, g, unknown or other
  misc_feature (420)..(420): n is a, c, g, or t
  modified_base (613)..(613): a, c, t, g, unknown or other
  misc_feature (613)..(613): n is a, c, g, or t
  modified_base (658)..(658): a, c, t, g, unknown or other
  misc_feature (658)..(658): n is a, c, g, or t
tcagcgatcgtatacacgaccggtgctcgatttagcacacgatagtttggggttttggggggtcgggtccacggagggctacgaactctgggttgtctcaccatggcctggatccctctacttcctcccctctcactctctgcanaggtctctgacggtccttcgtatgagcttagaacncncgccaccgtggtgtcagtcgtcccgaggacgcggtacgccaggtctccgaccgtggtctcgacgggtatactcggactacgtcgaccctaaacggtnttagngtacctttagttacgtacccagacgaaggtaccggcccggtaccnccggtcccgtaggtggttcgtaggagttacgtaanaagcgtaacgtgacgtacgccgttagaaggcttccggaagacgtcgtattccgcgnggccctacggagtacgaggtaccacgtcagcttacgcacgaccgtagacgacgtaccgaggtccgagacgggtacaggtctacgtacgttatacgttacgactaacgtacgaactacgaaccgtacgtttgtacgtttaaccttggtacctacggtagtaacgtacgacgacgttacggtacgcggttaccgnggttacccaacgtcccgaaacccgtcccaaccggtcgttcgtccnccgtttaccg

SEQ ID NO: 257464 - DNA, 720 bp, Homo sapiens
  misc_feature: GYAE6OF01DHILL.51.35.D02.1.454.CMB.1.raw
tcagcgatcgtatacacgaccggtgctcgatttagcacacgatagttgggtttggggggtgggtccaggaggcagaactctgggtgtctcaccatggcctggatccctctacttctccccctcctcactctctgcacaggctctgaggcctcctatgagctgacacagcccaccctcggtgtcagtcgtcccgaggacagacggccaggatcacctgctcgtggagatgctattcgaccaaacgatatgtactttagttcggtaaccagacaaggaacggcccgggccaccggcccctggtggtggtgtagttagtaaataaacgacacgtaggacggacggcccgtacgacgggactcccgagacgcgtatttcctcgtcgggtcctaccggtagggtacggaacggggaacctaacgggtccaacgtacgttacggacctagtcgaggtaggacgtaccgagggacgaagggacgggaacggacggtcgtagtacgtttaatttagttacgtaacctaaataccgaaacgaacgaacccttacgttaacgtttaaggttacctttaagttaccggtttaccgtttaccgggacgttaccggaccggtaaaccggtaacgggtacccgtacccggtcccggttacgggaccacccggaaccccgaaacccggaaccccccttaaaccccgaccttccggttacctacccgtttccccgg

SEQ ID NO: 257465 - DNA, 860 bp, Homo sapiens
  misc_feature: GYAE6OF01AYAZB.51.35.D02.1.454.CMB.1.raw
  modified_base (225)..(225): a, c, t, g, unknown or other
  misc_feature (225)..(225): n is a, c, g, or t
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacacgccaccctggtgtcagtcgtccccaggacagacggccaggatccacctgctcgtggagntgctattcgaccgaaaccgtatattgtctttggttcggtaaccaggacgaaggaacggcccgggtccacgggtccccttggttcggttggtagtagtaggtaaactaaacggactacgtagacggtacggcccgtacggagggtccttcccggtagacggtcgttactttccgtacgttcgggtaccctaccgggtacggtaccggaacgggtaaccgtaaccgggtactaaccgtaacggtttccggacccgttagtcggtaacgggtcgggttaccgaccgggaaggccgaagggaaccggtaacggtacggtacgtacgttaaccgttttaagttacgtttacgtaacgtaaccgttaacgaaaccgtaacgtaaccttaacccggtttaacggttttaccggttaaacgtttttacggtttaacccggtttaccgttttaaccggggtaacccgtttaaccgggaaccccggttaaacccgggtaaacccgggttttacccgttaaccccgggtttaccgggtacccggggttaaccccgaacccccgggttaaccccgggaaaccccgttaaaccccccgtaacccccggtaccggtttccttaacccccgtaccccgttttaccccggg

SEQ ID NO: 257466 - DNA, 807 bp, Homo sapiens
  misc_feature: GYAE6OF01DE69J.51.35.D02.1.454.CMB.1.raw
  modified_base (87)..(87): a, c, t, g, unknown or other
  misc_feature (87)..(87): n is a, c, g, or t
  modified_base (139)..(139): a, c, t, g, unknown or other
  misc_feature (139)..(139): n is a, c, g, or t
  modified_base (158)..(158): a, c, t, g, unknown or other
  misc_feature (158)..(158): n is a, c, g, or t
  modified_base (186)..(186): a, c, t, g, unknown or other
  misc_feature (186)..(186): n is a, c, g, or t
  modified_base (249)..(249): a, c, t, g, unknown or other
  misc_feature (249)..(249): n is a, c, g, or t
tcagcgatcgtatacacgaccggtgctcgatttagcacacgatagttgggtttggggctgtgggtccaggaggcagaactctgggtntctcaccatgcctggactccctctacttcctcccctctcactctctgcacgngctcgtgacgtcctctagngagctgaacacgacgccctaccgtggtntacgacgtccgacccgaggacacggacgcgaagtactccgaccgtgtccgtcgtaggaacgtntacgacttacggtaaccgaaacccgtaacgttaatgttacgttaacgtttacggtaacggaacctacgaacggaacggacccggccgggtaacccgtccggttccgtgggttacggttggtaacgtaaacgtttaagaaaacgtaacgacctaggtaacgacgggtaaccctccgtagggtacccgtacgtaccggagacgtaccgtttacgtccgtacggtcccgtacgttaaaccgggacgggttaaccggaaacgggttaacccggaaccgtttggaaccgtttaccggaccggtaactacggtaccggtttaacgggacggtacgtaacccggaaggtacccggtaaggtaaccggggtagtacgacgtttaacgttactagttacgtacgtaacaacgtacgaaccgtaactacgtacgtttactaaggttacttgtacggttaacccgtagtaccggtccgtaaacggtacccgtaaacggtccgttaaacgggttcaacccggttacgacccgttaacccaaccggtaccctcccgtaacgtcccttaccg

SEQ ID NO: 257467 - DNA, 793 bp, Homo sapiens
  misc_feature: GYAE6OF01EX0VG.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctcgtggagatgcattcggaccaaaccgataatgtacttattaggtaccaagcaaggaacggccgggaccaacggtcccccttggtcgttgggtagtataggttaaactaaaaggactaacgtaggaacgtaccgggcccttacgaagggtactccccgtggaacggtacgtactttccgtccgtcgggccttaccgacgggttacgaacgggtaaccgtaaacgggtacctaacgttaacgtttacgggaccctaagtaccggtaagggttacggggtaacgtacccgggaacgggaccgaaacgggtaaacggggacggtaacggggccttaacgtaaccggtttaaatttaacgtttacgtaagtaaaccttaacctaaaccgaacgtaaccctaacgtaacgtttacggttaaacgttttacttacggtaccgtttaacggtaaccgttacggaaccgtaaacccggtaaacggttacccgtaacccggttaccgggtaccgggttacccgaaccggaaccccgaacccgggtaacccaaaccccccgtagtaccgttccgacctttaccccgg

SEQ ID NO: 257468 - DNA, 974 bp, Homo sapiens
  misc_feature: GYAE6OF01AL2R4.51.35.D02.1.454.CMB.1.raw
tcagcgatcgtatacacgaccggtgctcgatttagcacacgatagttgggtttgggggtgggtccaggaggcagaactctgggtgtctcaccatggcctggactccctctacttctcccctcctcactctctgcacgaggctcgtgacggcctctagtgagctagaccactacgccctacccgtggtcgtacgacgtccgtacccgaggaccgacggtaccggaccgaaggtactaccgtaccgtcggccttacggtagggacgtacgtacggtaccgtacgttacccgaacccgtaaaaccgtattacgttacgttacctttaagttaccgggaacctaggaaccgtaagggaacccggcccggtaccgaccggttaccgtggttaggttacggtaaggtaagtaaccggtaaaataaccggtaaccgtaggtaacggtacggtaacccgtacccggttacggaaccgggttaacccttcggaacgggtacgttaccgttacgttaaccgttcggttacggaacccgtacggaacggggttaaccggaacccgggttaaacggttaaacgtacccggtaagttaaccgggttccggtaaaccgtaacggttacgggttacggttaccggggtaaccgtaacccggggtacggaaaccgggttaacggggaacgggtaacccgggagggtttaaaccgttacgttaaacccggtttaagttaaccggtttaccggtaaccgtaaaacgtaccgtaaaaccccgggtaattaacccgggttaaacctttaaacggggtttacctttaaccgggttaacgtttccggttacccgggttaacgtaaccggtacgttaaaccggaccggtaacgttcccgggtaaaccgttcggggttaaccgaccgtaacccggaacccgtaacccggtaacccccttaacgtacggtttacctacccggtttacccgttaccccgg

SEQ ID NO: 257469 - DNA, 872 bp, Homo sapiens
  misc_feature: GYAE6OF01CUNP7.51.35.D02.1.454.CMB.1.raw
  modified_base (140)..(140): a, c, t, g, unknown or other
  misc_feature (140)..(140): n is a, c, g, or t
  modified_base (262)..(262): a, c, t, g, unknown or other
  misc_feature (262)..(262): n is a, c, g, or t
tcagcgatcgtatacacgaccggtgctcgatttagcacacgatagttgggtttgggggtgggtccaggaggcagaactctgggtgtctcaccagtggcctggatccctctacttcctcccctctcactctctcgctacgnggtctcgtcggacggtcctcgtaatggacgtacctagacacgtacgccccacccgtgtgtcctagtccgtacccgagaacgacggaccgccgtaggtactccaccgtgtcgtacgtaggganatcggtactacgttaccggaaacccaacgtatgttacgtactttacggtacggacgaggaacgaacggaccggccggtccgtacggttcggtggttacggtagtacgtaagtaagtaacgacgtacgtacggacggacgtccgtaccgtaggtacggtccgtacggtagtacgtacgtacgttcgtacggtaccgacgtacggtacggtaacggtaccggtaacggtaccgttacgtacgggttacgtaccgtacgtacggtacggtcggtaccgggtacggtacggacggtacggtacgggaacggtaacggtacggttaccgtaagtttacggttaacgtttaacgtaacgtaactaaaccgtaacgtaaccgtaaccgttaaccgtttaaccgtttaacggtttaccgttaaccgtttaccgggttaccgtttaacccggggttaaccgtaaccggttaaacccgggtaacccggtaaccggttacccggtaccccgggttaacggggttaccccgaccggtaaccccgtaacccggtaaaccccgtacccggttaacccccttaccggtaccccttacccggttaccccgttaacccggttccccg

SEQ ID NO: 257470 - DNA, 789 bp, Homo sapiens
  misc_feature: GYAE6OF01CS3PT.51.35.D02.1.454.CMB.1.raw
  modified_base (173)..(173): a, c, t, g, unknown or other
  misc_feature (173)..(173): n is a, c, g, or t
tcagcgatcgtatacacgaccggtgctcgatttagcacacgatagttgggtttgggggtgggtccaggaggcagaactctgggtgtctcaccatcggcctaggactccctctacttcctcccctcctcactctctgcacgaggctctggacgcctctatgagctagacacgcnccaccgtcgtgactgtccgtcccgaggaccacggacggacgacggactccgacctcgcgttggtaggactgtcgacctacgttaaccgaaccgtaaaatgtaacttcgtaacttacgtacgacgacgacggaacggaccggccgaccggtccgtacggtgtggtacgtagtagtacgaacgtacgacgacggtacggacgtaccgtacggacggtaaccgtcgtacgcgtacgtacgttacgtcggtacgtcgtaccggtacggaacggtaacggaacgtaaccgtacgacgtacgtacggaccgtaacgtacggtacgggtacggtacgtacggtaacggacggaacgggaacgggacggaacggtaacgttacttaacgttaacgttaggttacgtaactaacgtaaccgtaacgtaaaccgtaccgttaacgttacgtttaagtttaacgtttacgttacggttaccgttaacggtaccgtaaccggtaacgtaaccggtacggtaacccgttaccggttacccggtaggttaacccggaacccgaacccggtaaaccccgaccgttaaaccccgacggttaaccgttacctacccgtttcccggtaaccccg

SEQ ID NO: 257471 - DNA, 504 bp, Homo sapiens
  misc_feature: GYAE6OF02HBFPL.51.35.D02.1.454.CMB.1.raw
  modified_base (497)..(497): a, c, t, g, unknown or other
  misc_feature (497)..(497): n is a, c, g, or t
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtacaatcaacagacaccattgtacttatgtcttcgaactgcgaccaaggtccaccgtcctgggtcacgcccaaggcccaaccccnctcgtcc

SEQ ID NO: 257472 - DNA, 498 bp, Homo sapiens
  misc_feature: GYAE6OF02IS5Q6.51.35.D02.1.454.CMB.1.raw
  modified_base (488)..(488): a, c, t, g, unknown or other
  misc_feature (488)..(488): n is a, c, g, or t
tcagcgatcgtatacacgaccggtgctcgatttagcacacgatagttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacacattgtacttatgttcttcggaactgcgaccaaggtcaccgtctgggtcagcccaaggccaacccnctcgtcactc

SEQ ID NO: 257473 - DNA, 508 bp, Homo sapiens
  misc_feature: GYAE6OF02JY6VR.51.35.D02.1.454.CMB.1.raw
  modified_base (236)..(236): a, c, t, g, unknown or other
  misc_feature (236)..(236): n is a, c, g, or t
tcagcgatcgtatacacgaccggtgctcgatttagcacacgatagttgggtttggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccgggcaggcccctgtgttggtgatgtataaagacactgagaggcctcagggatccctgagcgattctctggctccaggtcagggcaacggtcacagttggccatcagtggagtccgaggcagaggacgaggcgtgactattattgtcaatcaacagacaccattagtacttatgtcttcggaactgacgaccaggtacgaccgtccgtgggtcacgccgaacggccaacccgactacggtacactccg

SEQ ID NO: 257474 - DNA, 504 bp, Homo sapiens
  misc_feature: GYAE6OF02JQUGK.51.35.D02.1.454.CMB.1.raw
  modified_base (403)..(403): a, c, t, g, unknown or other
  misc_feature (403)..(403): n is a, c, g, or t
  modified_base (423)..(423): a, c, t, g, unknown or other
  misc_feature (423)..(423): n is a, c, g, or t
  modified_base (454)..(454): a, c, t, g, unknown or other
  misc_feature (454)..(454): n is a, c, g, or t
tcagcgatcgtatacacgaccggtgctcgatttagcacacgatagttgggtttggggttggggtccgaggaggcgagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcaggggacaacggtcaacattggccatcagtggatccaggcagaggacgaggtcngactattattgcaatcaacngacaccatttggacttaatgtcttcgaactnccgacaaggtcaccggtcctgggtcagcccaaggccaacccactgtcatc

SEQ ID NO: 257475 - DNA, 606 bp, Homo sapiens
  misc_feature: GYAE6OF02HDP7L.51.35.D02.1.454.CMB.1.raw
  modified_base (222)..(222): a, c, t, g, unknown or other
  misc_feature (222)..(222): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaaccgatatgcttattggtaccagcagaagccggccaggcccctgtgttggtgatgtaataaagacacgtgagaggccctcgaggggactcccgtgacgcgtattctcgtggctccgaggtcgagggaccaacggtcaactagttggccatcaggtggacgtccgaggcaggaggacggaggctaggacttagtttagttcgtactaaatccaaacacgaacctaacctagtttacggtaactttagtcgtttacgttacggtaacttggaccgtaccgtaacggttcccgacccggttcccgttaggggtacccaacggacccccgaacgggtccccaaaccccgtaccgtttacgtaccgacctttcccg

SEQ ID NO: 257476 - DNA, 518 bp, Homo sapiens
  misc_feature: GYAE6OF02FE3PK.51.35.D02.1.454.CMB.1.raw
  modified_base (241)..(241): a, c, t, g, unknown or other
  misc_feature (241)..(241): n is a, c, g, or t
  modified_base (420)..(420): a, c, t, g, unknown or other
  misc_feature (420)..(420): n is a, c, g, or t
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggccccctgtcgttggtgatgtataaagacactgagaggccctcagggatccctgagcgattctctggctcaggtcagggacaacggtcacattgccatcagtggagtccaggcagaggacgaggctgactattattgtcaatcaanagacacctattgttacttatgtcttcggaacttgccgaccgtaaggtccaacccggtcctgggtccacggccccaacggcccaaccccactcgtaccc

SEQ ID NO: 257477 - DNA, 528 bp, Homo sapiens
  misc_feature: GYAE6OF02GNZLT.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatcccgtgagcgattctctggctccgaggtcagggacaacggtcacattggccatcagtggagtccaggcaggaggacgaggctgacttattagttgtacaatcaaacagaaccaacctagtttaggtaactttatgttcttacggaacttgacgaccaggtcaccgtcctgggtcacgcccaaggcccaaccccgactcgtaccacttcc

SEQ ID NO: 257478 - DNA, 527 bp, Homo sapiens
  misc_feature: GYAE6OF02IY0OM.51.35.D02.1.454.CMB.1.raw
  modified_base (315)..(315): a, c, t, g, unknown or other
  misc_feature (315)..(315): n is a, c, g, or t
  modified_base (423)..(423): a, c, t, g, unknown or other
  misc_feature (423)..(423): n is a, c, g, or t
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctnagggatccctgagcgattctctggctcaggtcagggacaacggtcacattggccatcagtggatccgaggcagaggacgaggctaggactattattgtacaatcaaanagacacctattcggtaacttatcgtacttacggaactgacgaaccgtaaggtccaccggtcctagggtccacggtcccgaacggcccaaccccgtactcgtacc

SEQ ID NO: 257479 - DNA, 643 bp, Homo sapiens
  misc_feature: GYAE6OF02IP778.51.35.D02.1.454.CMB.1.raw
  modified_base (294)..(294): a, c, t, g, unknown or other
  misc_feature (294)..(294): n is a, c, g, or t
  modified_base (397)..(397): a, c, t, g, unknown or other
  misc_feature (397)..(397): n is a, c, g, or t
tcagcgatcgtatacacgaccggtgctcgatttagcacacgatagttgggtttggggtcgtgtgggtccaggaggcagaactctgggtgtctcaccatggcctggatccctctacttcctcccctcctcactctctgcacagctctgaggcctcctatgagctgacacagcccaccctcggtgtcagtgtccccaggacagacggccaggatccacctgctcgtggagatgccattgaccaaaccgatatgcttattcggaccagcagaagccggccaggcccctgtcgttggngatgtaataaagcactggagaggtccttgagggtactcccgtagagccgagttctcgtcggccttcccaaccgtcgacgggtaacaaacttcgggtcaacgtnttacgacctagtcaagtcggaagtccgagacgaagaacgagtacggacgtgtaacttagttctagtacctaattccttacgtaaccgtaacctattaccgtaaggttacgttaacgtttattacgggtttacccttacgggtaaccgttacggggtaaccgtaaccggttccgtaaccccgttccgttaaggtacccgtaaccgggacccccaaacggggtaccccctaacccgtaacccttccgg

SEQ ID NO: 257480 - DNA, 506 bp, Homo sapiens
  misc_feature: GYAE6OF02G20L2.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccccctgtgttggtgatgtataaagacactgagaggccctcagggatccctgagcgattctctggctccaggtcagggacaacggtcacattggccatcagtggagtccgaggcagaggacgaggctgacttattattgcaatcaacagacaccattggtacttatgtcttcggaactgcgacaaggtcaccgtctgggtcacgtcccaaggcccaacccactcgtcactccg

SEQ ID NO: 257481 - DNA, 509 bp, Homo sapiens
  misc_feature: GYAE6OF02ICU3E.51.35.D02.1.454.CMB.1.raw
  modified_base (419)..(419): a, c, t, g, unknown or other
  misc_feature (419)..(419): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgacttattatgtcaatcaacngacaccattggtacttatgtcttcggaaactgacgaccaaggtcaccgtcctgggtcagacccaaggcccaaccccactcgtccactccg

SEQ ID NO: 257482 - DNA, 509 bp, Homo sapiens
  misc_feature: GYAE6OF02HG339.51.35.D02.1.454.CMB.1.raw
  modified_base (313)..(313): a, c, t, g, unknown or other
  misc_feature (313)..(313): n is a, c, g, or t
  modified_base (504)..(504): a, c, t, g, unknown or other
  misc_feature (504)..(504): n is a, c, g, or t
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggccaggcccctgtgttggtgatgtaataaagcactgagagccctnagggatccctgagcgattctctggctcaggtcagggacaacgtcacattggccatcagtggagtccaggcaggaggacgaggctagacttattattgtcaaatcaacagacacctagtcgttacttatcgtcttcgaactgacgaccgaaggtccaccgtcgtacggcacggcccaggacccaacccagtntaccg

SEQ ID NO: 257483 - DNA, 541 bp, Homo sapiens
  misc_feature: GYAE6OF02I1XD3.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccgggccaggcccctgtgttggtgatgtataaagacactgagaggccctcagggatccctgagcgattctctggctccaggtcagggacaacggtcacattggcatcagtggagtccgaggcagaggacgaggctgacttattattgtacaatcaacacgacaaccattacggtacttatgttcgttacggaacttgaccgaccgaaggtacctacccggttccgtggggtaccacggacccaacgggcccaaacccctacgtcgtaccaccttcccg

SEQ ID NO: 257484 - DNA, 508 bp, Homo sapiens
  misc_feature: GYAE6OF02F1H8V.51.35.D02.1.454.CMB.1.raw
  modified_base (241)..(241): a, c, t, g, unknown or other
  misc_feature (241)..(241): n is a, c, g, or t
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggccccctgtgttggtgatgtataaagacactgagaggccctcagggatccctgagcgattctctggctccaggtcagggacaacggtcacattggccatcagtggagtccaggcaggaggacgaggctgactattattgtacaatcaacagacacctattgtacttatgtcttacgaactgcgaccgaaggccaccgtcctggtccacgcccaaggcccaaccctactcgtacc

SEQ ID NO: 257485 - DNA, 566 bp, Homo sapiens
  misc_feature: GYAE6OF02II28M.51.35.D02.1.454.CMB.1.raw
tcagcgatcgtatacacgaccggtgctcgatttagcacacgatagttgggtttggggctgtgggtccagggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctctggagatgcattcgaccaaaaccgatatgcttattggtaccagcagaagccgggccacggcccctgtgttggtgatgtaataaagacactgagacggccctcgagggactccctgagcgtattctctggctccgaggtcgagggacaacggtcacagttcggccagtcgaggtggacgtccgaggcaggaggacggaggctgacttaattattgtacaatcaacgagaccaactagtttcggtaactttatcgtacttacggaactcgacgaccgtaaggtccctaccggtccgtcgggtaccaccggacccgaacggaccccaaccccgtaccgtgtacccg

SEQ ID NO: 257486 - DNA, 561 bp, Homo sapiens
  misc_feature: GYAE6OF02HJ6Y6.51.35.D02.1.454.CMB.1.raw
  modified_base (316)..(316): a, c, t, g, unknown or other
  misc_feature (316)..(316): n is a, c, g, or t
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagacggccctnagggatcccgtgagcgattctctggctccgaggtcgagggacaacggtcacagttcggcatcagtggagtccgaggcaggaggacgaggctgactagttatgtacaatcaacagacacctattacggttacttatcgttacttacggaacttcggaccgtaacccgtaaaggtccctaacccggttccgttcggggtaccacggaccccgaaggacccccaacccccgtaccgtcgttaaccccg

SEQ ID NO: 257487 - DNA, 606 bp, Homo sapiens
  misc_feature: GYAE6OF02H6RWZ.51.35.D02.1.454.CMB.1.raw
  modified_base (222)..(222): a, c, t, g, unknown or other
  misc_feature (222)..(222): n is a, c, g, or t
  modified_base (238)..(238): a, c, t, g, unknown or other
  misc_feature (238)..(238): n is a, c, g, or t
  modified_base (429)..(429): a, c, t, g, unknown or other
  misc_feature (429)..(429): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaacgntatgcttattggtaccagcagaagccgggccaggcccctgtgttggtgatgtataaagacactggacgacggccctgagggacttccccgtaggacgcgtattcctacgtggctccgaggtcgaagggacaacggtcacgtagttcggcctagtcgaggtggacgtccgagggaccaagggacggaacggnggtctagaacttattagttgtacctaatacgaacagaccaacgtagttcggttaacttagtcgtttaccgtacggtaaacgttgaccgtaccgtaacggtccgaacccggttccgtacgggtccaaccggacccgtaacggacccctaaccccgtacgtacgtccctactttcccgg

SEQ ID NO: 257488 - DNA, 505 bp, Homo sapiens
  misc_feature: GYAE6OF02IE6YD.51.35.D02.1.454.CMB.1.raw
  modified_base (239)..(239): a, c, t, g, unknown or other
  misc_feature (239)..(239): n is a, c, g, or t
  modified_base (311)..(311): a, c, t, g, unknown or other
  misc_feature (311)..(311): n is a, c, g, or t
  modified_base (415)..(415): a, c, t, g, unknown or other
  misc_feature (415)..(415): n is a, c, g, or t
  modified_base (465)..(465): a, c, t, g, unknown or other
  misc_feature (465)..(465): n is a, c, g, or t
  modified_base (491)..(491): a, c, t, g, unknown or other
  misc_feature (491)..(491): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggcaggcccctgtgttggtgatgtataaagacactgagaggccctnagggatccctgagcgattctctggctccagtcagggacaacggtcacattggcatcagtggagtccaggcagaggacgaggctgactattattgtcaatcaaanagacaccattggtacttatgtcttacggaactgcgacaggtcaccgtccngggtccagcccaaggcccaaaccccnctcgtccacttccg

SEQ ID NO: 257489 - DNA, 936 bp, Homo sapiens
  misc_feature: GYAE6OF02J3Q8O.51.35.D02.1.454.CMB.1.raw
  modified_base (255)..(255): a, c, t, g, unknown or other
  misc_feature (255)..(255): n is a, c, g, or t
tcagcgatcgtatacacgaccggtgctcgatttagcacacgatagttgggtttggggctgtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggactcacctgctcgtaggagatcgctacgttcggacccaaaaccggtnttacgtcggtacctttaagttcgggtaacccagccgaacggaaccgggccccggggacccgtaaccgggtccccccgttaggtttacgggtttgggtacgtaacgttacggttaaaacgttaaacggaccgtaacggttacgggaaccggtaccgggtaccccttacgggaacggggttaacccgttacccccggtaggtaaccggccgttaacgtttcccgttacgggtcgggtacccttacccgggtaacggggttaccgaaacgggggtaacccgtaaaccggggttacctaacgtaacggttttacgggacccctaacgttaccggtaacgggttacggtaaaccgggttacccggaacggggtaaccggaaggggtaaccggggtaaccgggacgggttaccgttaacggttaaccttttaacggtttacgtttaccggtaacctaacgtaaacctaaaccggtaacgtaaccgttaaaccgttagggttttaaccggttaacgtttacgttaccggttaccgtttaccggggtaaccttacggaccccgggttaaacccgtacgggttaacccgttacccggttacccggtttaccgggaacccggtaacccggtaacccccggtaaacccggtacccccttaaccccggttacccttaccggtttaaccccccg

SEQ ID NO: 257490 - DNA, 597 bp, Homo sapiens
  misc_feature: GYAE6OF02HG480.51.35.D02.1.454.CMB.1.raw
  modified_base (407)..(407): a, c, t, g, unknown or other
  misc_feature (407)..(407): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggccaggcccctgtgttggtgatgtataaagacactggagaggccctcgagggactccctgagcgattctcgtggctccgaggtcgagggacaacggtcacagttcggccatcagtggacgtccgaggcgaggacggacggnggtactgaacttattagttgtacaatacaactagaacctacgtagttacggttacttagttacgttcgttacggtaacttcggaccgtaccgtaaggttcccgtaacccggttccgttacgggtacctaaccggaccccgtaaaccggaccccaaaccccgtacgtacgttacccgtacctttaccccgg

SEQ ID NO: 257491 - DNA, 583 bp, Homo sapiens
  misc_feature: GYAE6OF02IGPGM.51.35.D02.1.454.CMB.1.raw
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctgagggatccctgagcgattctctggctccaggtcagggacaacggtcacatttggccatcagtgagtccaggcagaggacgaggctagacttaattattgtacaaattcaaacagaccaacctagttacggtaactttagtgttacctttacgggaacttcgaccgtaaccgaacgggttaccctaacccggttcccgttacggggttacccaacggacccccgaaaccggggacccccaaacccccgtacccgttaggttaacccccg

SEQ ID NO: 257492 - DNA, 540 bp, Homo sapiens
  misc_feature: GYAE6OF02FS67O.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccggccaggcccctgtgttggtgatgtataaaagacactgagaggccctcagggactccctgagcgattctctggctccaggtcaggacaacggtcacattggccatcagtggagtccaggcagaggacgaggctgacttatattgtacaatcaacagaacaaccattacggttaactttatcgttactttcggaactgaccgaccaaggtcctaaccggtccgttgggtaccacggacccgaacggccctaaaccccgactcgtaccaccttccg

SEQ ID NO: 257493 - DNA, 531 bp, Homo sapiens
  misc_feature: GYAE6OF02FWX46.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtataaagacactgagaggccctcgagggatcccgtgagcgattctcgtggctccgaggtcgagggacaacggtcacgtattcggccatcagtggagtccgaggcaggacggacggaggctggacttattattgtacaatcaacagacaccattagtacttagtgtcttcggaactgacgacgaaggtccaccgtccgtgggtccacgacccgaggcccaaccccgactcgtcacttccg

SEQ ID NO: 257494 - DNA, 706 bp, Homo sapiens
  misc_feature: GYAE6OF02JKM40.51.35.D02.1.454.CMB.1.raw
tcagcgatcgtatacacgaccggtgctcgatttagcacacgatagttgggtttggggcgtgtgggtccaggaggcagaactctgggtgtctcaccatggcctggatccctctacttcctcccctcctcactctctgcacaggctctgaggcctcctatgagctgacacagccaccctcggtcgtcagtcgtccccaggacagacggccaggatcacctgctcgtggagatgacattcgaccaaaaccgatactgtctttagttcggtaccaagcaaggaacggcccgggacacgggtcccctggttggttcgggtgagttgtaataaacggacacgtaggacggacggcccttacggacgggtactcccgtagacggtacgtattccgtacgtcgggccttcggacggtccgaaagggtaccaacggttccagttacgttcggcctagtctacgggtggtacgtacccgagggtaccgaagggaacgggtaaccggacgggtacgtaggtactttaacgtttacgttcgttaacctaactacgaaacctaacggaacctaaccgttagtttaacggttaactttacgttacggttaacgttacggtaactccggaccgtaacgtaacgggttaccctaaccggtcccgtttcgggaaccctacggaccccgtaaccggaacccctaacccggccgttacgtacccg

SEQ ID NO: 257495 - DNA, 536 bp, Homo sapiens
  misc_feature: GYAE6OF02FX7KJ.51.35.D02.1.454.CMB.1.raw
  modified_base (239)..(239): a, c, t, g, unknown or other
  misc_feature (239)..(239): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcatttccaaaccgntatgcttattggtaccagcagaagccggccaggcccctgtcgttggtgatgtataaagcactgagaggccctcgagggatcccgtgagcgattctctggctccaggtcgagggacaacggtcacattggccatcagtggagtccaggcagaggacgaggctgacttattagtgtacaatcaacacgacaccattggtaacttatgttcttcggaactgacgtaccgaggtccaaccggtccgtagggttaccacgacccgaagggtcccaacccgtactcggctaccgtcttacccg

SEQ ID NO: 257496 - DNA, 590 bp, Homo sapiens
  misc_feature: GYAE6OF02GFXKC.51.35.D02.1.454.CMB.1.raw
tcagcgatcgtatacacgaccggtgctcgatttagcacacgatagttgggtttgggggtgggtccaggaggcagaactctgggtgtctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgtctttttggtaccatcagaggccaggccaggcccctgtatggtcatctatgagacaccagcgaccctcggaatccctgagagagtcgctggctcgaggtcagggacaagtcggcctaccgttgactactcgacgtacggacccagagtcggacgagtaggaggtgaaccgtacacgttgttacgttacgacgacgtcaagcgtaggtggtacgtacgggtaggggttaccgtcgggacgggtacggggaacggaacgtcgtacgtacccggtacgtaggacgtcgaacgcccgaacggtccgtccgtccccgtcgggtaccctacgtccgttccgtcccctaccccg

SEQ ID NO: 257497 - DNA, 620 bp, Homo sapiens
  misc_feature: GYAE6OF02HE6AE.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctcgtggagatgcattcgaccaaaccgatatgtcttattcggtaccagcagaacgccggccacggccctgtgttggtgatagtaataaacgacacgtgagacggccctgagggtactcccgtgacggcgtattcctacgtcggcctaccgaggtacgagggaaccgaacggtacaactagttcggacctagtcaggtggacgtacgaggcaggacggacgaggtacctagtaacgttaagtttacgttacgtacctaaagttaccaaacgacggaacctaaccgttagtttacggttaacgtttagttacgttcgttacggaactcggaccgacgtaacgtccaccggttcgtaggtaccacgacccaaccggaccctaacccgtacgtcgtaccctacgttcccg

SEQ ID NO: 257498 - DNA, 566 bp, Homo sapiens
  misc_feature: GYAE6OF02FO16L.51.35.D02.1.454.CMB.1.raw
  modified_base (376)..(376): a, c, t, g, unknown or other
  misc_feature (376)..(376): n is a, c, g, or t
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccaggcccctgtgttggtgatgtataagacactgagacgccctagagggactcccgtgagcgtattcctcgtggcctcccgaggttcgaggggacaacggtccacngttcggccagtcgaggtggacgtaccgaggcgaggacgggacgagggctagacttagtttagtgtacgaatacaacacgaccactagttggttaattatcgttcttacggactggaccgtacgtaacggtccgtacccggtcgttcggtaccaccggacccgaaccggcccaaccccgtacctagtaccc

SEQ ID NO: 257499 - DNA, 580 bp, Homo sapiens
  misc_feature: GYAE6OF02HD40Q.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccacccctcggtgtcagtcgtccccaggacaggacggccaggatcacctgctctggagatgcattcgaccaaaccgatatgcttattggtaccagcagaagccggccaggcccctgtggttggtgatagtaataaagacacgtggagacgggtccctacgagggactccgtagacgcgtattctcgtggtcctccgaggtcgaagggacgaacggtcaactagtcggacctatacgaggtggacgtccgaggcgaggagggacgaggctagaattaattagttgtacaaatcaacaacgaacacctagtttacgtaacttagtcgttcgttacgaatcgacgtaccgacggtccgtacggtccgtgggtccacggtcccgaacgcccaacccgtacgtacgtcctacttccg

SEQ ID NO: 257500 - DNA, 675 bp, Homo sapiens
  misc_feature: GYAE6OF02FW8OZ.51.35.D02.1.454.CMB.1.raw
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctggtctgggagatgcattcgaccaaaaccgatatgcttattggtaccagcagaacgccgggccaggcccctggtcgttggtgattgtaataaagcactgagacggccctacagggactcccgtgacgcgattcgtctggctccgaggtcgaacgggacaaaccgggtcaaccgtagtttcgggacctagtacgaggtcgggaagttcccgaagggcgaacgggtaacgggacggaacgggccttaagggtaacctttaagtttacgtttaggtaacctaaacttaccgaaacaacgtaaccaccgttacgtttacgggttaaccttttaattacggtttaccgttaccgggaacgttcggtacccgaacccgtaacgggttcccgacccgtttccggtaccgggttccgaaccggaccccgaacggtacccccgaacccctacgttccggaccttacccg

SEQ ID NO: 257501 - DNA, 628 bp, Homo sapiens
  misc_feature: GYAE6OF02HT0QY.51.35.D02.1.454.CMB.1.raw
  modified_base (261)..(261): a, c, t, g, unknown or other
  misc_feature (261)..(261): n is a, c, g, or t
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagccacctcggtgtcagtgtcccaggacagacggccaggatcacctgctcgtggagatgctattcgaccaaaccgatatgcttattgtaccagnagagcggccacggccctgtcgttgtgatgtaataaagacacgtgaaggacgccctacgagggactcccgtgacgcgtattacgtctcggtctacgtacggtcgaacgggaaccaaacggtcacgtagtttggacctaatcgaggttacggacgtccgaaggcgtaaggacgggaacgaacggtcgttacggtaaacttagtttaagttacgtaactaaatactaaaacgtaagaaccctaacttaacgttagttacttaagtcgttaccgttacgtaacgtacgtacgaaccgtaacggtacctaccggtaccgttacggtcgtacggtacccgtaaacggaccctaacccgtaccgttacgtaccg

SEQ ID NO: 257502 - DNA, 641 bp, Homo sapiens
  misc_feature: GYAE6OF02H5O0V.51.35.D02.1.454.CMB.1.raw
  modified_base (512)..(512): a, c, t, g, unknown or other
  misc_feature (512)..(512): n is a, c, g, or t
tcagcgatcgtatacacgaccggtgctcgatttagcacacgatagttgggtttgggggtgggtccaggaggcagaactctgggtgtctcaccatggcctggatccctctacttcctccccctcctcactctctgcacaggctctgacggcctcctatgagctgacacagcccaccctcggtgtcagtcgtccccaggacacggacggccaggactccacctgctcgtggagatgctattcgcccaaaccctacttacgtttcttaagttcggtaaccagacaagaaacgccacggccgacggcccctgttgtttgtgtataactaataaagacactgagacgccttagaggtactccgtagacgtctacgttctcgtcgtctcctaaccgtcgaacgggtactagtacgtacactacgttcgaacctagtacgagttacggacggtccaggtacgagaacgacggagtctaggtactttagttctaggttactaacttcttacgaagtactnttacgtacgttacgtttaacttgtacgttacgttacggacgttacgggtaaccgtacggtcctaccggttacgtacggtaccgaccgaccgtaaccggaccctaacccggtacttccggtactacccgg

SEQ ID NO: 257503 - DNA, 723 bp, Homo sapiens
  misc_feature: GYAE6OF02HFLY8.51.35.D02.1.454.CMB.1.raw
tcagcgatcgtatacacgaccggtgctcgatttagcacacgatagttgggtttgggggtgggtccgaggaggcagaactctgggtgtctcaccatggcctggatccctctacttctcccctcctcactctctgcacaggctctgaggcctcctatgagctgacacagcccaccctcggtgtcagtgtccccaggacagacggccaggatcacctgctcgtggagatgcattcgaccaaaccgatactgacttattggtaccagacagaacgccggccgtaggccccctgtcgttggtgtagtgtaagtaaacgacaacgttgacgacggtcccctagacgggactcccgtacgagacggtatccgttcgtacggtcctaccgagggttacgaacggggaaccgtaacggtacgtaacgtaagtttcgggcctaacgtaccgtaacggtggtacggtccgtaacgggacggacggaacgggacgggacgggtccgtaggtaaccgtttaatttacgtttacgtacctaaagtacccgaaactaacggaaacccttaacgtacggtttaaccgttacgtttaacgttagttaccggttaccggttaacgtacgtaccggtacccgtaaacggttcccgtacccggttacccgtcggggtacccgttaaccggccccgtaaacgggccccctaacccccgtacgtacggtaccgtacccttacccg

SEQ ID NO: 257504 - DNA, 519 bp, Homo sapiens
  misc_feature: GYAE6OF02F74VI.51.35.D02.1.454.CMB.1.raw
  modified_base (412)..(412): a, c, t, g, unknown or other
  misc_feature (412)..(412): n is a, c, g, or t
tcagcgatcgtatacacgaccggtgctcgatttagcacacgatagttgggtttgggggtgggtccaggaggcagaactctgggtgtctcaccatggcctggatccctctaattctccccctcctcactctctgcacaggctctgaggcctcctatgagctgacacagcccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctgagggatccctgagcgattctctggctccgaggtcagggacaacggtcacattcggccatcagtggagtccgaggcaggaggacgaggctgacttattnttgtacaatcaacagacaccgattgtacttatgttcttggattgcgacaggtcaccgtcgtcgggtcacgcccgtaacggcccaaccccgactcgtaccacttcccg

SEQ ID NO: 257505 - DNA, 723 bp, Homo sapiens
  misc_feature: GYAE6OF02HVRO0.51.35.D02.1.454.CMB.1.raw
  modified_base (227)..(227): a, c, t, g, unknown or other
  misc_feature (227)..(227): n is a, c, g, or t
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtcgtcccaggacaggacggccaggatcactgctctggagatncattcgaccaaaccgattatgtacttagttcggtaccagcaaggaacggcccgggaccacgggtcccctggttcggttggtacgtattaggttaataaaacggactactaggagacggccctagacgggtactcccgagacgacgtacgttctacgtggtcctaccgaggtacgacgggtaacgtacggtacacgtacgtttcgacctaacgtcgtaagggtcggaacgtacccgagggaacagggacgggacgacgggtactacggttaacttaagtttagttacgtaactaaacgttacaaaacgtaacgtaccctaaacgttaacgtttacgggtaacttttacggtacgttaaccgtttacgggaacttccggtaccggtaacccggaacgggttacccgtacccgggttacccgttacggggttacccgaacccggtaaccccggtaaacccgggaccccccctaaacccgttcggttaccgtaaccccgg

SEQ ID NO: 257506 - DNA, 581 bp, Homo sapiens
  misc_feature: GYAE6OF02I69CQ.51.35.D02.1.454.CMB.1.raw
  modified_base (478)..(478): a, c, t, g, unknown or other
  misc_feature (478)..(478): n is a, c, g, or t
  modified_base (537)..(537): a, c, t, g, unknown or other
  misc_feature (537)..(537): n is a, c, g, or t
  modified_base (574)..(574): a, c, t, g, unknown or other
  misc_feature (574)..(574): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtccagtcgtccccgaggacaggacggccaaggatcacctgctcgtggacgatgacattcgaccaaaccgtatatgtacttattcggtaccagcaaggaacgccggaccgacggccccttgtacggttggtgtataggtaataaaaggacacgttaggagacggaccctagacgggactccgtagacgcgtacttcgcgtagcctccgagggtcgaaggacaacgtcaactagttcggccagtcgagtcggacgtcaggcaaggtaggacgagccagtacttaatttagtgacaatcaanacgacacgtattcgtaattagcttacggtacgactgaccgtactaggtccaccgttcgnggtaccacgtccgaaccgccctaaccctgtactaccncttcccg

SEQ ID NO: 257507 - DNA, 731 bp, Homo sapiens
  misc_feature: GYAE6OF02HWSMJ.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctcggtgtccagtcgtcccaggacagccggccaggatccacctgctcgtaggatatgctattcgacccaaaacgatatgtacttagttcggtaccagcaagaacggcccggaccaacgggccccttggttggttcggtagtaatggtaaataaaacgacacgttggaagacggtcccgtagaggactccgagagccgtattcgctcggctacggacggtacgaacgggaacacggtcaacgtacgtttcggacctacgtcgacgggtacgggaacgttacccgaagggacgaagggaacgggacgtacggacgttagaacgttaaattttacgttaggttaactaacgtaaccgaaactaacgaaccctaacgtaagtttacgggtttaactttaacgttgtttaccggttaaccggtaacggttaccgaaccgtaaccgttaaaccgggttccgtaacccggttacccggttcgggggtaaacgtaacccgtaaccccggtaacgggacccccctaaaccccgtaaaccggttccgtaccctaacccggtttacccg

SEQ ID NO: 257508 - DNA, 663 bp, Homo sapiens
  misc_feature: GYAE6OF02HFXIZ.51.35.D02.1.454.CMB.1.raw
  modified_base (243)..(243): a, c, t, g, unknown or other
  misc_feature (243)..(243): n is a, c, g, or t
  modified_base (624)..(624): a, c, t, g, unknown or other
  misc_feature (624)..(624): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcactgctctggagatgctattcgaccaaaaccgntatcgtcttattcggtacagtcagaacgccgggccacggcccctgtcgttggtagtacgtagtaataaaacgacacgtgaaggacggccctacggacgggtactcccgtagacggacgtattccttacgtcggtacctccggaacggtcgaacggggtaaccgtaaacgggttacaacgtacgttcggacctacgttacggaaggttcgggaccgttaccgaagggtacggaaggacgggaacggagggtacctaggaacctttaagtttacgttcgttactaacgttacaaaccgtacgaacctaaccgttagtttacgtactttagtcgttacgttacggaacttcgaccgtacgacggtccgtaccgtcgtcggtacnccgtaccgacggacccaaccctagtcgtacctactcccg

SEQ ID NO: 257509 - DNA, 703 bp, Homo sapiens
  misc_feature: GYAE6OF02JB372.51.35.D02.1.454.CMB.1.raw
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagcccaccctcggtgtcagtcgtccccagacagacggccaggatcactnctctgganatgctatcggacccaaaccgtataactgtaccttagttacggtaaccagacgaagaacggcccgggccgacgggtacccccgttggttcggttggttacgagttgtaaataaacgacacgtagacggacggtcccgtacgaggactccgtaggacgacggtacttcgtacgtggtacctacgacggtacgacgggaacacggtactacgtacgtttcggactaagtcgtaggtacggtaccggtccgtaacggacgaaaggacgggaacggacggtactagacctttagttaacgttcggttaacaacgttaaccaaacggtaactaaccgtaacgtaagtttacggttacctttaagtaccgttacgttaccggtaagtcgaacggtaacccgtaaggtccgtaaccggttaccgggtacggtaccgaaccggtacccgaaacccggtaaccccgtaaccccgtagttccgtaacccg

SEQ ID NO: 257510 - DNA, 718 bp, Homo sapiens
  misc_feature: GYAE6OF02IBOHI.51.35.D02.1.454.CMB.1.raw
tcagcgatcgtatacacgaccggtgctcgatttagcacacgatagttgggtttgggggtggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgcttattcggtacagcagaagccggccagccctgtgttggtgatgtaataaacgacacgtagacgacggccctagaggactccctgagcgtattctcgtggcctcgaggtcgagggaacctacgggtacaacgtaagttcggacctacgtacgtaggtacgggtaaccgttcccgaagggaccgaagggaaacggggaacggtaacggggacccttaggtaaaccgtttaagttttaacgtttaggtaacccttaaaagttacccaaaacggtaacggtaaacctaaacccgttagttttaaccggggtttaactttaacgtttcgtttacccgttaacgggaacctttcggaacccgtaaccgtaacgggttcccgaaccccggttccgttacggggtacccgaaccggacccccgtaaaccggacccccctaaacccccgtaacgttcccgttacccgtacccgtttccccgg

SEQ ID NO: 257511 - DNA, 557 bp, Homo sapiens
  misc_feature: GYAE6OF02IYRDE.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaaccgatatgcttattggtaccagcagaagccgggccaggcccctgtgttggtgatgtataaagacactgagcggccctcgagggactcctggagcgtattctcgtggcctccaggtcgagggacaacggtcacagttcggccatcgagtggagtccgaggcaggaggacgaggctagacttattattgacaatacaacagaccactatttagtaacttagttcgttcgttacgaactgaccgaccgtaacggtccgtaccggttcctgggtaccacgtacccgaacggaccccaacccgtacgtcgtccctacttcccg

SEQ ID NO: 257512 - DNA, 533 bp, Homo sapiens
  misc_feature: GYAE6OF02FLGRF.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgggagatgcattcgaccaaaaccgatatgctttattggtaccagcagaacgccgggccaggcccctgtgttggtgatgtataaagacactgagaggccctgagggactcccctggacgcgtattcctcgtggctccgaggtcgagggacaacggtcacagttcggccatcgagtggagtccgaggcagaggacgaggctgacttattattgtacaatcaacagacactagttagtacttatgtcttacggaactgaccgacgaagtccgaccgtccgtgggacacgaccacggacccaaccctatcgtcactccg

SEQ ID NO: 257513 - DNA, 733 bp, Homo sapiens
  misc_feature: GYAE6OF02F81IK.51.35.D02.1.454.CMB.1.raw
  modified_base (180)..(180): a, c, t, g, unknown or other
  misc_feature (180)..(180): n is a, c, g, or t
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctcggtntcagtcgtccccaggacagacgccaggatcacctgctctgganatgcattcgaccaaacgntatgtacttattggtaccagacaagaacgcccgggccacggcccctgtcgttggtgatgtataaagcactgagacggccctcgagggactcccgtagacggtcgacttcgtcgtcggtcctccgacggtacgaagggtaccaaacggtccaactacgttcgacccctagtcgtaggtacggacgtacccggaaggaccgaacgggaacgggaacggggacgggtaccgttacggtaaacctttaatttacgtttacggtaacctaacgttaaccaaaaccgtacgaaacccgtacccttaagtttacggttaaactttacgttacgttacccgttttaaccggaaaccgttcggtaacccgtaacccggtaacgggttacccgtaacccgggttcccgttacgggggtaaccctaaccgggaacccccgtaaccgggtaaccccctaaccccccggttaacgttaccgttacccgtacccttttacccccgg

SEQ ID NO: 257514 - DNA, 663 bp, Homo sapiens
  misc_feature: GYAE6OF02FK7ZN.51.35.D02.1.454.CMB.1.raw
  modified_base (179)..(179): a, c, t, g, unknown or other
  misc_feature (179)..(179): n is a, c, g, or t
  modified_base (240)..(240): a, c, t, g, unknown or other
  misc_feature (240)..(240): n is a, c, g, or t
  modified_base (345)..(345): a, c, t, g, unknown or other
  misc_feature (345)..(345): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtntcagtgtccccaggacagacggccaggatcacctgcctctggagatgcattgccaaaccgntatgcttatgtaccagcagaagccgggccaggcccctgtgttgtgatagtactaaagacacgtgagacggtccctcgagggtactcccgtggacgcgtatttccnctcgggcttccgaggtcgagggaccaacgggtcacagttcggaccctaagtccgtaaggtggacgtcccgaagggtcaaggacggaccggacgggcttaggtaacgttaatttagttgtaacaattccgaaacctaaggtaactaaccgttaagtttacgggttaactttagttacgttaaccgttacggaaacttcggaccgtaacccgtaaggtcccgtaacccggttcccgttacggggtaccctaaccggtacccccgaaacgggtacccccgtaaaaccccctaccgttaccggtaccctacgtttacccccg

SEQ ID NO: 257515 - DNA, 601 bp, Homo sapiens
  misc_feature: GYAE6OF02G64AP.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgctattcgacccaaaaccgatatgcttattggtaccagcagaagccgggccacggcccctgtgttggtgagtgtaataagacacgtgagacggccctgacgggactcccgtgacgcgtacttctctcggtctccgaggtcgacgggactaacggtcactagttcggaccatcgagtggacgtaccgaggcaggacggacgaggctggacttagtttagttcgtacatacaacacgacaacctagttcgtactttacgtgttccgttacggaaccttcgaccgtaccgtaacggtccctaaccggtccggttacgggtacctaccggacccctaaccggaccctaaacccccgtacgttcgtacccgtaccttcccg

SEQ ID NO: 257516 - DNA, 755 bp, Homo sapiens
  misc_feature: GYAE6OF02H847U.51.35.D02.1.454.CMB.1.raw
tcagcgatcgtatacacgaccggtgctcgatttagcacacgatagttgggtttggggctgtgggtccaggaggcagaactctgggtgtctcaccatggcctggatccctctacttctccccctctcactctctgcacaggctctgaggcctcctatgagctgacacacgcccaccctcggtgtacacgtcgtaccccgaggaccaggacggcccaggactccacctgccttcgtggagatgactattcgaccaaaccgattagtcgtactttagttcggtaccagtcaaggaacggcccgggaccacggtccccgttaggttggttcgggtgtacttagtaaacgtaaacgacctaacgtaggaacggtaccggcccgtacggaacgggtactcccgtaggacgtacgttacttccggtcgtcggtaccttacccgacgggttaccggacggggtaacctaaccgggttccaaccgttagttcccgggaccttagtaccggtacggtacgggaccggttacccggaaggcggaacgggtaacgggacgggtaacggtccgttacgtaacgtttaagtttacttacggtaaccttaacgtaaccgaaaccgtacgtacctaaccgttagtttacggtttaacttacggttcgttacgttacggtactacggaccgtacggtaccggtaccgtaccggtccggtaacggtcccgacggtacccgaaccggacccctaaccgtacggttacctacccg

SEQ ID NO: 257517 - DNA, 729 bp, Homo sapiens
  misc_feature: GYAE6OF02GSIQC.51.35.D02.1.454.CMB.1.raw
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
tcagcgatcgtatacacgaccggtgctcgatttagcacacgatagttgggtttggggctgtgggtccaggaggcagaactctgggtgtctcaccatggcctggatccctctacttctcccctcctcactctctgcacaggctctgacggcctcctatgagctgacacacgccacccgtcggtgtcaggtcgtccccaggaccagacggccaggactcacctgctcgnggagtatgctnttacgacccaaaacgtatactcgtctttaagttcggtacctaaggacaacgggaacggcccgggaccgaaccggtccccgttcggttggtttacgggtagtaagttagttaaacgtaaaacgtactaacgtaggaacgggaaccggtccccgttacggaacggggtacctacccgtaggtacgtaccgttacgttccgtcgtacggtccgtacccgtaacggtaccggacggggaacgtaaacccggtcgaaccgttagttacggacctaagtcgtaggtagggaccgtccggaaggacgaggtacggaacggtcgacgttaagaactttaagttgtacgtaacgtaacaccgtaaagacgtaacctactagtttacgtacgttacgttacgtccgttaacggacttacggacgtaaccgtaacgtccgtaacccgtcggtacggtaccggaaccgacccgaaccgcccctaacccgacgttcgtaacccg

SEQ ID NO: 257518 - DNA, 767 bp, Homo sapiens
  misc_feature: GYAE6OF02G898U.51.35.D02.1.454.CMB.1.raw
  modified_base (271)..(271): a, c, t, g, unknown or other
  misc_feature (271)..(271): n is a, c, g, or t
  modified_base (520)..(520): a, c, t, g, unknown or other
  misc_feature (520)..(520): n is a, c, g, or t
tcagcgatcgtatacacgaccggtgctcgatttagcacacgatagttgggtttgggggtgggtccaggaggcagaactctgggtgtctcaccatggcctggatcctctacttcctcccctctcactctctgcacaggtctctgacggcctacctagtgagtctcgacacacgcccacccgtggtactcagtccgtacccgaggacaggaccggcaaggtactcctacctggacttcggtgggatatcggctattcggaaccaaaacgtatntcgtactttagttacggtaccagcgaacggaacggcccgggccgacgggtccccgttgttcggttacggtgtagttaggttaaactaaacggaactacgtaggacgtacggcccgttacgagggtacctccgtaggacgtcgtcttacgtgtcggtcacggtacgtacggacggacgtaacgggtacaacgttgtcggtaaccacgtacggtaggtacgtacgtaccgacgggaacgtaggaaacgggnggtcggacgtcgtaaacgttattacgttagaaaccgtttacaacgaaccgacgtaacccgtaagttagtttaccggtaactttaacgtcgggtttacctaaacggtttaacgccggtaaaccggtaccgttaaccggttacccgtaacccgggttccggttaaaccgggtccgaaacccggtacccggtaaacccggtaccccctaaaccccggtacgggttttacgtacccacccggtttaccccg

SEQ ID NO: 257519 - DNA, 833 bp, Homo sapiens
  misc_feature: GYAE6OF02HCEW4.51.35.D02.1.454.CMB.1.raw
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagcccaccctcggtgtcagtcgtccccgaggacagacggccaggactcacctgctctggagatgactattcgacccaaaaccggattaatcggttactttagtttacgggttaaccaacgaccgaaggaaacggccccggggacccgtaaccgggccccccgttggttggtttggggtggtagttacggtaataaaacggtactaaccgttaggaacgggaaccgggccctaccggtaagggtaccgttaccccgtggtaacggtaccgttatttaccgtcgtccgggtcccttacccgtacggggtaccggaaacggggtaacccgaaaccgggttaccaacggtacgtttacggacctaacgtacggtaacgggttcgggaacgttaccggaacgggtacgaagggtaaccgggaacggtacgggacttaacgggtaccgtttaaattacgtttaacgtactaaaacttacgaaacgaacccggtaacctaacccgttaagttttaccgggttaaactttggtttacgtttaacgttacgggtaaccttacgaacccgggtaacgtaaccgggtttaccgtaacccggttacccggttaccggtccgtaaccccggaacccggtaaccgggtacccccaaccccccgtagttaccgttaccccg

SEQ ID NO: 257520 - DNA, 774 bp, Homo sapiens
  misc_feature: GYAE6OF02GFV21.51.35.D02.1.454.CMB.1.raw
  modified_base (250)..(250): a, c, t, g, unknown or other
  misc_feature (250)..(250): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatccacctgcctcgtggagatgactattcgacccaaacgtntactgtcttattcggtaccagcaaggaacggcccgggcccgacggtcccccgtggttggttgggtagtagttaggtaaataaacgaccgtaccgtaggacggacggtacccgtacgaagggtactcccggtaggacgtaccgtacgttccgttccgttcggggtcctaccggtaacgggtcggaacgggtaaccgaaaccgggttccaacggttacgttccgggtacctaagttcgtaggtacgggtaacgttacccggaagggtaccgaagggtaaccgggaacgggtaccgggtaccgtaacggttaaccgttttaagtttacgtttacggtaaacgttaaacgttaccaaaacggtaacgaacccgttaccgttaagttttaccggttaactttacgttacgtttccgttaccgtaacgttaccgaccgtaccggtacggtacccgttaaccggtcgttcggacccgtacggtaccccgaaccgaccccgtaaaccctcgtaccgtacctaccgttccccg

SEQ ID NO: 257521 - DNA, 617 bp, Homo sapiens
  misc_feature: GYAE6OF02FME8T.51.35.D02.1.454.CMB.1.raw
  modified_base (244)..(244): a, c, t, g, unknown or other
  misc_feature (244)..(244): n is a, c, g, or t
  modified_base (290)..(290): a, c, t, g, unknown or other
  misc_feature (290)..(290): n is a, c, g, or t
  modified_base (577)..(577): a, c, t, g, unknown or other
  misc_feature (577)..(577): n is a, c, g, or t
  modified_base (606)..(606): a, c, t, g, unknown or other
  misc_feature (606)..(606): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccacctcggtgtcagtgtccccaggcagacggccaggactcacctgcctcgtggacgatgccattcgaccaaaccgntatggcttatggtaccagcagaagccggccaggtcccctgtgttgngtagtgtataagacacgtgacgacggccctactagggactcccgtagacgtcgtacttccgtcgtacggtccttaccgacgggttcgaacgggtactaaaccgggttccacgtagttcggtaccctagttcgaaggttcggaacgtccgaggtactaggaacggacgtacggccgtagtacgtaattacgttacgttccaaatcgaaacgtcgaccaccttagttacggtacttacgttacgttaccgtacgtaccgtgtaccgtactaacggtccgtaccgtccgnggtccacgtacccgtagccctaacccgtncgtctactccg

SEQ ID NO: 257522 - DNA, 660 bp, Homo sapiens
  misc_feature: GYAE6OF02GERZT.51.35.D02.1.454.CMB.1.raw
  modified_base (243)..(243): a, c, t, g, unknown or other
  misc_feature (243)..(243): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatccaccgtgctctggagatgcattcgaccaaacgntatcgtcttagttggtaccagcagaacgccggcgacgccctgtgtgtnatgtanaagacactgagacgcctagaggtactccgtggacgcgtattcctcgtcggtcctccgtaggtcgaacgggaactaacggtacacgtaggttacgcctagtacgtaggtacgggtacgtccgtaggacgaaacgggacgggtaacggaacgggtctacggtaactttaacgtttagttacgtaactaaacgtaccgaaacaacgaacctaacgttagtttacggttaactttacgttcgttaccgttacggtaaccgtacgtacccgtacgtacgtaccggtacccgttccgtacgggtaccacccggtaacccgacccgggtaacccctaacccgtacgttacgtacctacccgtttaccccg

SEQ ID NO: 257523 - DNA, 737 bp, Homo sapiens
  misc_feature: GYAE6OF02G5B8X.51.35.D02.1.454.CMB.1.raw
  modified_base (481)..(481): a, c, t, g, unknown or other
  misc_feature (481)..(481): n is a, c, g, or t
  modified_base (510)..(510): a, c, t, g, unknown or other
  misc_feature (510)..(510): n is a, c, g, or t
  modified_base (533)..(533): a, c, t, g, unknown or other
  misc_feature (533)..(533): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactccacctgctcgtggagagtgctattcgacccaaaccgatatgtcttattggtaccagacaaggaacggccgggccacggtccccgttggttcgttgggtacgtagttaggtaaataaaacggactacgtaggaacggtcggacccctgaacggggtacctcccgtaggacggccgtaatttcctcgtcggaccttccggaacggtccgaacgggacgtaacggtacaacgtagttaccggacctagttcgaggttacgggacgtaaccggnggacgaaggtaaccggggacggtaacggngttacgaacgttattacggttanacgtaaactacaacggactaacgtaaccttaagtttaggttaccttaacgtttcgtaccgttaaccgtaaccgttacgacccgggtaacctaacgggtttcccccggaacggttaccccggtacgggtacccgaacccggtaaccccggaaaccggtacccccaaaccggttacccgtacccggttacctaacccggtttcccc

SEQ ID NO: 257524 - DNA, 786 bp, Homo sapiens
  misc_feature: GYAE6OF02JUHVN.51.35.D02.1.454.CMB.1.raw
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgaggcctcctatgagctgacacagcccaccctcggtgtcaggtcgtcccccgagggacaggacggccgaggatccacctgcctcgtggagatcgactacgttcgacccaaaaccgtatagtcgtactttagttacggtaaccaggacacggaaccggtcccgggacccgacggtcccccgtggttaggttgggtgtactagttaagtaaacgacgtacgtagaacggtacggaccccgtacggacgggtaaccttcccgtagtaacgggtaccgtacgttcctttacgtccggttacccgttacggaaccgggttcggaaaccgggggtaaccgtaaccgggtttaccaccggttacgtttaccgggaccctaggttacccgtagggtacgggttaccgaccgggtacggaacgagggtacggaacgggtacgacgttgaacgtttagtacgttagtaacattaccaaacgacgtaccgaaacgttcgttaacggttacttacgtacgtttaccgtaccgggttaacgttacggacccggttaacggaacggtttacccggaccgtttaccccgggtggtaacccgtaccggtaaccccggtaacccggtaacccctaacccgtccgtttaccgtaacccg

SEQ ID NO: 257525 - DNA, 664 bp, Homo sapiens
  misc_feature: GYAE6OF02HABML.51.35.D02.1.454.CMB.1.raw
  modified_base (223)..(223): a, c, t, g, unknown or other
  misc_feature (223)..(223): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctcgtgganatgactattcgacccgaaaccgatatcggtacttagttcggtaccagacaggaacggccggaccacggtcccctggtggttggtgatgtaataaacgtacacgtggacgacggccctgacgggtactcccgtagacgacgtacttccgtcgtcggctccgtaggtacgacgggaactaacggtacacgtagttcggacctagttccgaggtcggtaacgtccgaacgggtcgaagggacggaacggcggtacgtaggtactttaatttacgttccgttaagaacttaacgaaccgtaacgtaaccaccttagttacgggtttaactttacgttcgttacgttacgtaaccgtcgtaccggaaccttaacgggtcctacccgggtaccgttcgggtccaccgacccgtaaccggaccccaccctacgtctccaccgttcccg

SEQ ID NO: 257526 - DNA, 666 bp, Homo sapiens
  misc_feature: GYAE6OF02JF57M.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccacccgtcggtgtcagtcgtccccaggacagacggccaggactcacctgctctggagatgctattcgaccaaaccgatatgtcttagttcggtacagcagaacgccgggaccagggtcccctgttacggttggtgtacgttaggaaataaaggaccaacgtggacggacggtcccctaggacggggtactcccggtagacgtccgtatttcgtccgtggccttaccgacgggtcgacgggtaccaacggtcaaccgtgttacggcctatccgtaggtcggacgttccgaacgggcaagggacggtaacgacggactgtaacttattagttcgaacctaatacgacaaggtaccaacttacgttacgttaacgttttacgcgtttacgtttaacggaacgttcgaaccgtacgtaacggtcctacccggttacggtacgggtacaccggtaacccacggtaccctaaaccccgtgttccgtacccgtaccgtttcccg

SEQ ID NO: 257527 - DNA, 807 bp, Homo sapiens
  misc_feature: GYAE6OF02G0I3T.51.35.D02.1.454.CMB.1.raw
tcagcgatcgtatacacgaccggtgctcgatttagcacacgatagttggggtttgggggtgggtccaggaggcagaactctgggtgtctcaccatggcctggatccctctacttctccccctcctcactctctgcacaggctctgacggcctcctatgagctgacacagcccacccgtcggtgtcacggtcgtcccccgaggaccaggaaccggccaggatccacctgaccttcgtggagatcgacattcgaccaaaaccgtatatcgtacttagttggtaccagacaaggaacgccggcacggtcccctagtcggttggtgtaagttagtaacgtaaaacggactacgtaggtacggacggtccccttaggaacgggtactaccccggtaggtaacggccgttaagtttcctacgtcgggtaccttccggaacgttacgggaacgggtaaccgaaccggtacgtaactaggttacggaccctaaggtacgtacggttaacgggaccgttccggaacggcggtaacggaacgggaacggtcggtacgtacgttaacgttacgtttacgtttacggtaacctaaacgttaaccgaaaccgaacggtaacccgaaccgttaacggttttaacgttaaaccgtttacgtttacggttacccgttaaacgggtaacgtaccggtaaccgtaacccgggtaacggttacccggtaaacccggtttccggttacggggttaacccgaaccggtaaccccgaaaccgggtacccctaaaccccggtacttaccgggttaccctacggttacccc

SEQ ID NO: 257528 - DNA, 660 bp, Homo sapiens
  misc_feature: GYAE6OF02I12WL.51.35.D02.1.454.CMB.1.raw
  modified_base (135)..(135): a, c, t, g, unknown or other
  misc_feature (135)..(135): n is a, c, g, or t
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
  modified_base (567)..(567): a, c, t, g, unknown or other
  misc_feature (567)..(567): n is a, c, g, or t
  modified_base (621)..(621): a, c, t, g, unknown or other
  misc_feature (621)..(621): n is a, c, g, or t
  modified_base (643)..(643): a, c, t, g, unknown or other
  misc_feature (643)..(643): n is a, c, g, or t
tcagcgatcgtatacacgaccggtgctcgatttagcacacgatagttgggtttgggggtgggtccaggaggcagaactctgggtgtctcaccatggcctggatccctctacttctcccctctcactctctgcacnggctctgacgcctctatgagctgacacacgcccacccgttggtgtcagttcgtccccaggaccaggaccggccaggtactccaccgttgacttcgtgggatctgcctattcggaacccaaacgtatagtgtacttattcggaccagcaagaacggccggccncggtccctaggtgttacggtnagtgtaataacgacgtacgtgaacggtacggccctagaacggtctccgtaagcgcgttactctcggtgccttcgacggtacgaggacctacggctaatcgtacgcaacgtccgtaggttacgacgtccgtaggacgtaacggcggaagcggtacgtaggttaaacctggttttacttaacggttaacaaccgttaacaaaccggttacaaaccgtcgttaaggtttacgtaccgtttaagtccggtttntaaccgggtaactcgaccgtaccgtacggtcccgtaaacgtcgtacgggtaccncgaaccgtaccgactaccccgntaccggtctaccgtccg

SEQ ID NO: 257529 - DNA, 845 bp, Homo sapiens
  misc_feature: GYAE6OF02HB04B.51.35.D02.1.454.CMB.1.raw
  modified_base (182)..(182): a, c, t, g, unknown or other
  misc_feature (182)..(182): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgacggcctcctatgagctgacacacgcccaccctcggtntcagtccgtccccgaggaccaggaccggccaggatccacctgcctcgtaggacgtatcgactagttcgaccctaaaaccgattacgtcgttactttaagttcggtaaccagacgaacggtaaccggcccgggacccgtaccggtacccccgttgggtttcggttacgggtagtacgttaggtaaacttaaaacggacctacgtacggacggtaccggtaccctaggacgggtaccttaccggtaggacgtacgttacgtttcctaccggtcgttacccgtacggtaacggtaccggaacgggtaaccgtaaccggtacgtacgttacggttacggacctacgttacgtacgggttcgtaaccggtaccgaacgggaaccgagggaaccgggtacggacgggtacgtacgttaacgtttaacgtttacgttacgtaactaaccgtaacaaaccgaccgtaacgttaccgtaagtttaccggttaacctttagttaccgtttacccgggttaacgtaaaccggttccgtaacccggtaccgttaacgggtaccccggttaaacccggtttaccgggtcgggttaaacccgcccggtaaaccccggaaccccggaaccccgttaacccgtcccggtttaaccgtacccgttacccggtttaccccc

SEQ ID NO: 257530 - DNA, 833 bp, Homo sapiens
  misc_feature: GYAE6OF02IREQ4.51.35.D02.1.454.CMB.1.raw
  modified_base (234)..(234): a, c, t, g, unknown or other
  misc_feature (234)..(234): n is a, c, g, or t
  modified_base (262)..(262): a, c, t, g, unknown or other
  misc_feature (262)..(262): n is a, c, g, or t
tcagcgatcgtatacacgaccggtgctcgatttagcacacgatagttgggtttgggggtggtccaggaggcagaactctgggtgtctcaccatggcctggatccctctacttctccccctctcactctctgcacaggctcgtgacggtcctcctatgagctgacacgacgcccacccgttggtgtcagtcgtcccaggacaggacgccaggactccaccgttgcctcgtagganactcggactagttcgaacccgtaaacgnttacgtcgttacttacgtttcggaaccagtaccgaacggaacggtcccggaccgaccggtccccttggtttacggttaggttaggtaacgttacggttaaaacgtaaaacggtacgtaacggtagggaaccggtaccggtacccttacggaacgggtaccttccgtaggacggttacgtacgttccgttacggtaccggtaccgtaccgtacggttaacggaccggggtaaccgtaacggtaccgaccgttaggttaccggacccttaagtaccggttagggtacgggtaaccgttaccggacggaggtaacgggtaaggtaaccggtacgggttaccgtagttaaccgtttaagtttacgttaacgtacgttaaacgtaccgaaacgttagaacccttaacgttacgttttacgggttaactttaggtaccgttttaccggttaacgtaccgtaccgttacggaacccgttacgtaccggttcccgttaaccgggtacggttacccgaaccggtaacccgaaacccggtacccgtaaccccgtacgtacgttaccccgtactttaccccg

SEQ ID NO: 257531 - DNA, 601 bp, Homo sapiens
  misc_feature: GYAE6OF02FYLHP.51.35.D02.1.454.CMB.1.raw
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
  modified_base (247)..(248): a, c, t, g, unknown or other
  misc_feature (247)..(248): n is a, c, g, or t
  modified_base (310)..(310): a, c, t, g, unknown or other
  misc_feature (310)..(310): n is a, c, g, or t
  modified_base (554)..(554): a, c, t, g, unknown or other
  misc_feature (554)..(554): n is a, c, g, or t
tcagcgatcgtatacacgaccggtgctcgatttagcacacgatagttgggtttggggctgtgggtccaggaggcagaactctgggtgtctcaccatggcctggatccctctacttctccccctcctcactctctgcacaggctctgacggcctcctatgagctgacacagcccaccctcggtgtcagtcgtcccagacagaccggcagatcacctnctctgganatgcattcgaccaaaacgatatnnttagtggtaccagcaagacgcggccacggccctgtgtgtgagtagtaataaagacagtaganacggcctcgaggtactccctgacgcgtattcctgtcgctaccgaggtacggaagggaacctaacggtccagtacgttcgacctaatcgagtacgggactaccggtaggacgacggaagggacggacggactacggaacctttaaattcgttacgtacgtaaattaccgaaacgtaacgactaacctagtttaggttacttaattcgttacgttacgactagaccgaagttacggcttacccggngtacggtaccaacggtacccgaaccgccccaacccgtgtacctaccg

SEQ ID NO: 257532 - DNA, 785 bp, Homo sapiens
  misc_feature: GYAE6OF02HDCXH.51.35.D02.1.454.CMB.1.raw
  modified_base (216)..(216): a, c, t, g, unknown or other
  misc_feature (216)..(216): n is a, c, g, or t
tcagcgatcgtatacacgaccggtgctcgatttagcacacgatagttgggtttgggggtgggtccaggaggcagaactctgggtgtctcaccatggcctggatccctctacttctccccctctcactctctgcacaggctctgaggcctcctatgagctgacacagccacccgtggtgtcagtcgtcccaggacagacggccaggatcacctgctnggagatgctattgaccaaaccgtatatgtacttagttacggtacagcaaggaacgccgggaccacggtcccgttgtgttggtacgtagtacgtaataaagccaacgtgaaggaccggtaccctacgtaacgggtactcccgtaggacgtccgtaactttcgttacgtcggtactcccgaggtacggtaaacggggaacctaaccggggtttacaaaccggttagttaccgggaccctaagttaccggaacgggtttagggaaccggtttaccggaaacgggtccggtaaaacggggaaacggggtaaccggtacgggttaaccgttacgtaacgttttaaacgttttacgttacggttaacctaaaacttaaccgaaaccggttaagaacccgttaacgttacgtttaacgggttaactttaacgttccgggtttactacggtaaccgttaggttaccccgaacgtaacggttaccctaccggggttaccgttacggaccgttaacccgaaccccggtaacgaacccccgttaaccctacggtacccttccggtaaccctttccccggg

SEQ ID NO: 257533 - DNA, 766 bp, Homo sapiens
  misc_feature: GYAE6OF02JK8IN.51.35.D02.1.454.CMB.1.raw
tcagcgatcgtatacacgaccggtgctcgatttagcacacgatagttgggtttgggggtgggtccgaggaggcagaactctgggtgtctcaccatggcctggatccctctacttctcccctcctcactctctgcacaggctctagcgcctcctatgacgctgacacacgcctacccgtggtctcagttcgtaccccgaggacaggacgtcccaggactaccaccgtgcctacgtggaacgtatcggactattcgacccgaaaaccgtattgttaccgtaccgttagtttacggtaacctacacggggggggggggaacaacggacccgggacccgtaaccggtcccccttcgggttcggttacggttaggtagttaggtaaacttaaacggtaacctaaccggtaacggtaaccggtaaccggtaccccgttacgaaccggggttacgttaccccggttacggaccggtacgtaccgttaccgttaccgttcggtaccgttccgtacgggtaccggtaacgggtaaccgtaacggtaccgtaacgtacggtccgtacgtacttacgtaggtacggtacgtaccgacggtaccgtaaggaacgggacgtacggtacggtacttacgttaatttacgttacgtactactacgactacgactaactacgttacgttacttagtacttacgtacgtacgtacgacgacgtacgtacgtaccgtcgtggtaccgacgtaccgaccgcccgaccgtacgtctaccgactccg

SEQ ID NO: 257534 - DNA, 713 bp, Homo sapiens
  misc_feature: GYAE6OF02IDEK2.51.35.D02.1.454.CMB.1.raw
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgacggcctcctatgagctgacacagcccacctcggtgtccagtgtccccaggacagaccggccaggactccacctgctgtggagatgcctaagttgacccgaaaaacgntaatnccttaattcggtacagacagaggccggcacggcccctgttgtggtagactagtattaaaagactaaccgtgaacggacggaccccgtagacggggtaacttccccgtaggaacgtccggtaactttccctacgttcgggacccgttccgaacgggtttacggaaacgggtaccgtaaacgggttccaacgtacgttacggaccgtacgtactagggttacggaggtccccgggaggtaaccgaggggaacggaacgggtaccgttaggtaacaacgtttaatttcggtaacttaaacgttacaaaccacggtaaacaacctaacgtttagttacgttaacgtttacgttcgttaaccggtacgtaacgtccgaaccgtaccggttaactccggttaacccgtacggccgtagaacccgtacgaccgtaaccccacgtacgtccgtactacgttccg

SEQ ID NO: 257535 - DNA, 778 bp, Homo sapiens
  misc_feature: GYAE6OF02JULXS.51.35.D02.1.454.CMB.1.raw
  modified_base (280)..(280): a, c, t, g, unknown or other
  misc_feature (280)..(280): n is a, c, g, or t
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctggtgtcagtcgtccccaggacacggacggccaggatccaccgtgcctcgtggagatgctagttcgaacccgaaaccgtatatcgtacttagttggtaaccacganaacggtaacgggccccgggtaccccgaaccggtcccccgttagggttcggtttacgggtacggtacgttaacggttaaaagtttaaaaccggaaccctaaccggttagggaaccgggtaccggtacccccgtaacgggtaaccggggtaacctttaccccggtacggggtaacggtacccgttaatttacccggttccgggtaccggttacccgtaaccggtacgggtaaccggaacgggtaaccgtaccggtaacgtaaccgtagttccggacctcgtaaccgaggttcggatccggaggtacgaggagggacgaggtcgtacgtactttagttacgttacgtaacaagttaccaaagtcgaaccacgttagtttacggttactttagttacgtaccttcggaactcgggtaaccacggttactccggaaccgttccgaggtacccgtcgacccgaacggttaccccaacccgttatccggtacctacggtaccccg

SEQ ID NO: 257536 - DNA, 671 bp, Homo sapiens
  misc_feature: GYAE6OF02GY2UP.51.35.D02.1.454.CMB.1.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatccacctgctcgtgggagatcgctattacggacccaaaaccgtatactcgtactttagttacggtaccagcaaggaacggcccgggccgaccgggccccgttggttcggttggtgtagttgtaataaacgactacgtaggacgaccggtcctacgacgggtctcccgtgacgcgtacttcgtcgtcggcgtccgaggtacgacggacgtaacgtcacgtagtcggtaccagtcgaggtggacgtccgaaggacgaggacgggacggaggtacgtacgtaacttagtttacttacgtactaacgtaccaaacgacgtaaccgtaccgttagtttacgttaactttacggttacgttaccgttacggaacgttacggaccggtaccgtacggtacccgtccggtccggtacggacgtacccggaccgaaccggtacccaacccgtagttccgacctaccttcccg

SEQ ID NO: 257537 - DNA, 811 bp, Homo sapiens
  misc_feature: GYAE6OF02GDPVN.51.35.D02.1.454.CMB.1.raw
  modified_base (240)..(240): a, c, t, g, unknown or other
  misc_feature (240)..(240): n is a, c, g, or t
  modified_base (267)..(267): a, c, t, g, unknown or other
  misc_feature (267)..(267): n is a, c, g, or t
tcagcgatcgtatacacgaccggtgctcgatttagcacacgatagttgggtttggggctgtgggtccaggaggcagaactctgggtgtctcaccatggcctggatccctctacttcctccccctcctcactctctgcacaggctcgtgacggcctcctagtgagctgacacacgcccacccgtcggtgtcagtcgtaccccaggacaggaccggccaggactccaccgtgcctcgtgganacgtgacgtattcgaacccgaaaccgnttagtcgtacttagtcggtaccagtacgagaacggccggccgacggtccccgtaggttggtcggtagtagtagtaacgtaaacgacgtacgtaggacgtaccggtcccgtacgacgggtacctccgtaggacgacgtacttcgtcgtcggtacccgtacgacggtaccggagggtaacctaaccgggtactacgtacgttacggaccgtagtaccggaggtcggaacgtacggtacggacgaacgggacggtaacgggacggttacgtaagttaaccgtttagttaacgtttacgtaaaccgtaacgttaacccgaaacggaaccgttaaccctaaacgttttacggttttaaccgggttaaaccggttttacgttaccggtttacccgttaaacggggtacccttacgggtaccccggtaaaccgggtaacccgggttaccccgtacccggggttaacggttacccgggaacccggtaaccccggtaaccccggtaaccccgggtaacccccggtttaaccccgaccgttccggttaaccccg

SEQ ID NO: 257538 - DNA, 659 bp, Homo sapiens
  misc_feature: GYAE6OF02HBF0R.51.35.D02.1.454.CMB.1.raw
  modified_base (229)..(229): a, c, t, g, unknown or other
  misc_feature (229)..(229): n is a, c, g, or t
  modified_base (361)..(361): a, c, t, g, unknown or other
  misc_feature (361)..(361): n is a, c, g, or t
  modified_base (523)..(523): a, c, t, g, unknown or other
  misc_feature (523)..(523): n is a, c, g, or t
tcagcgatcgtatacacgaccggtgctcgatttagcacacgatagttgggtttgggggtgggtccaggaggcagaactctgggtgtctcaccatggcctggatccctctacttctccccctctcactctctgcacaggctctgaggcctcctatgagctgacacacgcccaccctggtcgtcagtcgtcccaggacaggacggccaggctaccacctgcctcgtagganatgctattcgacccaaacgtatatgtacttagttcgtacagcaaggacggccgggccacggtccctggttcgttggtcgtagtgtaataaacgactacgtcgacggaccggcccgtaggacggcgttaccgnggacgcgttacgttcgtcgtcggtcctcgtacggtacgacggggaacctaacggtccgtaatacgtcggactacgtacgaggtacggtacggtccgacggacgtaacgggacgggacgagggtctacggttattacgttattacggtactaactaccgaacncgtaacctacgttagtttacggtaacttagttacgtcgttaacgaccttggacccgaccgtacgttccggaccggttcgtcgggtaccaccgggtaccgaaccccgacccgtacccacgttacgcctcgttacccg

SEQ ID NO: 257539 - DNA, 192 bp, Homo sapiens
  misc_feature: GYAE6OF01CM53G.34.14.B03.1.454.CMB.1.raw
  modified_base (192)..(192): a, c, t, g, unknown or other
  misc_feature (192)..(192): n is a, c, g, or t
tcagtacacgtgatcacgaccggtgctcgatttagtgtgagtagttcccgggacagcgttggtaaccatcagggagtggtcttcggcggagggaccaagctgaccgtcctaggtcagcccaaggctgcccctcggtcactctgttcccgcctcctcatcacgtgtactgagcgggctggcaaggcgcatagn

SEQ ID NO: 257540 - DNA, 197 bp, Homo sapiens
  misc_feature: GYAE6OF01AQQB6.34.14.B03.1.454.CMB.1.raw
  modified_base (194)..(197): a, c, t, g, unknown or other
  misc_feature (194)..(197): n is a, c, g, or t
tcagtacacgtgatcacgaccggtgctcgatttagtgtgagtagttcccgggacagcgttggtaaccatcagggagtggtcttcggcggagggaccaagctgaccgtcctaggtcagcccaaggctgccccctcggtcactctgttcccgccctcctcatcacgtgtactgagcgggctggcaaggcgcatagnnnn

SEQ ID NO: 257541 - DNA, 194 bp, Homo sapiens
  misc_feature: GYAE6OF01A2RV7.34.14.B03.1.454.CMB.1.raw
  modified_base (193)..(194): a, c, t, g, unknown or other
  misc_feature (193)..(194): n is a, c, g, or t
tcagtacacgtgatcacgaccggtgctcgatttagtgtgagtagttcccgggacagcgttggtaaccatcagggagtggtcttcggcggagggaccaagctgaccgtcctaggtcagcccaaggctgcccctcggtcactctgttcccgccctcctcatcacgtgtactgagcgggctggcaaggcgcatagnn

SEQ ID NO: 257542 - DNA, 197 bp, Homo sapiens
  misc_feature: GYAE6OF01BY9LE.34.14.B03.1.454.CMB.1.raw
  modified_base (195)..(197): a, c, t, g, unknown or other
  misc_feature (195)..(197): n is a, c, g, or t
tcagtacacgtgatcacgaccggtgctcgatttagtgtgagtagttcccgggacagcgttggtaaccatcagggagtggtcttcggcggagggaccaagctgaccgtcctaggtcagcccaaggctgccccctcggtcactctgttcccccgcctcctcatcacgtgtactgagcgggctggcaaggcgcatagnnn

SEQ ID NO: 257543 - DNA, 235 bp, Homo sapiens
  misc_feature: GYAE6OF01CSWAI.34.14.B03.1.454.CMB.1.raw
  modified_base (196)..(235): a, c, t, g, unknown or other
  misc_feature (196)..(235): n is a, c, g, or t
tcagtacacgtgatcacgaccggtgctcgatttagtgtgagtagttcccgggacgtaggcgttggtaaccatcagggagtggtcttcggcggagggaccaagctgaccgtcctaggtcagcccaaggctgcccctggtcactctgttcccaccctcctcatcacgtgtactgagcgggctggcaaggcgcatacgnnnnnnnnnnnnnnnnnnnnnnnnnnnnnnnnnnnnnnnn

SEQ ID NO: 257544 - DNA, 242 bp, Homo sapiens
  misc_feature: GYAE6OF01ERFQV.34.14.B03.1.454.CMB.1.raw
  modified_base (200)..(242): a, c, t, g, unknown or other
  misc_feature (200)..(242): n is a, c, g, or t
tcagtacacgtgatcacgaccggtgctcgattttagtgtgagtagttcccgggtacgtaggcgttggtaaccatcagggagtggtcttcggcggaggaccaagctgaccgtcctaggtcacgcccaaggctgccccctggtcactctgttcccaccctcctcatccacgtgtactgagcgggctggcaaggcgcatacgnnnnnnnnnnnnnnnnnnnnnnnnnnnnnnnnnnnnnnnnnnn

SEQ ID NO: 257545 - DNA, 195 bp, Homo sapiens
  misc_feature: GYAE6OF01A6TEC.34.14.B03.1.454.CMB.1.raw
  modified_base (194)..(195): a, c, t, g, unknown or other
  misc_feature (194)..(195): n is a, c, g, or t
tcagtacacgtgatcacgaccggtgctcgatttagtgtgagtagttcccgggacagcgttggtaaccatcagggagtggtcttcggcggagggaccaagctgaccgtcctaggtcagcccaaggctgccccctcggtcactctgttcccgccctcctcatcacgtgtactgagcgggctggcaaggcgcatagnn

SEQ ID NO: 257546 - DNA, 700 bp, Homo sapiens
  misc_feature: GYAE6OF01C1O30.34.14.B03.1.454.CMB.1.raw
  modified_base (324)..(324): a, c, t, g, unknown or other
  misc_feature (324)..(324): n is a, c, g, or t
  modified_base (390)..(390): a, c, t, g, unknown or other
  misc_feature (390)..(390): n is a, c, g, or t
tcagtacacgtgatcacgaccggtgctcgatttagtgtgagtagtttgggtttgagtgactcctgtgccccaccatggacacactgtgctccacgctcctgctgctgaccatcccttcatgggtcttgtcccagatcaccttgaaggagtctggtccgacgctggtgaaacccaaacagaccctcacgctgacctgcaccttctctggtttctcactcaccagtgaagaagaggctgtggcctggggtcctcacgccccgaagggaaacgggccgtggagttcctagccgtcttcgtttagttggggtgctgatgagcgctacngtccatctctgaacgaccaggctcaccatccgaacgaccgaacccaaacccccgaaaacgacggtnactcctagaaccacgtacgaacctaaggttcggacccgttggtacggaactacgacgaccctaaccttatttattcgacgaccaacctaaaccctaaaacccgccgggtacccgggtcgggaccggggtaacctttacgtttacggaaccgttaccggtcggggacccgtaacggggtaccccgttcgggacccgtacccggttcccgtacccgtaccgacccggtccccgttaccccgaaacccggtaaccggggtccccctaaccggttccccgggttacccccgttccccccggtcgggtccccccg

SEQ ID NO: 257547 - DNA, 696 bp, Homo sapiens
  misc_feature: GYAE6OF01A2FFP.34.14.B03.1.454.CMB.1.raw
  modified_base (217)..(217): a, c, t, g, unknown or other
  misc_feature (217)..(217): n is a, c, g, or t
  modified_base (320)..(320): a, c, t, g, unknown or other
  misc_feature (320)..(320): n is a, c, g, or t
  modified_base (337)..(337): a, c, t, g, unknown or other
  misc_feature (337)..(337): n is a, c, g, or t
tcagtacacgtgatcacgaccggtgctcgatttagtgtgagtagtttgggtttgagtgactcctgtgccccaccatggacacactgtgctccacgctcctgctgctgaccatcccttcatgggtcttgtcccagatcaccttgaaggagtctggtccgacgctggtacgaaaacccaaacagaccctcacgctgacctgccaccttctctggtttcncactcaccagtagaagaagaggctggtcggccgtggggttcccgcacgcccccgaagggaaacgggcctggacgttcctagcgtcttcggtttagttggggtncgtgatggagcgctacngtccatctctagaacgaccgaggcctccaaccactaccaaccggaaccggaaacccaaacccccgaaaaacgtacgggtacgaaccttcccgtacgaacctacgtacgaaccgtaaggttaccggacccgtggtacgaccacacgccctaacttattagttcgacgacccaacctaaaccgtaaaacccgcggtacccgggtcggaccgggttacttaccgtttacgaacgttcggccggggaccgaccggggtacccgtcggtcccgaacccgttccgtcccctacgaccgtccccgtacccgacccgaaccgggtccctacggttccccggttccccttcccccgtcggtacccccc

SEQ ID NO: 257548 - DNA, 583 bp, Homo sapiens
  misc_feature: GYAE6OF01BD3ML.34.14.B03.1.454.CMB.1.raw
  modified_base (367)..(367): a, c, t, g, unknown or other
  misc_feature (367)..(367): n is a, c, g, or t
tcagtacacgtgatcacgaccggtgctcgatttagtgtgagtagtttgggtttgagtgactcctgtgccccaccatggacacactgtgctccacgctcctgctgctgaccatcccttcatgggtcttgtcccagatcaccttgaaggagtctggtccgacgctggtagaaacccaaacagaccctcacgctgacctgcaccttctctggtttctcactcaccagtgaagaagaggctgtggcctgggtccgtcagcccccaggaaagggcctggagttcctagcgctcgtttatggggtgctgatgagcgctacagtccatctctgaagaccaggctcaccatcacgacggaaccaaccccaaaacnggtgactcctgacactgaccaagttcgacctgtcgacacgacgccacttattattgtcgaccaccaaccctaaaccacggcccgtgggaccgggtactactttgacctacgtcggggaccacggggaccctggtccgacccgtcgtccctcgaccgccctcccgaacccgacgggcccctacgttcccggttccccttcccccggtgggtcccccg

SEQ ID NO: 257549 - DNA, 541 bp, Homo sapiens
  misc_feature: GYAE6OF01BU7RR.34.14.B03.1.454.CMB.1.raw
  modified_base (368)..(368): a, c, t, g, unknown or other
  misc_feature (368)..(368): n is a, c, g, or t
  modified_base (430)..(430): a, c, t, g, unknown or other
  misc_feature (430)..(430): n is a, c, g, or t
  modified_base (495)..(495): a, c, t, g, unknown or other
  misc_feature (495)..(495): n is a, c, g, or t
  modified_base (534)..(534): a, c, t, g, unknown or other
  misc_feature (534)..(534): n is a, c, g, or t
tcagtacacgtgatcacgaccggtgctcgatttagtgtgagtagtttgggtttgagtgactcctgtgccccaccatggacacactgtgctccacgctcctgctgctgaccatcccttcatgggtcttgtcccagatcaccttgaaggagtctggtccgacgctggtgaaacccaaacagaccctcacgctgacctgcaccttctctggtttctcactcaccagtgaagaagaggctgtggcctggggtccgtcagcccccaggaaagggcctggagttcctagcgctcgtttatggggtgctgatgagcgctacagtccatctctgaagaccaggctcaccatcacgacgacaaccccaaaacaggtnatctgacactgaccagttcgacctgtgacacagccactattatgtcgacacaacctaaaccncgcccgtggcgggactacgttcgactacgtcggggccaacggggccctggtccaccgtctccgtnacgccctaccaccgacggcccagtccgtccttcccccgnggtcccg

SEQ ID NO: 257550 - DNA, 771 bp, Homo sapiens
  misc_feature: GYAE6OF01B86OQ.34.14.B03.1.454.CMB.1.raw
  modified_base (179)..(179): a, c, t, g, unknown or other
  misc_feature (179)..(179): n is a, c, g, or t
  modified_base (215)..(215): a, c, t, g, unknown or other
  misc_feature (215)..(215): n is a, c, g, or t
  modified_base (235)..(235): a, c, t, g, unknown or other
  misc_feature (235)..(235): n is a, c, g, or t
tcagtacacgtgatcacgaccggtgctcgatttagtgtgagtagtttgggtttgagtgactcctgtgccccaccatggacacactgtgctccacgctcctgctgctgaccatcccttcatgggtcttgtcccagatcaccttgaaggagtctggtccgacgctggtacgaaacccaaanacgaccctcacgctgacctgctaccttctctgttcncactcaccagtagaagaagnggctggtcggccgtgggtccctcacggcccccgaagggaaacgggcctaggacgttcctagccgtcgttacggtttagttcgggggtgcgtggactggacgccgctacgcgtccattcgtacgtacggaacgacccgaggcctacaaccactaccgaacccggaacccggaaaccccaaaacccccgaaaaaccgtcgggtacgtaacgttacccgaacgaaccgtaaccgtacgtaacccgtaacggtttaccgggaaccccgttggtacggaacctaaccggaccgtaccccttaaccgttagttttacgttcgtacgaacctaaacccgtaaaccccgtaaaaccgccgggtaccccgggtagggacccggggttaacctttacgtttacggaaccgttaccgggtacggggtcccgaaccggggtcccttagggtccccgtaacccgttccgtcccgtacccgaccgtacccctacccgaacccggaccgggtccccacgttccccggtaccccttccccggccggtccccg

SEQ ID NO: 257551 - DNA, 855 bp, Homo sapiens
  misc_feature: GYAE6OF01CL1S6.34.14.B03.1.454.CMB.1.raw
  modified_base (122)..(122): a, c, t, g, unknown or other
  misc_feature (122)..(122): n is a, c, g, or t
tcagtacacgtgatcacgaccggtgctcgatttagtgtgagtagtttgggtttgagtgactcctgtcgccccaccatggacacactgtgctccacgctcctgctgctgacctattccccttnagttcgggtcttcgtcccagactccaccttggaaggtgttcgtcgggtcccgacgcgttacgggacgaaaaaccccaaacgcgaacccctcacgtcctacgacctcaccctcctttctcgttcgtttccacctactaccgacgaggtaagaaagaacggcgtcgtggtccggtaccggtcggtcccgacgacccgaccccgggaaggaaccggtcgtacggtacgttaccgtcgccgttacgtttcggtttagggtggggtcctagtggtaacgtggaccgtccgtactacgaccttactacttccgtacgaacgaacgtacccgaggtcctaaccgaaccgtacgaaccccgaaaccggtaaaccccgaaaacccccaaaaaccccgtaaaggtcggtaaccaccgttaccgtacgaacctacgtaccgaacgttaacgggttcccgaccgttaggaaccacgaaccgtacgtaaccttattacgttacgttcggaaccaaccctaaaccctaaaccggtaaccgcccgggtaccgggtacgggtaaccggttaccgtttaacggtaccgtaaccgggtccggggtaaccgggacccgggtaacccgggttaccgtccggttacccgcccgtttaccctacccgtaccgtaccccgacccgttaccccggaaaccgttcccgggacccctttacccggtccccgtttaccccgccccggttcccggtccccg

SEQ ID NO: 257552 - DNA, 195 bp, Homo sapiens
  misc_feature: GYAE6OF01DCINJ.34.14.B03.1.454.CMB.1.raw
  modified_base (193)..(195): a, c, t, g, unknown or other
  misc_feature (193)..(195): n is a, c, g, or t
tcagtacacgtgatcacgaccggtgctcgatttagtgtgagtagttcccgggacagcgttggtaaccatcagggagtggtcttcggcggagggaccaagctgaccgtcctaggtcagcccaaggctgccccctggtcactctgttcccaccctcctcatcacgtgtactgagcgggctggcaaggcgcatagnnn

SEQ ID NO: 257553 - DNA, 780 bp, Homo sapiens
  misc_feature: GYAE6OF01B8APN.34.14.B03.1.454.CMB.1.raw
  modified_base (183)..(183): a, c, t, g, unknown or other
  misc_feature (183)..(183): n is a, c, g, or t
  modified_base (219)..(219): a, c, t, g, unknown or other
  misc_feature (219)..(219): n is a, c, g, or t
  modified_base (384)..(384): a, c, t, g, unknown or other
  misc_feature (384)..(384): n is a, c, g, or t
  modified_base (708)..(708): a, c, t, g, unknown or other
  misc_feature (708)..(708): n is a, c, g, or t
tcagtacacgtgatcacgaccggtgctcgatttagtgtgagtagtttgggtttgagtgactcctgtgccccaccatggacacactgtgctccacgctcctgctgctgaccatcccttcatgggtcttgtcccagatcaccttgaaggagtcgtggtccgacgctggtacgaaaacccaaaacngaccctcacgctgacctgccaccttctctggtttcncactcaccagtagaagaaggaggtctggtcggtccgtcggggtcctcgaccggaccccgaagggaaacggtccgtggtacgttccgcgaccgtcgttcggtttagttggggtgcgtaggtagtcgagtccgacgtaccgagtcctactctacgtagaacgaccgnggtacctacaaccgacgtacgaaccggacccggaaacccctaaacccccgaaaacgtacggtacacctccgacgaccacgtacgtaaccgtacggttaccgaccgtacggacgaaccgacgaccgtaccttaacgttacttattagtccgaaacctaacccgtaaaccctaaacccggaccgggtcccgggtaacggggtaacggtacccgtttaacgtttaccggaacccggttaaccggggtccgggggtacccgtaaccgggggttacccctacgggtacccctacccggttcccgtcccgtaccgtaccccggtaccccncccggaaacccggtaaccccggccccttaccggttccccggtttacccccgtcccccggtcggtccccccgg

SEQ ID NO: 257554 - DNA, 766 bp, Homo sapiens
  misc_feature: GYAE6OF01AOVV6.34.14.B03.1.454.CMB.1.raw
tcagtacacgtgatcacgaccggtgctcgatttagtgtgagtagtttgggtttgagtgactcctgtgccccaccatggacacactgtgctccacgctcctgctgctgaccatcccttcatgggtcttgtcccagatcaccttgaaggagtctggtccgacgctggtacgaaacccaaacagaccctcacgctgacctgctaccttctctggtttctcactcaccagtgaagaagaggctgtggccgtgggtccgtcacgccccgaggaaacgggccgtggagttccgtagccgtcttcggtttagttggggtgcgtgagtgacgcgactacgacgtccatctacgtagaacgaccgacggtctaccaaccactaccgaaccggaaccggaacccgaaaccccctaaaaacgacggtacgaactcctacgacctacgtacgaaccgtaacggttacggacccgtaggtacggaactaacgaacgtacccgtaaccttagttacgttacgtacgaacccaaacctaaacccgttaaacccgaccggtacccggggtacgggaaccggggttaactttaaccgtttaccggaaccgttacggggtaccgggggtacccgtaaccgggggtacccctacgggtacccctacccggttacccgttccccgtaccgtaccccggtaccccgtaccccgaaacccggtaacccggggtacccctacccgggtttaccccggttcccccgtttcccccgggcggtaccccccgg

SEQ ID NO: 257555 - DNA, 774 bp, Homo sapiens
  misc_feature: GYAE6OF01D2Z3R.34.14.B03.1.454.CMB.1.raw
  modified_base (181)..(181): a, c, t, g, unknown or other
  misc_feature (181)..(181): n is a, c, g, or t
  modified_base (222)..(222): a, c, t, g, unknown or other
  misc_feature (222)..(222): n is a, c, g, or t
  modified_base (700)..(700): a, c, t, g, unknown or other
  misc_feature (700)..(700): n is a, c, g, or t
tcagtacacgtgatcacgaccggtgctcgatttagtgtgagtagtttgggtttgagtgactcctgtgccccaccatggacacactgtgctccacgctcctgctagctgaccactcccttcatgggtcttgtcccagactcaccttgaaggagtctggtccgacgctggtacgaaacccaanacgaccctcacgctcgacctcgctaccttctctggtttccncgactcaccagtgaagagagctggtcggccgtgggtcctccgacgacccgaggaacggccgtaggcgttcgtcgtacgtcgttcggtttacgtgggggttacgtcgtcggtacgttgggacgtaccggtaccgtaaccgtacgtacctacttccgttaccgtaggaaaccgtaccgtaggccttaccaccgttacacgaaccggaacccggaacccaaacccccgtaaaacggacgttacgacttaccgtacggaccaacgttacggaaccgtaaccggttacggtaccccgtaggtaccgtaccaacgtccgtaccttaacttacgtttacttacggtaccaaccgtaaccctaaacccggttaaaccgccggttaccgggaccgggtaccgggttacccgtttagttacggtaaccgtacgggttcggggaccgtaccggggtacgtccgggtacctaccggtccttcccgtaccncccgtacccgacccgtaaacccggacccggtaccttacggttaccccggttccccttacccggtccggaccccg

SEQ ID NO: 257556 - DNA, 778 bp, Homo sapiens
  misc_feature: GYAE6OF01D7FY2.34.14.B03.1.454.CMB.1.raw
  modified_base (768)..(768): a, c, t, g, unknown or other
  misc_feature (768)..(768): n is a, c, g, or t
tcagtacacgtgatcacgaccggtgctcgatttagtgtgagtagtttgggtttgagtgactcctgtgccccaccatggacacactgtgctccacgctcctgctgctgaccatcccttcatgggtcttgtcccagatcaccttgaaggagtctggtccgacgcgtaggtacgaaacccaaaacacgaccctcacgctgacctgctaccttctcgtgtttctcactcacctagtagaagaagaggctggtcggccgttcggggtccgtcgaccggaccccccgaaggggaaacgggccgtaggtacgtttacctaaggccgtacctttcggttttaggttcgggggttgcgtgagtggacgccgtacgtacacgtacctattcctacgtaggaaaccgaccgacggtcctaccaccgaataccgaaaccggaacccggaaaccccaaaacccccgaaaaacgtcggtacgtacctccgtacgaaccaacgtacgtaaccgtaaggtttcccggaccgttggtaacggtaaccacaccggtaccctaaccgtttattacgttcggtacaccgtaaccctaaacccgtaaaccgccgggtacccgggtagggtacccgggttaactttaccgtttacggaaccgttacgggtacggggacccggtaccggggtacccgtcgggtcccacccgttccgtccctacgacccgtcccgtacccgaaccccggtaacgggtcccccttacggtccccggtttccccttcccccggnggtacccccg

SEQ ID NO: 257557 - DNA, 872 bp, Homo sapiens
  misc_feature: GYAE6OF01BCMBP.34.14.B03.1.454.CMB.1.raw
  modified_base (108)..(108): a, c, t, g, unknown or other
  misc_feature (108)..(108): n is a, c, g, or t
  modified_base (210)..(210): a, c, t, g, unknown or other
  misc_feature (210)..(210): n is a, c, g, or t
tcagtacacgtgatcacgaccggtgctcgatttagtgtgagtagtttgggtttgagtgactcctgtcgccccaccatggacacactgtgctccacgctcctgctgctnacctatcccttcagtgggtcttcgtcccagactcgaaccgttaggaaggcgtctcgggtaccgacggtctagggtaacgaaaaccccaaacgcgtaaccccncaaccggtcgttacgaccgtcacctaccgtttcctcgtttcgggttttccctacaacttaccgaaccgtaaggtagaaaaggaaaggcggtcgtggtacggtaccggttcggggaccctacgaccgaccccggaaggggaaacggtcctaggtaccgttaccaggtcctacgttcggtttaacgttgggggactcgtaggtagttacggacgtacgctaacgtactaccgtactacttaccgaaggtaacgaaccgtaggtaccaaccacctaacgacccgaaccggaaaccggaaacccccgtaaaaccccgtaaacgacgggtacctaaacgttaccggaaccgtaaaccgtacgtaaccgggtaaccgttaacgggtacccggtaacttacgggtaaacccggaataacccggactaaccggttaaccctaaggtttaaccggtacggacaaacccctaacgttaaaacccgaaacccggccgggtcccgggtaagggtaccggtaaacgtttcgtaacgccggtaacgggaccggggccgtaacccgggtccgtaccggtccctaaccgtccccgtcctacccgaacgttcccgaaccccgaaaccgtacccgggtccttaccgggtacccctttaccccgtccggtccggtaccccg

SEQ ID NO: 257558 - DNA, 195 bp, Homo sapiens
  misc_feature: GYAE6OF02HJB9O.34.14.B03.1.454.CMB.1.raw
  modified_base (194)..(195): a, c, t, g, unknown or other
  misc_feature (194)..(195): n is a, c, g, or t
tcagtacacgtgatcacgaccggtgctcgatttagtgtgagtagttcccgggacagcgttggtaaccatcagggagtggtcttcggcggagggaccaagctgaccgtcctaggtcagcccaaggctgccccctcggtcactctgttcccaccctcctcatcacgtgtactgagcgggctggcaaggcgcatagnn

SEQ ID NO: 257559 - DNA, 202 bp, Homo sapiens
  misc_feature: GYAE6OF02JIN00.34.14.B03.1.454.CMB.1.raw
  modified_base (192)..(202): a, c, t, g, unknown or other
  misc_feature (192)..(202): n is a, c, g, or t
tcagtacacgtgatcacgaccggtgctcgatttagtgtgagtagttcccgggacagcgttgggtaaccatcagggagtggtcttcggcggagggaccaagctgaccgtcctaggtcagcccaaggctgcccctggtcactctgttcccacctcctcatcacgtgtactgagcgggctggcaaggcgcatagnnnnnnnnnnn

SEQ ID NO: 257560 - DNA, 192 bp, Homo sapiens; identical to SEQ ID NO: 257539
  misc_feature: GYAE6OF02HFP8Y.34.14.B03.1.454.CMB.1.raw
  modified_base (192)..(192): a, c, t, g, unknown or other
  misc_feature (192)..(192): n is a, c, g, or t

SEQ ID NO: 257561 - DNA, 204 bp, Homo sapiens
  misc_feature: GYAE6OF02HCWER.34.14.B03.1.454.CMB.1.raw
  modified_base (196)..(204): a, c, t, g, unknown or other
  misc_feature (196)..(204): n is a, c, g, or t
tcagtacacgtgatcacgaccggtgctcgatttagtgtgagtagttcccgggacgagcgttggtaaccatcagggagtggtcttcggcggagggaccaagctgaccgtcctaggtcagcccaaggcctgccccctcggtcactctgttcccgccctcctcatcacgtgtactgagcgggctggcaaggcgcatagnnnnnnnnn

SEQ ID NO: 257562 - DNA, 194 bp, Homo sapiens
  misc_feature: GYAE6OF02HDG45.34.14.B03.1.454.CMB.1.raw
  modified_base (194)..(194): a, c, t, g, unknown or other
  misc_feature (194)..(194): n is a, c, g, or t
tcagtacacgtgatcacgaccggtgctcgatttagtgtgagtagttcccgggacagcgttggtaaccatcagggagtggtcttcggcggagggaccaagctgaccgtcctaggtcagcccaaggctgccccctcggtcactctgttcccgccctcctcatcacgtgtactgagcgggctggcaaggcgcatagn

SEQ ID NO: 257563 - DNA, 607 bp, Homo sapiens
  misc_feature: GYAE6OF02F1TX2.34.14.B03.1.454.CMB.1.raw
tcagtacacgtgatcacgaccggtgctcgatttagtgtgagtagtttgggtttgagtgactcctgtgccccaccatggacacactgtgctccacgctcctgctgctgaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcacgcccccgaggaaagggcctggacgttcctagcgctcgtttattggggtgctgatgagcgctacagtccatctctgaagaccaggctcaccatcacgaccggaaccaaccccaaaaacacggtagactcctagaccactgacctaagttcggaccctgtcggacacacgccactattattgcgacaccaaccctaaaccacgacccggtgggaccggggtacttacgtttcgaaccgttacggtcggggccgaggggacccttggtccgacccgtcctcccgtacgacgtcccctaccgaacccgaaccggggcccctaacggttcccggttaccctttcccccgtggtccccg

SEQ ID NO: 257564 - DNA, 566 bp, Homo sapiens
  misc_feature: GYAE6OF02JH8L6.34.14.B03.1.454.CMB.1.raw
  modified_base (177)..(177): a, c, t, g, unknown or other
  misc_feature (177)..(177): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (454)..(454): a, c, t, g, unknown or other
  misc_feature (454)..(454): n is a, c, g, or t
tcagtacacgtgatcacgaccggtgctcgatttagtgtgagtagtttgggtttgagtgactcctgtgccccaccatggacacactgtgctccacgctcctgctgctgaccatcccttcatgggtcttgtctcagatcaccttgaaggagtctggtccgacgctggtgaaacccaaanagaccctcacgctgacctgcaccttctctggtttctcactcaccagtgaagaagnggctgnggcctgggtaccgtcacgcccccagggaaacgggcctggagttcctagtgctcgtttagttggggtgctagatgagcgctacagtccatctctgaagaccaggctcacatcacgacggaccaacccctaaaacaggtcatcctgacactcgaccaagttcggaccctgtggacacgagccctactattacttgtacgactacgaaccctaaaaccncgtcccgtagggcgggtaactacttgacttacgtcgggccagggaccctggtaccaccggttcctcctcacgccctaccaccgacgggcccaggtccgtccttccccgcggg

SEQ ID NO: 257565 - DNA, 195 bp, Homo sapiens; identical to SEQ ID NO: 257558
  misc_feature: GYAE6OF02IKDP2.34.14.B03.1.454.CMB.1.raw
  modified_base (194)..(195): a, c, t, g, unknown or other
  misc_feature (194)..(195): n is a, c, g, or t

SEQ ID NO: 257566 - DNA, 529 bp, Homo sapiens
  misc_feature: GYAE6OF02GJ8V3.34.14.B03.1.454.CMB.1.raw
  modified_base (361)..(361): a, c, t, g, unknown or other
  misc_feature (361)..(361): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (428)..(428): a, c, t, g, unknown or other
  misc_feature (428)..(428): n is a, c, g, or t
  modified_base (523)..(523): a, c, t, g, unknown or other
  misc_feature (523)..(523): n is a, c, g, or t
tcagtacacgtgatcacgaccggtgctcgatttagtgtgagtagtttgggtttgagtgactcctgtgccccaccatggacacactgtgctccacgctcctgctgctgaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcagcccccaggaaagggcctggagttcctagcgctcgtttattgggtgctgatgagcgctacagtccatctctgaagaccaggctcacatcacgacgacaccccaaaacngtnatctnacactgaccaagtcgacctgtggacacagccacctattattgtgacacaacctaaaccngcccgtggcgggactacttgactacgtgggccagggccctggtccaccgtctcctcacgccctccaccgaacggcccagtccggtccttccccgngtcccg

SEQ ID NO: 257567 - DNA, 574 bp, Homo sapiens
  misc_feature: GYAE6OF02IDGYJ.34.14.B03.1.454.CMB.1.raw
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (519)..(519): a, c, t, g, unknown or other
  misc_feature (519)..(519): n is a, c, g, or t
  modified_base (566)..(566): a, c, t, g, unknown or other
  misc_feature (566)..(566): n is a, c, g, or t
tcagtacacgtgatcacgaccggtgctcgatttagtgtgagtagtttgggtttgagtgactcctgtgccccaccatggacacactgtgctccacgctcctgctgctgaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcagcccccaggaaagggcctggagttcctagcgctcgtttattggggtgctgatgagcgctacagtccatctctgaagaccaggctcaccatcacgacggacaccccaaaacnggtnatccngacactgacctaagttcggaccctgtcggacacacgccacctattattgtcgacaccaacctaaaaccacgcccgtaggccggggtacttacgtttcgacgttacgtcggggccgacggggtaccctgggtcctacccgtctcccncacgtccctcccgaccgaacgggcccagtcccggtaccttcccccgnggtccccg

SEQ ID NO: 257568 - DNA, 565 bp, Homo sapiens
  misc_feature: GYAE6OF02HOW69.34.14.B03.1.454.CMB.1.raw
  modified_base (231)..(231): a, c, t, g, unknown or other
  misc_feature (231)..(231): n is a, c, g, or t
  modified_base (364)..(364): a, c, t, g, unknown or other
  misc_feature (364)..(364): n is a, c, g, or t
tcagtacacgtgatcacgaccggtgctcgatttagtgtgagtagtttgggtttgagtgactcctgtgccccaccatggacacactgtgctccacgctcctgctgctgaccatcccttcatgggtcttgtcccagatcaccttgaaggagtctggtccgacgctggtgaaacccaaacagaccctcacgctgacctgcaccttctctggtttctcactcacagtgaagaagngctgtcggcctgggtcctcagcccccaggaaagggcctggagttcctagcgctcgtttagttggggtgctgatgagcgctacagtccatctctagaagacaggctcaccatcacgacggacaaccccaaaacngtacatcctgacactacgacctaagtcgacctgagacacacgccactattatgtcgacacaacctaaaccacgcccgtgggacgggacttacgttcgacctacgtcgggcgacggggtacctggtccacccgtcgtcctcgacgtccctacccgaaccgacggacccacgttacccggtcccttcccccggtggtaccccc

SEQ ID NO: 257569 - DNA, 762 bp, Homo sapiens
  misc_feature: GYAE6OF02HFZEF.34.14.B03.1.454.CMB.1.raw
  modified_base (333)..(333): a, c, t, g, unknown or other
  misc_feature (333)..(333): n is a, c, g, or t
tcagtacacgtgatcacgaccggtgctcgatttagtgtgagtagtttgggtttgagtgactcctgtgccccaccatggacacactgtgctccacgctcctgctgctgaccatcccttcatgggtcttgtcccagatcaccttgaaggagtctggtccgacgctggtgaaacccaaacagaccctcacgctgacctgcctaccttctcttggtttctcactcaccagtagaagaagaggctggtcggccgtgggtcccgtcaccggacccccgaaggggaaacgggccgtagggtacgtttccgtaggccgtcttcggttttaggttgggggtncgtgatggacgcgtctacacgtcctatcctctaggaacgaccgacggctaccaaccactaccaaccggaaccggaaaccccaaaacccccgaaaaacgagggtactactccgtacgacctacgtacgaaaccgtaacgggttaccggaccccgtaggtaccgggaaccaacgaacgtaccctaaccgttatttacgttcgtacgaccctaaaccgtaaaaccctaaaaacccgccggtcccgggttacggggaacccggggtacctttaacgttaccgaacgttaccgggtcggggacccgtaacgggggtacccctcgggtaccctaccggttccctacccgtaccgaccgtccccgttaacccgaacccggtaacgggtccccgtaacgttccccgggttaccccttcccccggtacggtcccccgg

SEQ ID NO: 257570 - DNA, 658 bp, Homo sapiens
  misc_feature: GYAE6OF02G63NL.34.14.B03.1.454.CMB.1.raw
  modified_base (208)..(208): a, c, t, g, unknown or other
  misc_feature (208)..(208): n is a, c, g, or t
  modified_base (218)..(218): a, c, t, g, unknown or other
  misc_feature (218)..(218): n is a, c, g, or t
  modified_base (239)..(239): a, c, t, g, unknown or other
  misc_feature (239)..(239): n is a, c, g, or t
  modified_base (314)..(314): a, c, t, g, unknown or other
  misc_feature (314)..(314): n is a, c, g, or t
  modified_base (326)..(326): a, c, t, g, unknown or other
  misc_feature (326)..(326): n is a, c, g, or t
  modified_base (330)..(330): a, c, t, g, unknown or other
  misc_feature (330)..(330): n is a, c, g, or t
  modified_base (339)..(339): a, c, t, g, unknown or other
  misc_feature (339)..(339): n is a, c, g, or t
  modified_base (390)..(390): a, c, t, g, unknown or other
  misc_feature (390)..(390): n is a, c, g, or t
tcagtacacgtgatcacgaccggtgctcgatttagtgtgagtagtttgggtttgagtgactcctgtgccccaccatggacacactgtgctccacgctcctgctgctgaccatcccttcatgggtcttgtcccagatcaccttgaaggagtctggtcccgacgctggtgaaacccaacagacccctcacgctgacctgcctacctttcncgtggtttcncacctcaccagtagaagaagnggctgcggccgtggggtacctcacgccccgaagggaacggcctaggacgttccagcgtcttcgtttagtggggtnactgatgagcgntacncgtcatctntacgacgaccagctacaccgatacgacgaccgacccaaaccccgaaaacgngtactactacccgtacgacctacgtaccgaaccgtaaaggttccggaaccccttggtacggaccacgacgaacccttacgttattagtcgacgtaccaacctaaacccgtaacgaccggtccggttacggccgggtaacctttgttacgaccgtacgggtccgggcgaccggggtacccttggtacccctccgttcccacccgttcgacctccccgtaccgaaccgaccggccctaacggttcccgtaccctccccggacgtccccgg

SEQ ID NO: 257571 - DNA, 611 bp, Homo sapiens
  misc_feature: GYAE6OF02JKT1P.34.14.B03.1.454.CMB.1.raw
  modified_base (249)..(249): a, c, t, g, unknown or other
  misc_feature (249)..(249): n is a, c, g, or t
  modified_base (394)..(394): a, c, t, g, unknown or other
  misc_feature (394)..(394): n is a, c, g, or t
  modified_base (462)..(462): a, c, t, g, unknown or other
  misc_feature (462)..(462): n is a, c, g, or t
  modified_base (488)..(488): a, c, t, g, unknown or other
  misc_feature (488)..(488): n is a, c, g, or t
tcagtacacgtgatcacgaccggtgctcgatttagtgtgagtagtttgggtttgagtgactcctgtgccccaccatggacacactgtgctccacgctcctgctgctgaccatcccttcatgggtcttgtcccagatcaccttgaaggagtctggtccgacgctggtgaaacccaaacagaccctcacgctgacctgccaccttctctggtttctcactcaccagtgaagagagctgtggcctgggtccncacgcccccgaggaagggcctggacgttccagcgcttcggtttagtggggtcgcgtgatggacgtcgctacacgtcctactctcgtagaacgtccgagcctacacccatccgaaccgaccggtaaccccaaaccccgaaaaccgnggtacgactcctacgacctacgtacgaccgtaagtccggaccgtggtcgaacacacacctactagttntgcgacaccaacctaaacgcggtccngggtacgactacgttcgacgtacgcgggaccgtcggtaccgtcggtactacccgtcgtccctcgaccgcccttaccggaaccgacggtaccctcggtaccccgttccgtccccgtgtaccccc

SEQ ID NO: 257572 - DNA, 217 bp, Homo sapiens
  misc_feature: GYAE6OF02HMMDN.34.14.B03.1.454.CMB.1.raw
  modified_base (194)..(217): a, c, t, g, unknown or other
  misc_feature (194)..(217): n is a, c, g, or t
tcagtacacgtgatcacgaccggtgctcgatttagtgtgagtagttcccgggacagcgttggtaaccatcagggagtggtcttcggcggagggaccaagctgaccgtcctaggtcagcccaaggctgccccctcggtcactctgttcccaccctcctcatcacgtgtactgagcgggctggcaaggcgcatagnnnnnnnnnnnnnnnnnnnnnnnn

SEQ ID NO: 257573 - DNA, 205 bp, Homo sapiens
  misc_feature: GYAE6OF02H5PI4.34.14.B03.1.454.CMB.1.raw
  modified_base (191)..(205): a, c, t, g, unknown or other
  misc_feature (191)..(205): n is a, c, g, or t
tcagtacacgtgatcacgaccggtgctcgatttagtgtgagtagttcccgggacagcgttggtaaccatcagggagtggtcttcggcggagggaccaagctgaccgtcctaggtcagcccaaggctgccccctggtcactctgttcccgcctcctcatcacgtgtactgagcgggctggcaaggcgcatgnnnnnnnnnnnnnnn

SEQ ID NO: 257574 - DNA, 931 bp, Homo sapiens
  misc_feature: GYAE6OF02FWKNT.34.14.B03.1.454.CMB.1.raw
  modified_base (249)..(249): a, c, t, g, unknown or other
  misc_feature (249)..(249): n is a, c, g, or t
tcagtacacgtgatcacgaccggtgctcgatttagtgtgagtagtttgggtttgagtgactcctgtgccccaccatggacacactgtgctccacgctcctgctgctgaccatcccttcatgggtcttcgtcccagactcaccttggaaggagtctggtccgacgctggtacgaaacccaaacacgaccctcgacgctagacctgcctacctttctcgttcggtttctcacctccaccagtagaagaagnggtctggtgccgtgggtccgtccaccggcccccgaagggaaacgggtccgtaggtaccgtttcctacggaccgtcgttacggttttaggttcgggggttacgtcgtaggtacgtggggaccggtccgtaccgtaaccgtaccggtcccttaacttccgtttaccgttagggaaaaccgtaacccggacgggtacccttacccgaaaccgtactaccccggaacccgggaaaaccccggaaaccccccgaaaaccccccgtaaaaaaaccggcggggttaaccggaccttacccgtacgtaaccgtaaccgtaccgtaaccggtaaacggtttaccggaaccccgtgggtaacggaaccctaccggaaccgtaacccgtacccgtttaagttttacgttcggtacgtaacctaacccgtaaaccccttaaaccggacccgggcccgggttaaccggggacccggggtttaaccgtttacgtttaaccgtacgttacccgggggtaccgggacccggggttaacgggtacccgggttaaccgggttccccgaacccggttcccgttccccgtaaccggtaccccggttccccctaaaccccggttaaccccgggaaccccgggtaccccgtacccggtttacccccgggttcccccgtttacccccgggttccgggccccccgg

SEQ ID NO: 257575 - DNA, 985 bp, Homo sapiens
  misc_feature: GYAE6OF02I0MSY.34.14.B03.1.454.CMB.1.raw
  modified_base (117)..(117): a, c, t, g, unknown or other
  misc_feature (117)..(117): n is a, c, g, or t
  modified_base (146)..(146): a, c, t, g, unknown or other
  misc_feature (146)..(146): n is a, c, g, or t
tcagtacacgtgatcacgaccggtgctcgatttagtgtgagtagtttgggtttgagtgactcctgtgccccacatggacacactgtgctccacgctcctgctgctgaccatcccttnatgggtcttgtccagatcaccttgaaggnttctggtcccgacgctagggtacgaaaaccccaaacacgtaccccttcaaccggcttacggacccttaggcctacccgttttccgtttacctttcgggggttttttaccctacctaacctttacccgaaccccgtaaagggttacggaaaaaggggtaaaacgggtaccgggtccggtttaggggttacccggggtccccggttttaccgggggggtttaccccccgttccgtaaacccgggaccccccccggtaaaagggggtaaaaccggggggtccccgtttacgggtaccgggtttaacccgtaacgggtccgtacccgttttaaccggttttacgggtttgggggttcgttacgttacgggtacgttacggggaagtcccggtaacgttaaccgtacggtacccttaattacccttaccgtacggaacgaacccggtacggccctaacgtaccccaacgtaccgaaccggtaaacccggaaaccccgtaaaaacccccgaaacgtaaggtccgtaactaccgtacgtaactacgtaacgaaccgttaacggttccgtacccgtacggacgaccgaacgtacgtacccgtaacttagtttacgttacgtactaacccgtaaaccgaaaccccgtaacggccgtaccgggttacggtaccgggttaacgtttaccgttaacggtaccgttaccgggaccggggttcccggtaaccgggtacccgttccggttaccgtacccgttcccggttctaaccgtaccggtaacccaccgggttaacccgacccggcccgttaaccgttcccggttaccccgttccccggtaccgggtcccc
